United States Patent 8,362,325 (NUCLEOTIDE SEQUENCES AND CORRESPONDING POLYPEPTIDES CONFERRING MODULATED PLANT CHARACTERISTICS) - sequence listing, part 9

SEQ ID NO: 17688 - DNA, 1017 bp, Sorghum bicolor
  misc_feature: Ceres ANNOT ID no. 8681300
  misc_feature: Encodes the peptide sequence at SEQ ID NO 17689
atggacctacccaagccgccgtcgacggccgcctcgtcgtcgggggcggagacgccgaacccgcacgccttcacctgcgagctcccgcactcgatctacgcgctcgccttctcccccggcgcgcccgtcctcgcctccggcagcttcctcgaggacctccacaaccgcgtctccctgctctccttcgaccccgtccgcccctccgccgcctccttccgcgccctcccggcgctctccttcgaccacccctacccacccaccaagctccagttcaacccgcgcgccgccgcgccgtccctcctcgcctcctccgccgacacgctccgcatctggcacgccccgctcgacgacctctccgccaccgcctccgcgcccgagctccgctccgttctcgacaaccgcaaggccgcctccgagttctgcgcgcccctcacctccttcgattggaacgaggtcgagccccgccgtatcgggaccgcctccatcgacaccacctgcaccgtctgggacatcgatctcggcgtcgtggagacgcagctcatcgcgcacgacaaggccgtccacgacatcgcctggggggaggccggggtcttcgcctccgtgtcggccgacggctccgtccgcgtcttcgacctccgggacaaggaacactccaccatcgtctacgagagcccccgccccgacacgccgctcctcaggctggcgtggaaccgctctgacctccgctatatggccgcgctgctcatggacagcagcgccgtcgtcgtgctcgacatacgtgcgcccggggtgccggtggccgagctgcaccggcaccgggcgtgcgccaacgcagtcgcgtgggcgccgcaggccactaggcacctctgctcggctggggacgacgggcaggcactgatctgggaactgcccgagacggcggcgggtgccgaaataaaccaacttcagtgggcggccgcccacccggactggatggccatcgcctttgagaacaaggtccagcttcttagggtctga

SEQ ID NO: 17689 - protein, 338 aa, Sorghum bicolor
  misc_feature: Useful for making plants with altered lignin content
  misc_feature: Useful for making plants with altered terpenoid content
  misc_feature: Functional homolog of the protein sequence given in SEQ ID NO 14568
  misc_feature: Ceres ANNOT ID no. 8681300
  misc_feature (159)..(314): SWISSPROT Homolog: EC 2.3.1.48 Histone acetyltransferase
  misc_feature (174)..(211): Pfam ID: WD40 Pfam Description: WD domain, G-beta repeat
  misc_feature (263)..(302): Pfam ID: WD40 Pfam Description: WD domain, G-beta repeat
MDLPKPPSTAASSSGAETPNPHAFTCELPHSIYALAFSPGAPVLASGSFLEDLHNRVSLLSFDPVRPSAASFRALPALSFDHPYPPTKLQFNPRAAAPSLLASSADTLRIWHAPLDDLSATASAPELRSVLDNRKAASEFCAPLTSFDWNEVEPRRIGTASIDTTCTVWDIDLGVVETQLIAHDKAVHDIAWGEAGVFASVSADGSVRVFDLRDKEHSTIVYESPRPDTPLLRLAWNRSDLRYMAALLMDSSAVVVLDIRAPGVPVAELHRHRACANAVAWAPQATRHLCSAGDDGQALIWELPETAAGAEINQLQWAAAHPDWMAIAFENKVQLLRV

SEQ ID NO: 17690 - DNA, 780 bp, Sorghum bicolor
  misc_feature: Ceres ANNOT ID no. 8681303
  misc_feature: Encodes the peptide sequence at SEQ ID NO 17691
atggggaggggacgagttgagctgaagcggatcgagaacaagatcaaccgccaggtcaccttctccaagcgccgcaacggcctgctcaagaaggcgtacgagctctccgtgctctgcgacgccgaggtcgcgctcatcatcttctccagccgcggcaagctctacgagttcggcagcgccggcataactaaaacactagaaaggtatcaacattgctgctacaacgctcaagattccaatggtgcactctctgaaactcagagctggtaccaggaaatgtcaaaactgagggcaaaatttgaagccttgcagcgcactcagaggcacttgctcggggaggaccttggcccactgagtgttaaggaattgcagcagctagagaaacagctagaatgtgctttgtcacaggcaagacagagaaagacacaacttatgatggagcaagtggaagagcttcgcagaaaggagcgtcacctgggagaaatgaacaggcaactcaaacacaagcttgaagctgaaggttctagcaactacagaaccttgcagcatgccgccgcctggccagctcccggcggcaccatcgtggagcatgacggcgccacgtatcatgttcatccacctgctcactcagttgctatagactgtgaacccactctgcaaattgggtataatacctggtaccctcatcaccagtttctgccttctgatcaggcagccaataatatcccaaggaacgcccccggaggcgagaacaacttcatgctgggatgggttctttga

SEQ ID NO: 17691 - protein, 259 aa, Sorghum bicolor
  misc_feature: Useful for making plants with modulated flowering time
  misc_feature: Functional homolog of the protein sequence given in SEQ ID NO 13524
  misc_feature: The sequence is a functional homolog of SEQ ID NO 707 in the 10/666,642 US patent application
  misc_feature: Useful for making plants with altered alkaloid content
  misc_feature: Useful for making plants with altered terpenoid content
  misc_feature: Functional homolog of the protein sequence given in SEQ ID NO 13021
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 4 in US patent 7057087
  misc_feature: The sequence is a functional homolog of SEQ ID NO 30 in the 10/666,642 US patent application
  misc_feature: Useful for making plants with modulated biomass
  misc_feature: Functional homolog of the protein sequence given in SEQ ID NO 13569
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 6 in US patent 7279615
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 2 in US patent 7273968
  misc_feature: The sequence is a functional homolog of SEQ ID NO 46 in the 10/666,642 US patent application
  misc_feature: The sequence is a functional homolog of SEQ ID NO 730 in the 10/666,642 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 919 in the 10/666,642 US patent application
  misc_feature: The sequence is a functional homolog of SEQ ID NO 1701 in the 10/412,699 US patent application
  misc_feature: Useful for making plants with altered lignin content
  misc_feature: Functional homolog of the protein sequence given in SEQ ID NO 12944
  misc_feature: The sequence is a functional homolog of SEQ ID NO 1949 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1955 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8681303
  misc_feature (74)..(172): Pfam ID: K-box Pfam Description: K-box region
  misc_feature (9)..(59): Pfam ID: SRF-TF Pfam Description: SRF-type transcription factor (DNA-binding and dimerisation domain)
MGRGRVELKRIENKINRQVTFSKRRNGLLKKAYELSVLCDAEVALIIFSSRGKLYEFGSAGITKTLERYQHCCYNAQDSNGALSETQSWYQEMSKLRAKFEALQRTQRHLLGEDLGPLSVKELQQLEKQLECALSQARQRKTQLMMEQVEELRRKERHLGEMNRQLKHKLEAEGSSNYRTLQHAAAWPAPGGTIVEHDGATYHVHPPAHSVAIDCEPTLQIGYNTWYPHHQFLPSDQAANNIPRNAPGGENNFMLGWVL

SEQ ID NO: 17692 - DNA, 1461 bp, Sorghum bicolor
  misc_feature: Ceres ANNOT ID no. 8681309
  misc_feature: Encodes the peptide sequence at SEQ ID NO 17693
atgaaggcagccgccggaggaggcggcaaggagagcccagcggcctccctcctccgcttcgtcctcctgctccttctccctctcaccgtgctctacatcttctacaccctccacgtcattctctcctcaaccccgtcttgcccgccggcagaccccgtcagagccaagggcacgtcaaacgccttggcccacgtagtgttcggcattgcggcgtcggcgcgcctgtgggataagcggaaggagtacatcaagatctggtggcgtccaggcgggggcatgcggggcttcgtgtggatggaccgccccgtgcgggcttccagcgtgccggaggggctgccacccatcaaggtctcggcggacacctcccgcttcccctacacgcatcggcgcggccaccggtccgccatccgcatctctcgcatcatctctgagacctaccgcctcggccttcccgatgtgcggtggttcgtcatgggcgacgacgacaccgtcttcctcccggacaacctgctcgcggtgctcagcaggctcgaccaccggcagccctactacattggctcctcctcggagagccacctgcagaacatctacttctcgtatgggatggcgttcggcggcggcggtttcgccatcagccagccgctggcggcacggctggagcggatgcaggacgcgtgcatccggcggtacccgtcgctgtacggcagcgacgaccgcatccaggcgtgcatggcggagctgggcgtgccgctaacaaggcacccggggttccaccagtacgacgtgtacggggacctcctgggcctcctggccgcgcaccccgtcgcgccgctcgtgtcgctgcatcacctcgacgtggtgcgcccgctgttcccgaacgcgcggtcccgcccggccgcggtgcggaggctgttcgagggccccgtcatgctggactcggtcggggtgatgcagcagtccatatgctacgacgaggcgaagcggtggacggtgtcggtggcgtgggggttcgtggtgatggtggcgaggggcgtgatctcgccgcgggagatggagacccccgcgcggacgttcctcaactggtaccgacgcgccgactacaagtcgcacgctttcaacacgcggccgctggcgcgcaaaccgtgcgagcgccccgcgctgtattacctggccgctgcgcgccgtgcggtggcgcgcgacggcgagaccactgtgacgaggtaccagcggtggcggcggcgtgacgaggttcgcccggtgtgccggtggaagatcccagaccccgacacgctgctcgacagcgtgctcgtggttaagaagcccgatcccgcactgtgggataagtctccgagacggaattgctgcagagtgctgtcgtctcccggggcaggggaggacggcaacaagacgatgaccatagacgttagtgtatgtgaggactgggggatcaagcaacggtaa

SEQ ID NO: 17693 - protein, 486 aa, Sorghum bicolor
  misc_feature: Useful for making plants with altered carbohydrate content
  misc_feature: Functional homolog of the protein sequence given in SEQ ID NO 14169
  misc_feature: Ceres ANNOT ID no. 8681309
  misc_feature (150)..(225): SWISSPROT Homolog: EC 2.4.1.122 Glycoprotein-N-acetylgalactosamine 3-beta-galactosyltransferase
MKAAAGGGGKESPAASLLRFVLLLLLPLTVLYIFYTLHVILSSTPSCPPADPVRAKGTSNALAHVVFGIAASARLWDKRKEYIKIWWRPGGGMRGFVWMDRPVRASSVPEGLPPIKVSADTSRFPYTHRRGHRSAIRISRIISETYRLGLPDVRWFVMGDDDTVFLPDNLLAVLSRLDHRQPYYIGSSSESHLQNIYFSYGMAFGGGGFAISQPLAARLERMQDACIRRYPSLYGSDDRIQACMAELGVPLTRHPGFHQYDVYGDLLGLLAAHPVAPLVSLHHLDVVRPLFPNARSRPAAVRRLFEGPVMLDSVGVMQQSICYDEAKRWTVSVAWGFVVMVARGVISPREMETPARTFLNWYRRADYKSHAFNTRPLARKPCERPALYYLAAARRAVARDGETTVTRYQRWRRRDEVRPVCRWKIPDPDTLLDSVLVVKKPDPALWDKSPRRNCCRVLSSPGAGEDGNKTMTIDVSVCEDWGIKQR

SEQ ID NO: 17694 - DNA, 846 bp, Sorghum bicolor
  misc_feature: Ceres ANNOT ID no. 8681313
  misc_feature: Encodes the peptide sequence at SEQ ID NO 17695
atggtctccgccagcgcgccgccgccgccgctgcagtccgatgcggccgggtcgggggaggacgcgagcaagaaggtgcggaagccgtacaccatcactaagtcgcgcgagagctggacggagcaggagcacgacaagttcctcgaggccctgcagctctttgaccgtgactggaagaagatagaggcttttgttggctccaagactgtcatccagattaggagccatgcacagaagtactttttgaaggttcagaaaaatggaaccagtgaacatgtcccgcctccacgacctaagcgaaaagctgctcatccatatcctcagaaggcttccaagaatgaaccaaactatgggctcaagacagattcatcttccatccataggaactctggcatgaatgtgtctgtttcttcatgggctcatagttccatcccacaagctgttgcttcaacgatggtgaaagaagatttaggtgctggaacaccaggtccaaataatttttgctcaagcagtactgaaggccctccaagaacatggcaacctggtgaaacaaatgatcaaataaatcaagttccgtcactccttatgccagattttgcggaagtgtacagcttcttaggtagtgttttcgatccaagcacaagtggtcatctgcagaaacttaaggagatgaatccaattgatgttgagacggcactgttgttgatgaggaacctatccatcaatttgacgagtcctgattttgaagaccaaaggaagttgttgtcttcatatagcacttctgatggacttcagctagggagctccaggagttcagctctagcgatgagtacgcctttcatgtaa

SEQ ID NO: 17695 - protein, 281 aa, Sorghum bicolor
  misc_feature: The sequence is a functional homolog of SEQ ID NO 146 in the 10/412,699 US patent application
  misc_feature: Useful for biocontainment applications
  misc_feature: Functional homolog of the protein sequence given in SEQ ID NO 14569
  misc_feature: The sequence is a functional homolog of SEQ ID NO 392 in the 10/666,642 US patent application
  misc_feature: The sequence is a functional homolog of SEQ ID NO 1049 in the 11/479,226 US patent application
  misc_feature: The sequence is a functional homolog of SEQ ID NO 454 in the 10/412,699 US patent application
  misc_feature: The sequence is a functional homolog of SEQ ID NO 1752 in the 10/412,699 US patent application
  misc_feature: The sequence is a functional homolog of SEQ ID NO 1974 in the 10/374,780 US patent application
  misc_feature: The sequence is a functional homolog of SEQ ID NO 337 in the 11/479,226 US patent application
  misc_feature: Ceres ANNOT ID no. 8681313
  misc_feature (36)..(81): Pfam ID: Myb_DNA-binding Pfam Description: Myb-like DNA-binding domain
MVSASAPPPPLQSDAAGSGEDASKKVRKPYTITKSRESWTEQEHDKFLEALQLFDRDWKKIEAFVGSKTVIQIRSHAQKYFLKVQKNGTSEHVPPPRPKRKAAHPYPQKASKNEPNYGLKTDSSSIHRNSGMNVSVSSWAHSSIPQAVASTMVKEDLGAGTPGPNNFCSSSTEGPPRTWQPGETNDQINQVPSLLMPDFAEVYSFLGSVFDPSTSGHLQKLKEMNPIDVETALLLMRNLSINLTSPDFEDQRKLLSSYSTSDGLQLGSSRSSALAMSTPFM

SEQ ID NO: 17696 - DNA, 924 bp, Sorghum bicolor
  misc_feature: Ceres ANNOT ID no. 8681325
  misc_feature: Encodes the peptide sequence at SEQ ID NO 17697
atgggcgccgccaccaccaacggctcggcggaccccgcgcccgcgccggtgccggcgctcaagttcctcatctacgggcgcacgggctggatcgggggcctgctgggcggcctctgcgcggcgcgcgggatccccttcgcgtacggcgccggcaggctcgagagccgcgcgtcgctcgaggccgacatcgacgccgcgtcgcccacgcacgtgttcaacgccgcgggcgtcacgggccgccccaacgtcgactggtgcgagacgcaccgcgccgagaccatccgcgccaacgtcgtgggcacgctcacgctcgccgacgtctgccggggccgcgggctcgtcctcatcaactacgccacgggatgcatcttcgagtacgacgagggccacccgctcggctccgggctcggattcaaggaggaggacacgcccaacttcgtcggatcattctactccaaaactaaggccatggttgaggagctgctcaagaactacgagaatgtatgcacccttcgtgtaaggatgcctatttcatcggatctctccaaccctcgcaatttcattaccaaaatcacccgatatgacaaggttgttaacatcccaaattcaatgacaatattggatgagcttcttcccatctcaattgaaatggcaaagagaaacctcactggaatatggaacttcacaaaccctggggtggtgagccacaatgaaatactagagatgtacagagattacattgatccaagcttctcctggaaaaacttcaacttggaggagcaagcaaaggtcatagttgcaccaaggagcaacaatgagcttgatcaaaccaaattgaagagagagttcccagagcttttgtcaatcaaggagtcactgatcaaatatgtttttgaaccaaattgtaagacgtccaaggcttga

SEQ ID NO: 17697 - protein, 307 aa, Sorghum bicolor
  misc_feature: Useful for making plants with altered carbohydrate content
  misc_feature: Functional homolog of the protein sequence given in SEQ ID NO 14570
  misc_feature: Useful for making plants with altered cell wall content and/or composition
  misc_feature: Functional homolog of the protein sequence given in SEQ ID NO 14213
  misc_feature: Ceres ANNOT ID no. 8681325
  misc_feature (15)..(280): SWISSPROT Homolog: EC 1.1.1.133 dTDP-4-dehydrorhamnose reductase
  misc_feature (22)..(218): Pfam ID: Epimerase Pfam Description: NAD dependent epimerase/dehydratase family
MGAATTNGSADPAPAPVPALKFLIYGRTGWIGGLLGGLCAARGIPFAYGAGRLESRASLEADIDAASPTHVFNAAGVTGRPNVDWCETHRAETIRANVVGTLTLADVCRGRGLVLINYATGCIFEYDEGHPLGSGLGFKEEDTPNFVGSFYSKTKAMVEELLKNYENVCTLRVRMPISSDLSNPRNFITKITRYDKVVNIPNSMTILDELLPISIEMAKRNLTGIWNFTNPGVVSHNEILEMYRDYIDPSFSWKNFNLEEQAKVIVAPRSNNELDQTKLKREFPELLSIKESLIKYVFEPNCKTSKA

SEQ ID NO: 17698 - DNA, 1290 bp, Sorghum bicolor
  misc_feature: Ceres ANNOT ID no. 8681329
  misc_feature: Encodes the peptide sequence at SEQ ID NO 17699
atggacatagagaccgacgggcgattcggcaacaagcgagtgcaccatcgcctcggcccgggctccggcggtgctccgtcatctaccaacggcaaggtctgcaactactggcgcgccgggcggtgcaaccgtttcccgtgccccttcctccacagcgagctccccgaggctgcgccgcccaagcgccccagtggacccggggggaacgtctggcgcaacccccacaccggaggaagaggcggcggcggcggcggtcacagtagatgggggaagggccccggaggcggcagcgggattgtgagccacaagccgcctgacaggccctgcaagttctttctcgccggtaccgaatgcagctatggcgagaggtgccgctatccgcacagctactgcataagcgatagtgtcacgatgcttaccccgctcaagggccatgagaagggtgttacgggcattgcattacccgcggggtcagacaagctgtattccggtagtaaggatggaactgttcgcatgtgggattgccaaactggccagtgtgccggtatcatccctgttggtcgtgaggttgggtgcatgatcattgaaggtccatggttatttgttggaatgcctgatgcagtgaaggtttggaatatgcaaacagcagcggaaatgagccttaccggaccaactgggcaagtctatgcactcgccgttgccagtgagttactctttgctgcaacacaagacgggaggattttagcatggagatttagtgctgcaactaactgttttgaaccagctgcttctcttgatggccataagcttgctgttgtttcattgatagtaggaggcatgaggctttattctgcttcgatggataaaactatcagagtatgggatttggcaacactgcagtgcatacagactctttctgatcataccgatgttgttatgtctgtgctgtgctgggatcaatttctattatcttgctctttggatcaaacaataaaagtttgggcagctacagagagtggaaacttagaagtaacatatacgcacaaagaagatcagggtgcacttgccctcagtggtatgcctgatgcacagtcaaaacctgtgctattgtgttcattaaatgacaacactgtccgcctatatgatttgccatcgttcaatgatcgaggcagactattctccaaacaagaaattagggcaatacaaatgggtcctggtggtttattttttaccggggatggaactggtgagctaaaggtttggcagtgggtagatggagcccaaacctaa

SEQ ID NO: 17699 - protein, 429 aa, Sorghum bicolor
  misc_feature: Useful for making plants with altered terpenoid content
  misc_feature: Functional homolog of the protein sequence given in SEQ ID NO 13137
  misc_feature: Useful for making plants with modulated biomass
  misc_feature: Functional homolog of the protein sequence given in SEQ ID NO 12972
  misc_feature: Ceres ANNOT ID no. 8681329
  misc_feature (128)..(334): SWISSPROT Homolog: EC 2.7.11.7 [Myosin heavy-chain] kinase
  misc_feature (136)..(174): Pfam ID: WD40 Pfam Description: WD domain, G-beta repeat
  misc_feature (299)..(335): Pfam ID: WD40 Pfam Description: WD domain, G-beta repeat
  misc_feature (259)..(295): Pfam ID: WD40 Pfam Description: WD domain, G-beta repeat
  misc_feature (104)..(130): Pfam ID: zf-CCCH Pfam Description: Zinc finger C-x8-C-x5-C-x3-H type (and similar)
MDIETDGRFGNKRVHHRLGPGSGGAPSSTNGKVCNYWRAGRCNRFPCPFLHSELPEAAPPKRPSGPGGNVWRNPHTGGRGGGGGGHSRWGKGPGGGSGIVSHKPPDRPCKFFLAGTECSYGERCRYPHSYCISDSVTMLTPLKGHEKGVTGIALPAGSDKLYSGSKDGTVRMWDCQTGQCAGIIPVGREVGCMIIEGPWLFVGMPDAVKVWNMQTAAEMSLTGPTGQVYALAVASELLFAATQDGRILAWRFSAATNCFEPAASLDGHKLAVVSLIVGGMRLYSASMDKTIRVWDLATLQCIQTLSDHTDVVMSVLCWDQFLLSCSLDQTIKVWAATESGNLEVTYTHKEDQGALALSGMPDAQSKPVLLCSLNDNTVRLYDLPSFNDRGRLFSKQEIRAIQMGPGGLFFTGDGTGELKVWQWVDGAQT

SEQ ID NO: 17700 - DNA, 1002 bp, Sorghum bicolor
  misc_feature: Ceres ANNOT ID no. 8681331
  misc_feature: Encodes the peptide sequence at SEQ ID NO 17701
atgcctgcgcgtccccatccccgtcccccggccccgcgagctccagctggttccgacccacttcgagcccgacgagcccgccctctctccccaagtcccgagcaccccctaccagaccgacccatcaagtcgcactacctggctggcgcctcccgagccgcaccgcgttggaacagtgcacgcggccacgtcgctctccacgcgctaacctatataacccgccacctttccctccaaatttcaaatcaaatgctccgacacacgttcctcctcccccccgctcgccacggccaccaccacacccgcccttcacccatggacgccgcatccttcagcgactactcctctggaacgccgtcccctgtcggtggcgtcagcggcggcgtggacggcgacgacggcggctcctcctcgtcgtacatgacggtgtcgtcggcgccgccgaagcggcgagccgggcggaccaagttcaaggagacgcggcaccccgtgtacaagggcgtgcggcggaggaaccccgggaggtgggtctgcgaggtgcgggagccgcacggcaagcagcggatatggctcgggaccttcgagaccgccgagatggcggcgcgcgcgcacgacgtcgccgcgctcgcgctgcgggggcgcgccgcctgcctcaacttcgcagactcgccgcggctcctcagggtgccgcccatgggctccggccatgacgagatacgccgggcggccgccgtcgcggcggaccagttccggccggcgcctgatcgtcagggcaatgtggccaccgccgaggaggcggcggatactacgccgctggatgcgacgacgcagagcgtagtcgatgacccgtactgcattatcgacgacaggctcgacttcgggatgcaggggtacctcgacatggcgcaagggatgctcattgatccaccacccatggctggttcgtccaccagtggcggtgacgacgatgacgacggtgaggtcaagctctggagctactga

SEQ ID NO: 17701 - protein, 333 aa, Sorghum bicolor
  misc_feature: Useful for making plants with modulated water use efficiency
  misc_feature: Functional homolog of the protein sequence given in SEQ ID NO 13860
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: The sequence is a functional homolog of SEQ ID NO 1223 in the 10/374,780 US patent application
  misc_feature: The sequence is a functional homolog of SEQ ID NO 1412 in the 10/412,699 US patent application
  misc_feature: The sequence is a functional homolog of SEQ ID NO 716 in the 11/435,388 US patent application
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 4 in US patent 7317141
  misc_feature: The sequence is a functional homolog of SEQ ID NO 750 in the 11/435,388 US patent application
  misc_feature: The sequence is a functional homolog of SEQ ID NO 1245 in the 10/374,780 US patent application
  misc_feature: Useful for making plants with altered terpenoid content
  misc_feature: Useful for making plants with modulated flowering time
  misc_feature: Functional homolog of the protein sequence given in SEQ ID NO 13195
  misc_feature: The sequence is a functional homolog of SEQ ID NO 1248 in the 10/374,780 US patent application
  misc_feature: Ceres ANNOT ID no. 8681331
  misc_feature (163)..(214): Pfam ID: AP2 Pfam Description: AP2 domain
MPARPHPRPPAPRAPAGSDPLRARRARPLSPSPEHPLPDRPIKSHYLAGASRAAPRWNSARGHVALHALTYITRHLSLQISNQMLRHTFLLPPARHGHHHTRPSPMDAASFSDYSSGTPSPVGGVSGGVDGDDGGSSSSYMTVSSAPPKRRAGRTKFKETRHPVYKGVRRRNPGRWVCEVREPHGKQRIWLGTFETAEMAARAHDVAALALRGRAACLNFADSPRLLRVPPMGSGHDEIRRAAAVAADQFRPAPDRQGNVATAEEAADTTPLDATTQSVVDDPYCIIDDRLDFGMQGYLDMAQGMLIDPPPMAGSSTSGGDDDDDGEVKLWSY

SEQ ID NO: 17702 - DNA, 2121 bp, Sorghum bicolor
  misc_feature: Ceres ANNOT ID no. 8681345
  misc_feature: Encodes the peptide sequence at SEQ ID NO 17703
atgggggtccgctcggcggccacgaagctgcacatcccgccgtccgccgcccgcggcggccgccccacgttcctgccgttcgtggccgtcttcctcctctgctccgcctcctacctagtcggcgtctggcagcacggcggcttcgcctcctcctccccatcctcctcccccggcgccgtctccatcgccacctccgtcgcctgcaccaccaccaacaccgccgccgccgccaccccgaagaggagaacccggtacgccacctcccgctcccgcaccacctccccatccctcgacttctccgtgcgccacgccgcggccatcgcgctcgacgatgccgacggcaccgcctcgcccggcgcctcctcctcctcggccaccccgcggaggtacccggcgtgcgcggccaagtactccgagtacacgccgtgcgaggacgtggagcggtcgctgcggttcccacgggaccgcctggtgtaccgggagcgccactgcccggcgtcggagcgggaggtgctgcggtgcctggtgccggccccggccgggtaccggacaccgttcccgtggcccgccagccgcgacgtcgcctggttcgccaacgtgccgcacaaggagctcaccgtcgagaaggcggtgcagaactggatccgcgtcgacggcgacaagctcaggttccccggcggcgggaccatgttccccaacggcgccgacgcgtacatcgacgacattgggaagctcatcccgctccacgacggctccatccgcaccgcgctcgacaccggatgcggggtggcgagctggggcgcgtacctgctgtcgcgggacatcctggccatgtcgttcgcgccgcgggactcccatgaggcgcaggtgcagttcgcgctggagcgcggcgtgccggccatgatcggcgtcctcgcgtccaaccgcctcacctacccggcccgcgcctttgacatggcgcactgctcccgctgcctcatcccctggcaactctacgatggactgtacctgatcgaggttgaccgtgtgctgcgtcccggagggtactggatcctgtccgggccgccaatcaactggaagaagtactggaaggggtgggagcgaaccaaggaggacctcaacgccgagcagcaggccatcgaggccgtcgccaggagcctctgctggaccaaggtcaaggaggccggcgacatcgccgtctggcagaagccctacaaccacgccgactgcaaggcctcccggccgagcaaggcctccaagtccccgcccttctgctcgcgcaagaaccccgacgccgcttggtacgacaagatggaggcgtgcataacgccgctgccggaggtctctagcgccaaggacgtcgccggcggcgcggtgaagaaatggccgcagcggctcacggccgtgccgcccagggtctcccgcggcgccgtcaagggcgtgacggccaagtcgttcgcgcaggacacggagctgtggcggaagagggtccggcactacaagtcggtgatcagcgagttcgagcagaaggggcggtaccgcaacgtgcttgacatgaacgcgcgcctgggcgggttcgccgcggcgctggcgacggccggcgacccgctgtgggtcatgaacatggtccccaccgtcgggaacaccaccacgctcggggccatctacgagcgcgggctcatcggaagctaccaggactggtgcgagggcatgtctacctacccgaggacctacgatctcatccatgcggattcggtgttcaccctgtacaagaacaggtgtgagatggatcgcatccttctggagatggacagggtcctgaggcccaggggcacggtgatcatcagggaagacgtggacatgctggtgaaggtcaagagcgtagcggacgggatgaggtgggagagccagatcgtcgaccacgaagacggcccgctcgtcagggagaagatcctcctggttgtgaagactacatttattgggccgcctattgaagcccatatagcctcattccagattaagggcttgcttgggtggatcatgcggctgtgccaagatttcagcccaaacaagcccaaaaagatttttgctaaacagctgtttgcacgcttaactgtttga

SEQ ID NO: 17703 - protein, 706 aa, Sorghum bicolor
  misc_feature: The sequence is a functional homolog of SEQ ID NO 1593 in the 11/479,226 US patent application
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 758 in the 10/412,699 US patent application
  misc_feature: Useful for making plants with altered cell wall content and/or composition
  misc_feature: Functional homolog of the protein sequence given in SEQ ID NO 13686
  misc_feature: Ceres ANNOT ID no. 8681345
MGVRSAATKLHIPPSAARGGRPTFLPFVAVFLLCSASYLVGVWQHGGFASSSPSSSPGAVSIATSVACTTTNTAAAATPKRRTRYATSRSRTTSPSLDFSVRHAAAIALDDADGTASPGASSSSATPRRYPACAAKYSEYTPCEDVERSLRFPRDRLVYRERHCPASEREVLRCLVPAPAGYRTPFPWPASRDVAWFANVPHKELTVEKAVQNWIRVDGDKLRFPGGGTMFPNGADAYIDDIGKLIPLHDGSIRTALDTGCGVASWGAYLLSRDILAMSFAPRDSHEAQVQFALERGVPAMIGVLASNRLTYPARAFDMAHCSRCLIPWQLYDGLYLIEVDRVLRPGGYWILSGPPINWKKYWKGWERTKEDLNAEQQAIEAVARSLCWTKVKEAGDIAVWQKPYNHADCKASRPSKASKSPPFCSRKNPDAAWYDKMEACITPLPEVSSAKDVAGGAVKKWPQRLTAVPPRVSRGAVKGVTAKSFAQDTELWRKRVRHYKSVISEFEQKGRYRNVLDMNARLGGFAAALATAGDPLWVMNMVPTVGNTTTLGAIYERGLIGSYQDWCEGMSTYPRTYDLIHADSVFTLYKNRCEMDRILLEMDRVLRPRGTVIIREDVDMLVKVKSVADGMRWESQIVDHEDGPLVREKILLVVKTTFIGPPIEAHIASFQIKGLLGWIMRLCQDFSPNKPKKIFAKQLFARLTV

SEQ ID NO: 17704 - DNA, 1788 bp, Sorghum bicolor
  misc_feature: Ceres ANNOT ID no. 8681371
  misc_feature: Encodes the peptide sequence at SEQ ID NO 17705
atggcatccaattcatcagcggcggctgtggcagctatgtttggaattagggatgccgaccaccaagaccagatgaagccgctgcttgcgcagcagcaccagcagctgcttcctcctgcgccactgctcagcgccgccgcttcgtcgtcggcggtgtccggccaggcgacaggggcatcaccgccgccagtgaagaagaagagaaacctaccagcagaccctgacgcggaggtgatcgcgctgtcgcccaagacgctgctggcgacgaaccggttcgtgtgcgaggtgtgcaacaaggggttccagcgtgagcagaacctgcagctgcaccggcgcggccacaacctgccgtggaagctgaagcagaaggaccccgcgcaggcgcagcggcggcgcgtgtacctgtgcccggagccgacgtgcgcgcaccacgacccgtcccgcgccctcggcgacctcaccgggatcaagaagcacttctgccgcaagcacggcgagaagaagtggaagtgcgacaagtgctccaagcgctacgccgtgcagtccgactggaaggcgcactccaaggtctgcggcacacgcgagtatcgctgcgactgcggcacactcttctcgcggagggatagcttcatcacccacagggctttctgcgacgccctcgcgcaggagagcgcccggctgccgcccccaggcctcaccgccagccacctctacggcgccaccagcgcggccaacatggggctcagcctctcgcaggtcggttcccacctcgcatccaccctcggtgcggacgctcacagccaccatcaggacctgctccggctcggcggcggcagcgccgcgagccgtcttgaccatcttctggggccatccaacgccgcctccgcgttccgccccctgccgcctccaccgtcgtcggcgttcctcatgggcgcgccgcaggagtttgctggcgacggcgacggcactgggtcccacgggttcttgcagggcaagccgttccacggtctcatgcacctgccggatctccaaggcaacggcgccgggggtccctcggcgtcgtcggctccgggtctcttcaaccttggctacatcgcaaacagtgcaaatagctcaggtacttccagccatggccatgcaagccagggacacctgacaagtgatcagttcagcgaaggaggtggtggtggtggtggtggcggcggcggcggcggcggcggctcggagtcatcggctgcgatgcttttcagcggcggcgggaatttctccggtggtgaccaccaagttgctcctggcgggatgtacaacaacgatccggccgtgatgctgccgcagatgtctgcgacggcgcttctgcagaaggcgtcccagatgggttccagcgcgagcgcgcagggcggcgtgtccgtgtttggaggcctcgtcggctcgtcggcgccctcggctatgcacgcccggccacccatgctcgaccagagccagatgcacctccagagcttgatgaactcgctggctgccggcggcatgtttggcggcgccaacagcggcagcatgattgacccgaggatgtatgacatggatcaagatgtgaagtttaaccagcagggcggccgtggtggcgctgagatgacgcgcgacttccttggcgtcggtggcggtggtgtcatgagggggatgacggtgccgagaggggggcaccaaacagacggtgccgcgggtgacatgagctccttggaggccgaaatgaagtcagcctcgtcacccttcactggaagcaggatgcaataa

SEQ ID NO: 17705 - protein, 595 aa, Sorghum bicolor
  misc_feature: Useful for making plants with altered lignin content
  misc_feature: Functional homolog of the protein sequence given in SEQ ID NO 13275
  misc_feature: The sequence is a functional homolog of SEQ ID NO 1087 in the 10/666,642 US patent application
  misc_feature: Ceres ANNOT ID no. 8681371
  misc_feature (92)..(114): Pfam ID: zf-C2H2 Pfam Description: Zinc finger, C2H2 type
MASNSSAAAVAAMFGIRDADHQDQMKPLLAQQHQQLLPPAPLLSAAASSSAVSGQATGASPPPVKKKRNLPADPDAEVIALSPKTLLATNRFVCEVCNKGFQREQNLQLHRRGHNLPWKLKQKDPAQAQRRRVYLCPEPTCAHHDPSRALGDLTGIKKHFCRKHGEKKWKCDKCSKRYAVQSDWKAHSKVCGTREYRCDCGTLFSRRDSFITHRAFCDALAQESARLPPPGLTASHLYGATSAANMGLSLSQVGSHLASTLGADAHSHHQDLLRLGGGSAASRLDHLLGPSNAASAFRPLPPPPSSAFLMGAPQEFAGDGDGTGSHGFLQGKPFHGLMHLPDLQGNGAGGPSASSAPGLFNLGYIANSANSSGTSSHGHASQGHLTSDQFSEGGGGGGGGGGGGGGGSESSAAMLFSGGGNFSGGDHQVAPGGMYNNDPAVMLPQMSATALLQKASQMGSSASAQGGVSVFGGLVGSSAPSAMHARPPMLDQSQMHLQSLMNSLAAGGMFGGANSGSMIDPRMYDMDQDVKFNQQGGRGGAEMTRDFLGVGGGGVMRGMTVPRGGHQTDGAAGDMSSLEAEMKSASSPFTGSRMQ

SEQ ID NO: 17706 - DNA, 1269 bp, Sorghum bicolor
  misc_feature: Ceres ANNOT ID no. 8681376
  misc_feature: Encodes the peptide sequence at SEQ ID NO 17707
atggggaataataacggggcgagctcctcgtcgtcgcggctggacccggcgccgctgctgccgcaccacggcagcgggagccgcgaggtcggcctgtcgtcgcagcccaagacgttcgccaacgtcttcatcgcggtggtgggcgccggcgtgctgggactgccgtacaccttctcgcacaccgggtgggcggcggggacgctgctgctcttctccgtcgccgcgctcaccttctactgcatgatgctgctcgtcgcgtgccgccgccgcctcgccgacgagcaccctaagatcgcctcgttcggggacctcggggacgccgtgttcggcgcgcacggccggttcgccgtcgacgtcatgctggtgctcagccaagtcagcttctgcgtcggctacctcatcttcatctctaacaccatggcgcacctctacccgattaccgcgccgtcctcctcggccctcctctcccccaaggcgctcgtcatctgggcgatgctgccgttccagctcgggctcaattccatcaagacgctcacgctgctcgcgccactcagcatcttcgccgacgtcgtcgacctcggcgccatgggcgtggtgcttggccaggacgttgccgcctgggtcgctaagcccgtgcccgtggccgccttcggcgggcctgccgcgcttctctacggtctcggcgtctccgtgtacgcgttcgagggcgtcggcatggtgctgccgctggaggccgaggcggcgaacaagaagaagttcggcgtcacgctggggctgtccatggcgttcatcgccgtcatgtacgggctgttcggcgtgatggggtacgtcgcgttcggcgacgccacgcgggacatcatcaccacaaacctcggcgccgggtggctgtcggccgccgtgcagctggggctctgcatcaacctcttcttcacgatgccggtgatgatgaaccccgtgtacgaggtcgccgagcgcctgctccacgggaagcgctactgctggtggctgaggtggctgctcgtcatcgtcgtcggactcgccgccatgtacgtgcccaacttcacggacttcctggcgctcgtcgggagcagcgtctgcgtcctcctcggcttcgtgctgccggcctcgttccacctcaaggtgttcggcggcgagatggaatggcccggagtggtatccgatgtcctgctggtcgtgatcggcctctcgctcgccgtgttcgggacgtacacgtcgctgctgcaaatcttccactcgtcaagcgcttga

SEQ ID NO: 17707 - protein, 422 aa, Sorghum bicolor
  misc_feature: Useful for making plants with modulated nitrogen use efficiency
  misc_feature: Functional homolog of the protein sequence given in SEQ ID NO 13145
  misc_feature: Ceres ANNOT ID no. 8681376
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (31)..(414): Pfam ID: Aa_trans Pfam Description: Transmembrane amino acid transporter protein
MGNNNGASSSSSRLDPAPLLPHHGSGSREVGLSSQPKTFANVFIAVVGAGVLGLPYTFSHTGWAAGTLLLFSVAALTFYCMMLLVACRRRLADEHPKIASFGDLGDAVFGAHGRFAVDVMLVLSQVSFCVGYLIFISNTMAHLYPITAPSSSALLSPKALVIWAMLPFQLGLNSIKTLTLLAPLSIFADVVDLGAMGVVLGQDVAAWVAKPVPVAAFGGPAALLYGLGVSVYAFEGVGMVLPLEAEAANKKKFGVTLGLSMAFIAVMYGLFGVMGYVAFGDATRDIITTNLGAGWLSAAVQLGLCINLFFTMPVMMNPVYEVAERLLHGKRYCWWLRWLLVIVVGLAAMYVPNFTDFLALVGSSVCVLLGFVLPASFHLKVFGGEMEWPGVVSDVLLVVIGLSLAVFGTYTSLLQIFHSSSA

SEQ ID NO: 17708 - DNA, 1422 bp, Sorghum bicolor
  misc_feature: Ceres ANNOT ID no. 8681378
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 17709
atgggcaattgctttggctccgacgtgcccgaggttggggccgtcaaagcaatggcgcacgcccatcacgcgcacccccaagtggcaatggcgaagcgcgtcatggccgcgcccagtcctgcccatcacgccgcggtgagccagcaaggggtgcccgggaagaagtcgccgccgagcacggccacgaccacgaccacaggaggcaccgccagcaagcgccccgctgcgggtggcggagccgcgacgagcggcggcggcggcggcgagcctagtcgtcatcagccggtggacgggaggatcctggaggttccgaacctccgggtgttcacgttcgcggagctcagggcggccacccggaacttcaaggcggacaccgtggtcggcgagggcgggttcgggcgggtccacaagggctgggtcgacgagcggaccatgagccccgcccggaacggcgccggcgtgcccgtcgccgtcaagaagctcaaccccgagagcttgcagggcgtgcaggaatggcagtctgaggtgaatttcctggggaggctttcgcatcccaatctggtgaggctgctggggtactgctgggaggacaaggagctcctgctggtgtacgagtacatggccaagggcagcctggagaaccacctgttcagaagcgagccacgcaagggcggagcagccgtgcaccagccgctgctgccgtggagcctccggctgcgcatcgccatcggcgccgcccgcgggctcgccttcctccactcgtcggagaagcacgtcatctaccgggacttcaaggcgtccaacatcctcctggacacgcacttcaacgccaagctctccgacttcgggctcgccaaggatggccccgccggcggcagcagccacgtgacgacccgggtcatgggaacctacgggtacgcggcgccggagtacgtcgccacgggccacctgtacgtgaagagcgacgtgtacggcttcggcgtggtgctgctggagatcctgacggggctgcgcgcgctggacacggaccggccggcggcgcagcacaacctggtggactgggccaagccctacctggcggaccgcaggaagctggcgcgcctggtggacccccgcctcgagggccagtacccgtcgcggggcgcgcagcgcgcggcgcagctcacgctgcgctgcctcgccgccgaccacaagaaccgcccttccatgcgggaggtcgtcgccgtgctcgaggagatcgagtccatgtcgttgtcatccagggcggcggcgcggttggatggctcggcgtccccgcgtcccccaacggcgcggaacgggcacagccagcgccctgggtcggggtccagcttggactgggctggcccggctccggctggcggccacagtgcccacccgtctgctagagtgacaacaagatag

SEQ ID NO: 17709 - protein, 473 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8681378
  misc_feature (92)..(414): SWISSPROT Homolog: EC 2.7.11.1 Non-specific serine/threonine protein kinase
  misc_feature (121)..(410): Pfam ID: Pkinase Pfam Description: Protein kinase domain
MGNCFGSDVPEVGAVKAMAHAHHAHPQVAMAKRVMAAPSPAHHAAVSQQGVPGKKSPPSTATTTTTGGTASKRPAAGGGAATSGGGGGEPSRHQPVDGRILEVPNLRVFTFAELRAATRNFKADTVVGEGGFGRVHKGWVDERTMSPARNGAGVPVAVKKLNPESLQGVQEWQSEVNFLGRLSHPNLVRLLGYCWEDKELLLVYEYMAKGSLENHLFRSEPRKGGAAVHQPLLPWSLRLRIAIGAARGLAFLHSSEKHVIYRDFKASNILLDTHFNAKLSDFGLAKDGPAGGSSHVTTRVMGTYGYAAPEYVATGHLYVKSDVYGFGVVLLEILTGLRALDTDRPAAQHNLVDWAKPYLADRRKLARLVDPRLEGQYPSRGAQRAAQLTLRCLAADHKNRPSMREVVAVLEEIESMSLSSRAAARLDGSASPRPPTARNGHSQRPGSGSSLDWAGPAPAGGHSAHPSARVTTR

SEQ ID NO: 17710 - DNA, 870 bp, Sorghum bicolor
  misc_feature: Ceres ANNOT ID no. 8681414
  misc_feature: Encodes the peptide sequence at SEQ ID NO 17711
atggaggggaaagaggaggacgtgcgcctgggcgccaacaagttctcggagcggcagcccatcgggacggcggcgcagggcgccggggacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccaactccaagtgcgccaccgtcggcatccagggcatcgcctggtccttcggagggatgatcttcgcgctcgtctactgcaccgccggcatctccggagggcacatcaacccagctgtgactttcgggctgttcttggccaggaagctgtccctgactagggccatcttctacattatcatgcaatgcctgggtgccatctgtggagctggagtggtgaagggcttccagcaggggctttacatgggcaacggtggtggtgccaatgttgtcgcccccggctacaccaagggtgatggccttggcgctgagatcgttggcaccttcatcctggtctacaccgtcttctcggccactgatgccaagaggaatgccagggactcccatgttcctatccttgccccactgccaattgggttcgcggtgttcctggtccaccttgccaccatccccattactggcactggcatcaacccagctaggagccttggcgctgccatcatctacaacagggatcatgcctggagcgaccattggatcttctgggtcggccccttcattggtgctgccctggctgccatctaccaccaggtgatcatcagggccatcccgttcaagagcaggtcttaa

SEQ ID NO: 17711 - protein, 289 aa, Sorghum bicolor
  misc_feature: Useful for making plants with modulated water use efficiency
  misc_feature: Functional homolog of the protein sequence given in SEQ ID NO 14289
  misc_feature: Useful for making plants with modulated drought sensitivity
  misc_feature: Functional homolog of the protein sequence given in SEQ ID NO 14287
  misc_feature: Useful for making plants with modulated cold sensitivity
  misc_feature: Functional homolog of the protein sequence given in SEQ ID NO 14288
  misc_feature: Ceres ANNOT ID no. 8681414
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in root tissues in response to aminocyclopropane carboxylic treatment
  misc_feature: Down-regulated in root tissues in response to methyl jasmonate treatment
  misc_feature (47)..(276): Pfam ID: MIP Pfam Description: Major intrinsic protein
MEGKEEDVRLGANKFSERQPIGTAAQGAGDDKDYKEPPPAPLFEPGELKSWSFYRAGIAEFVATFLFLYITILTVMGVSKSNSKCATVGIQGIAWSFGGMIFALVYCTAGISGGHINPAVTFGLFLARKLSLTRAIFYIIMQCLGAICGAGVVKGFQQGLYMGNGGGANVVAPGYTKGDGLGAEIVGTFILVYTVFSATDAKRNARDSHVPILAPLPIGFAVFLVHLATIPITGTGINPARSLGAAIIYNRDHAWSDHWIFWVGPFIGAALAAIYHQVIIRAIPFKSRS

SEQ ID NO: 17712 - DNA, 327 bp, Sorghum bicolor
  misc_feature: Ceres ANNOT ID no. 8681453
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in root tissues in response to aminocyclopropane carboxylic treatment
  misc_feature: Down-regulated in root tissues in response to methyl jasmonate treatment
  misc_feature: Encodes the peptide sequence at SEQ ID NO 17713
atggacgcccccaccgccgccgttgtttctgttaacggtaagctattgcactcccacggaagatgggggtcgaggagaggaaggcgcagaagagctactgggaggaggaacctcaccgtcgaggccatgatgctggactcccgcgccgccgatctcaacagggaggagcgccccgaggtcctgtctttgcttccttcatacgaaggaaaatctgtactggagcttggtgctggaataggccatttcactggagaactcgctaaaatagctgggaatgttcttgctcttgattttattgaaagtgcaattaaaaagatgaagaggtaa

SEQ ID NO: 17713 - protein, 108 aa, Sorghum bicolor
  misc_feature: The sequence is a functional homolog of SEQ ID NO 40 in US patent 7151202
  misc_feature: Ceres ANNOT ID no. 8681453
  misc_feature (37)..(105): SWISSPROT Homolog: EC 2.1.1.103 Phosphoethanolamine N-methyltransferase
MDAPTAAVVSVNGKLLHSHGRWGSRRGRRRRATGRRNLTVEAMMLDSRAADLNREERPEVLSLLPSYEGKSVLELGAGIGHFTGELAKIAGNVLALDFIESAIKKMKR

SEQ ID NO: 17714 - DNA, 369 bp, Sorghum bicolor
  misc_feature: Ceres ANNOT ID no. 8681460
  misc_feature: Encodes the peptide sequence at SEQ ID NO 17715
atgacgtccaaggcgttcgcgctgttcctggccgtgaacctagttgtgctgggcgtagccagcgcctgtgcgcccaacagcccgacgacacccacgccatcgtcgtcgtcgtccggctcgtgccccagggacgcgttgaagctgggcgtgtgcgccaacgtgctgggcctgatcaaggctcaggtcggcgtgccgcccgcggagccatgctgcccgctgctggcggggctcgtcgacctggaggccgccgtctgtctctgcaccgccatcaaggccaacgtcctcggcatcaacctcaacgtgccactcgatctcagcctcatcctcaactactgcggcaagaccgtgcccaccggcttcatgtgctaa

SEQ ID NO: 17715 - protein, 122 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated oxidative stress sensitivity
  misc_feature: Functional homolog of the protein sequence given in SEQ ID NO 13086
  misc_feature: Useful for making plants with modulated salt sensitivity
  misc_feature: Functional homolog of the protein sequence given in SEQ ID NO 13766
  misc_feature: Ceres ANNOT ID no. 8681460
  misc_feature (41)..(122): Pfam ID: Tryp_alpha_amyl Pfam Description: Protease inhibitor/seed storage/LTP family
MTSKAFALFLAVNLVVLGVASACAPNSPTTPTPSSSSSGSCPRDALKLGVCANVLGLIKAQVGVPPAEPCCPLLAGLVDLEAAVCLCTAIKANVLGINLNVPLDLSLILNYCGKTVPTGFMC

SEQ ID NO: 17716 - DNA, 369 bp, Sorghum bicolor; identical to SEQ ID NO: 17714
  misc_feature: Ceres ANNOT ID no. 8681458
  misc_feature: Encodes the peptide sequence at SEQ ID NO 17717

SEQ ID NO: 17717 - protein, 122 aa, Sorghum bicolor; identical to SEQ ID NO: 17715
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated oxidative stress sensitivity
  misc_feature: Functional homolog of the protein sequence given in SEQ ID NO 13086
  misc_feature: Useful for making plants with modulated salt sensitivity
  misc_feature: Functional homolog of the protein sequence given in SEQ ID NO 13766
  misc_feature: Ceres ANNOT ID no. 8681458
  misc_feature (41)..(122): Pfam ID: Tryp_alpha_amyl Pfam Description: Protease inhibitor/seed storage/LTP family

SEQ ID NO: 17718 - DNA, 396 bp, Sorghum bicolor
  misc_feature: Ceres ANNOT ID no. 8681449
  misc_feature: Encodes the peptide sequence at SEQ ID NO 17719
atggcatcgtcctccaagccggccttgctcctcgtggccctcaacctggtcctcttcacggtggccaacgcctgcggcggcggctgcccgacgccaccaacgccaccaactccgacgccgccgtcaccttcaaccggcggcaagtgccccaagcacgcgctcaagctcgcggcgtgcgccaacgtgctgggcttcgtcagcgccgaggtcggccacccgcccgccgagccttgctgcagcatcctcggcggcctcgccgacctggaggccgccgtctgcctctgcaccgccatcaaggccaacgtgctcgggatcaccgtagacatccctgtcaagctcagcctcattgtcaactactgtggcaagaacctccccagtggcttcatatgcgcctga

SEQ ID NO: 17719 - protein, 131 aa, Sorghum bicolor
  misc_feature: Useful for making plants with modulated oxidative stress sensitivity
  misc_feature: Functional homolog of the protein sequence given in SEQ ID NO 13086
  misc_feature: Useful for making plants with modulated biomass
  misc_feature: Useful for making plants with modulated flowering time
  misc_feature: Functional homolog of the protein sequence given in SEQ ID NO 14571
  misc_feature: Ceres ANNOT ID no. 8681449
  misc_feature (49)..(130): Pfam ID: Tryp_alpha_amyl Pfam Description: Protease inhibitor/seed storage/LTP family
MASSSKPALLLVALNLVLFTVANACGGGCPTPPTPPTPTPPSPSTGGKCPKHALKLAACANVLGFVSAEVGHPPAEPCCSILGGLADLEAAVCLCTAIKANVLGITVDIPVKLSLIVNYCGKNLPSGFICA

SEQ ID NO: 17720 - DNA, 369 bp, Sorghum bicolor
  misc_feature: Ceres ANNOT ID no. 8681457
  misc_feature: Encodes the peptide sequence at SEQ ID NO 17721
atggcgtccaaggcgttcgcgctgttcctggccgtgaacctggttgtgctgggcgtagccagcgcctgtgcgcccaacagcccgacgacacccacgccatcgtcgtcgtcgaacggctcgtgccccagggatgcgttgaagctgggcgtgtgcgccaatgtgctgggcctgatcaaggctcaggtcggcgtgccgcccgcggagccatgctgcccgctgctggcggggctcgtcgacctggaggccgccgtctgcctctgcaccgccatcaaggccaacgtcctcggcatcaacctcaacgtgccactcgatctcagcctcatcctcaactactgcggcaagaccgtgcccaccggcttcatgtgctga

SEQ ID NO: 17721 - protein, 122 aa, Sorghum bicolor; identical to SEQ ID NO: 1978
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated oxidative stress sensitivity
  misc_feature: Functional homolog of the protein sequence given in SEQ ID NO 13086
  misc_feature: Useful for making plants with modulated salt sensitivity
  misc_feature: Functional homolog of the protein sequence given in SEQ ID NO 13766
  misc_feature: Ceres ANNOT ID no. 8681457
  misc_feature (41)..(122): Pfam ID: Tryp_alpha_amyl Pfam Description: Protease inhibitor/seed storage/LTP family

SEQ ID NO: 17722 - DNA, 1761 bp, Sorghum bicolor
  misc_feature: Ceres ANNOT ID no. 8681483
  misc_feature: Encodes the peptide sequence at SEQ ID NO 17723
atggcgatggttatggagagccagcagccgctggcgccgccgatgccggtggtccgggcgccgcccctgcctcctcctcctccccctccgccgctgccgccacctccgcaggcgtacaagcaccgctgcagggtgtgcaagaaggggttcatgtgcgggcgcgcgctgggcggccacatgcgggcgcacggcgttaccgaagtcgacgggctcagcgccgacgacgacgacgacctcgacgatgacgcgggcccctttggcggcgcatgggactctacggaggcggcggcggcggcgacgacgacgacgaagcgcatgtactcgctccgcaccaacgcgggccggcacaagaattgcagggtgtgcgagaactgtggcaaggagttcacgtcgtggaaatcgttgctggatcacggcaggtgcagctacgatcggaagaaggacgacctcaatatcgccggcactgacatcgatggcgaagatgaggaggacctaacattggcagccggcggatggtcgaaagggaaacgtacacgccggacaaaggtgatcgttgtggacaatggtccacaaactgatgagccgctgccggtgccggccacctcaagggaggaggaggacctcgccaactgtctcgtcatgctcgcatcatcgcgtggtgacatgcagccacgagctgttgtcgatgtccaaaaacaacagcacgcatcgacgagcaaggacgagcgcgcctcggcaggcaaagatgagcagagatttcttgtgccaccgcaaccaatctctatgttaccacctaccgtaccacagttcaagttcctggcgccaccacaagtgatgccatcgccgcctgtcatatctcgtggattatttgagtgcaaggcatgtaagaaggtgttcacatctcaccaggctctcggcggccaccgtgccagccacaaaaaggtcaaaggatgtttcgcggccaagctagaagagagcagccgcaataacgattccccgcaacccagcgcagcgtcttccaatgacaacgtcaacaagcaggtcgtcgtcgaagccattcctgccatcgtcgacaccacggaatcatcgaatggtgtcgatggcaacgcggaagtcgacgaggcgccctcatcctccaccaccgtctcacccttgaagaagaaggggaaggtgcacgagtgctccatctgccaccgcgtcttcatgtcggggcaagcgctcggcggccacaagcggtgccactggctcacgacgggggccgccggcggggacccgacggtggtcgccaagcttcagcccttcgctcctcatcaagatcatcacgtcatgcacgccgccatgtgccagcagctcacgctgggtcctccgacgatgtatggcacgtcggattcgtgtcttgacctcaacgtgcccatgaatcaatctgcagatccagccgccacgagacaagcagccgggatcaacgaaagcatgctgagcctgaatgcaccggcgtcgctgtacatgcactcatggactggacataccaacaacgacgcgagcaacatgcacaacgacacggcggcgacaagtggtcactgcgacttgccggaggccaccgccgccaccgaggatgaagcggacagtacgagtgccaagcgagccaagatcagtgacctcaaggacatgaacatggctggggagacctcgccgtggctgcaagttggcattgccctaccgtccgagacgaccaacgagagactgctcaagcctaaaggctag

SEQ ID NO: 17723 - protein, 586 aa, Sorghum bicolor
  misc_feature: The sequence is a functional homolog of SEQ ID NO 1012 in the 10/666,642 US patent application
  misc_feature: Ceres ANNOT ID no. 8681483
MAMVMESQQPLAPPMPVVRAPPLPPPPPPPPLPPPPQAYKHRCRVCKKGFMCGRALGGHMRAHGVTEVDGLSADDDDDLDDDAGPFGGAWDSTEAAAAATTTTKRMYSLRTNAGRHKNCRVCENCGKEFTSWKSLLDHGRCSYDRKKDDLNIAGTDIDGEDEEDLTLAAGGWSKGKRTRRTKVIVVDNGPQTDEPLPVPATSREEEDLANCLVMLASSRGDMQPRAVVDVQKQQHASTSKDERASAGKDEQRFLVPPQPISMLPPTVPQFKFLAPPQVMPSPPVISRGLFECKACKKVFTSHQALGGHRASHKKVKGCFAAKLEESSRNNDSPQPSAASSNDNVNKQVVVEAIPAIVDTTESSNGVDGNAEVDEAPSSSTTVSPLKKKGKVHECSICHRVFMSGQALGGHKRCHWLTTGAAGGDPTVVAKLQPFAPHQDHHVMHAAMCQQLTLGPPTMYGTSDSCLDLNVPMNQSADPAATRQAAGINESMLSLNAPASLYMHSWTGHTNNDASNMHNDTAATSGHCDLPEATAATEDEADSTSAKRAKISDLKDMNMAGETSPWLQVGIALPSETTNERLLKPKG

SEQ ID NO: 17724 - DNA, 885 bp, Sorghum bicolor
  misc_feature: Ceres ANNOT ID no. 8681485
  misc_feature: Encodes the peptide sequence at SEQ ID NO 17725
atggcgaagtcctgcaccttcctgttcgtcgcactagtcgtgctcttgcttctagtgagccccattgcttgctcccgcaagctcgccaagccgaacaagcacaggccgagacacaagccggcagtcagggcccgcagcagcagcaaccacactgccacaccctcgatgtccgacgcctacggctccggcggctggttgtccgccggcgcgacgtactacggcgcacccgacggcgacggcagtgacggcggcgcgtgcggctaccagaccgccgtcgggcaacgccccttctcgtcgatgatcgccgccggtagcccgtcgctgttcaagggaggcaagggctgtggcgcttgctacgaggttaaatgcgacggcaacgcggcatgctccggccagccggccaccgtggtcatcaccgacgagtgccccggcggtgtctgccttgccgaggcggctcacttcgacatgagcggcacctccatgggcgccatggcgaagcccggcatggccgacaagcttcgcgccgccggtatcctaaaggtccagtacaagagggtgccgtgcaagtacagcggcgtgaacatcgccttcagggtggaccagggctccaacccattctacttcgaggtgctggtggagttcgaggacggcgacggcgacctcagcgccgtggacctgatggaggccggttgcggcacctggacgccgatggtgcagaactggggcgcgctgtggcgctacaactccaacaccggcaaggcgctcaaggcgcccttctcgctccgcctcacctccgactccggcaaggtgctcgtcgccaacaacgtcatccccgccggctggaaccccggcgccacgtaccgctccctggtgaactactcctaa

SEQ ID NO: 17725 - protein, 294 aa, Sorghum bicolor
  misc_feature: Useful for making plants with altered carbohydrate content
  misc_feature: Functional homolog of the protein sequence given in SEQ ID NO 13769
  misc_feature: Useful for making plants with altered cell wall content and/or composition
  misc_feature: Functional homolog of the protein sequence given in SEQ ID NO 13768
  misc_feature: Ceres ANNOT ID no. 8681485
  misc_feature (195)..(278): Pfam ID: Pollen_allerg_1 Pfam Description: Pollen allergen
  misc_feature (101)..(183): Pfam ID: DPBB_1 Pfam Description: Rare lipoprotein A (RlpA)-like double-psi beta-barrel
MAKSCTFLFVALVVLLLLVSPIACSRKLAKPNKHRPRHKPAVRARSSSNHTATPSMSDAYGSGGWLSAGATYYGAPDGDGSDGGACGYQTAVGQRPFSSMIAAGSPSLFKGGKGCGACYEVKCDGNAACSGQPATVVITDECPGGVCLAEAAHFDMSGTSMGAMAKPGMADKLRAAGILKVQYKRVPCKYSGVNIAFRVDQGSNPFYFEVLVEFEDGDGDLSAVDLMEAGCGTWTPMVQNWGALWRYNSNTGKALKAPFSLRLTSDSGKVLVANNVIPAGWNPGATYRSLVNYS

SEQ ID NO: 17726 - DNA, 705 bp, Sorghum bicolor
  misc_feature: Ceres ANNOT ID no. 8681502
  misc_feature: Encodes the peptide sequence at SEQ ID NO 17727
atggccatggacgactcgtcctccggctccgagcccgagcccacctcgtcgtcctccgtggaggctcccgcgtccccgaccgcgtcgtcctccgactccgcctccgccgcgggcagcgacagcaagaagcggcggcgcaccaaggacgggcaccacccgacgtaccgcggcgtgcgcatgcgggcctggggcaagtgggtgtcggagatccgggagccccgcaagaagtcgcgcatctggctcggcaccttcgccaccgccgagatggcggcgcgcgcccacgacgtggccgcgctggcgatcaagggccgcgccgcgcacctcaacttcccggagctcgcgggcgagctcccgcgcccggccaccgccgcgcccaaggacgtccaggccgccgccgcgctcgccgccgccgcggacttcccggcaacgcccgccaatgcagccggcgccgacgacgactgtggcccggacgccagcgccgcctccgacgacgtctccgcctccgcctcgccaccgccggcaacgacgctggacaaccccgacgacgcgctgttcgacctccccgacctcctcctcgacctcagacacggggcctcgtcgtgccagctgctctcgtgcgcgccgtcgtggtacgacgacgtgtgcttctccggcgccgccgccggtgcgttccgcctggaggagccgctgctgtgggagtactga

SEQ ID NO: 17727 - protein, 234 aa, Sorghum bicolor
  misc_feature: The sequence is a functional homolog of SEQ ID NO 16 in the 10/412,699 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: Useful for making plants with altered lignin content
  misc_feature: Functional homolog of the protein sequence given in SEQ ID NO 13219
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: The sequence is a functional homolog of SEQ ID NO 166 in the 11/375,241 US patent application
  misc_feature: The sequence is a functional homolog of SEQ ID NO 2231 in the 10/666,642 US patent application
  misc_feature: The sequence is a functional homolog of SEQ ID NO 94 in the 10/714,887 US patent application
  misc_feature: The sequence is a functional homolog of SEQ ID NO 94 in the 11/435,388 US patent application
  misc_feature: Ceres ANNOT ID no. 8681502
  misc_feature (53)..(104): Pfam ID: AP2 Pfam Description: AP2 domain
MAMDDSSSGSEPEPTSSSSVEAPASPTASSSDSASAAGSDSKKRRRTKDGHHPTYRGVRMRAWGKWVSEIREPRKKSRIWLGTFATAEMAARAHDVAALAIKGRAAHLNFPELAGELPRPATAAPKDVQAAAALAAAADFPATPANAAGADDDCGPDASAASDDVSASASPPPATTLDNPDDALFDLPDLLLDLRHGASSCQLLSCAPSWYDDVCFSGAAAGAFRLEEPLLWEY

SEQ ID NO: 17728 - DNA, 855 bp, Sorghum bicolor
  misc_feature: Ceres ANNOT ID no. 8681504
  misc_feature: Encodes the peptide sequence at SEQ ID NO 17729
atggaagctgacgcactactccatgcgcccaccacctcttcctcctgctccgactccggcggcggctcgtgcgtcatcaatggcgcgcaggagcgactgtccaagaccggcggcaagccccacaagaacgtgaaacggaagagaaccgcgtcgtccccgcctgctgctcccggcggcgtggcggtggcacccgaggccaccgtggacgacgactgcggcggcggcggcggccggcagcgcaagaggggcagcgccggcaccaggcacccgacgttccgcggcgtgcgcatgcgggtgtggggcaagtgggtgtccgagatcagagagccgcgcaagaagtcgcgcatctggctcggcacgttcccgacggccgagatggccgcgcgcgcccacgacgtggccgcgctggccatcaagggccgcgccgcgcacctcaacttcccgcacctcgcgcacgagctcccccgcccggcgtccacctcgcccgccgacatccaggccgcggcagccaaggctgctgctgctgccgccgccgccgccgatgccgacgtagagcaatgcgagtcgtcctctcatcatattgccgagacgccatcgtcgtcgtcgtcgtcagccgccaattcggaggaggtagctgcggccagcaactcggaggagagcgtgctgttgttcgacttcgatttgcccgaccttctgctggacctgagggacggcctctggtcacccatctgggaggcagcagctccggcggcggcggccgaagagtacgacggcgacagcctgagcgagccgcttctgtgggcccacgatcactgctggatggacgctgccgccgtgccggtgcagccggactag

SEQ ID NO: 17729 - protein, 284 aa, Sorghum bicolor
  misc_feature: The sequence is a functional homolog of SEQ ID NO 1248 in the 10/374,780 US patent application
  misc_feature: The sequence is a functional homolog of SEQ ID NO 164 in the 11/375,241 US patent application
  misc_feature: The sequence is a functional homolog of SEQ ID NO 2233 in the 10/666,642 US patent application
  misc_feature: The sequence is a functional homolog of SEQ ID NO 96 in the 10/714,887 US patent application
  misc_feature: The sequence is a functional homolog of SEQ ID NO 96 in the 11/435,388 US patent application
  misc_feature: Useful for making plants with altered lignin content
  misc_feature: Functional homolog of the protein sequence given in SEQ ID NO 13219
  misc_feature: The sequence is a functional homolog of SEQ ID NO 166 in the 11/375,241 US patent application
  misc_feature: The sequence is a functional homolog of SEQ ID NO 2231 in the 10/666,642 US patent application
  misc_feature: The sequence is a functional homolog of SEQ ID NO 94 in the 10/714,887 US patent application
  misc_feature: The sequence is a functional homolog of SEQ ID NO 94 in the 11/435,388 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: The sequence is a functional homolog of SEQ ID NO 10 in the 10/903,236 US patent application
  misc_feature: The sequence is a functional homolog of SEQ ID NO 1735 in the 10/374,780 US patent application
  misc_feature: The sequence is a functional homolog of SEQ ID NO 2125 in the 10/666,642 US patent application
  misc_feature: The sequence is a functional homolog of SEQ ID NO 690 in the 10/666,642 US patent application
  misc_feature: The sequence is a functional homolog of SEQ ID NO 70 in the 10/714,887 US patent application
  misc_feature: The sequence is a functional homolog of SEQ ID NO 70 in the 11/435,388 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: Ceres ANNOT ID no. 8681504
  misc_feature (90)..(141): Pfam ID: AP2 Pfam Description: AP2 domain
MEADALLHAPTTSSSCSDSGGGSCVINGAQERLSKTGGKPHKNVKRKRTASSPPAAPGGVAVAPEATVDDDCGGGGGRQRKRGSAGTRHPTFRGVRMRVWGKWVSEIREPRKKSRIWLGTFPTAEMAARAHDVAALAIKGRAAHLNFPHLAHELPRPASTSPADIQAAAAKAAAAAAAAADADVEQCESSSHHIAETPSSSSSSAANSEEVAAASNSEESVLLFDFDLPDLLLDLRDGLWSPIWEAAAPAAAAEEYDGDSLSEPLLWAHDHCWMDAAAVPVQPD

SEQ ID NO: 17730 - DNA, 936 bp, Sorghum bicolor
  misc_feature: Ceres ANNOT ID no. 8681529
  misc_feature: Encodes the peptide sequence at SEQ ID NO 17731
atgctgctgctcaacccggcgtgcgaggcggcagcgctggacaccatccggcatcacctcctggacgagcccgcggcgtcgtccgtgagcatgagcgcggcgccgccgcggccggtgtactgccgcagcacgagcttcgggagcctggtggcggaccagtggagcgagtcgctcccgttccgccccgacgacgccgacgacatggtggtcttcggcgcgctccgcgacgccttctcccggggctggctccccgacggctccttcgccgccgtcaagcccgagcccctggcgtcgtccccggacgatgactcctccccctacgaccacggatcctattcgtaccttggtggtggcgcggttggcggccttcttcgcgcggcggaggagcctgagacgccgaccgaggcggcggcgatgacgcccgggaccgcgagcgaggaggaggcggcggtggcggtggccggcagggggaagcactaccgcggggtgaggcagcggccgtggggcaagttcgcggcggagatccgggatccggccaagaacggcgcccgcgtgtggctcggcacctacgacagcgccgaggacgccgccgtggcctacgaccgcgccgcctaccgcatgcgcggctcccgcgcgctcctcaacttcccgctccgcatcagctccgagatcgccgccgcaatcactgccgctgcccctgcccctgccgtgggagacaagcgggcgtcccccgagccgaccgcgagctccgactcttcttcaccttcatcgtcctcctcctctgggacaccaaagcggaggaagagaggcgaggccgctgccgccaccatggccatggcccttgtcccgcccccgccggcgcaggctcccgtccagctgaccctcccggcccatccgtggttcgccgccggcccggtccagcagctagtgagctaa

SEQ ID NO: 17731 - protein, 311 aa, Sorghum bicolor
  misc_feature: Useful for making plants with altered lignin content
  misc_feature: Functional homolog of the protein sequence given in SEQ ID NO 13219
  misc_feature: Ceres ANNOT ID no. 8681529
  misc_feature (158)..(210): Pfam ID: AP2 Pfam Description: AP2 domain
MLLLNPACEAAALDTIRHHLLDEPAASSVSMSAAPPRPVYCRSTSFGSLVADQWSESLPFRPDDADDMVVFGALRDAFSRGWLPDGSFAAVKPEPLASSPDDDSSPYDHGSYSYLGGGAVGGLLRAAEEPETPTEAAAMTPGTASEEEAAVAVAGRGKHYRGVRQRPWGKFAAEIRDPAKNGARVWLGTYDSAEDAAVAYDRAAYRMRGSRALLNFPLRISSEIAAAITAAAPAPAVGDKRASPEPTASSDSSSPSSSSSSGTPKRRKRGEAAAATMAMALVPPPPAQAPVQLTLPAHPWFAAGPVQQLVS

SEQ ID NO: 17732 - DNA, 705 bp, Sorghum bicolor
  misc_feature: Ceres ANNOT ID no. 8681544
  misc_feature: Encodes the peptide sequence at SEQ ID NO 17733
atggagggaggccagttgagtgcttgccttcctggcttccttgtgccggatcactacgccttccctcttcctctcccgctacaacttcctagcagccaaaacaagcttttccagatgccgtttgtagttgaccaggaagcagagaccgaaaaccatggcggcggcgggatgctctcctccgaccattgtggactatacccgctgccggcactgcccttcggcagctgctccggtgccgccggcgccgcaacagcgtgcggtgggaagcctacggccggtttcatgcccagtgctattgtcgctgaggaggtctgcacctcggtgactactaaattaggttgcaacgacagtaatggcacatggtggaagggttcggcagctacaacgatagcggagagagggaagatgaaggtgaggaggaagatgagggaaccgaggttttgcttccagaccagaagcgacgtggatgtactggatgatggctacaagtggaggaagtatgggcagaaggttgtcaagaacagcctccatccaaggagctatttccggtgcactcacagcaactgccgcgtgaagaaacgggtggagcggctgtcgacggactgccgcatggtgatgaccacgtacgagggccgccacacgcactctccctgcagcgacgacgcttcctccgccgaccacaccgattgcttcacctccttctga

SEQ ID NO: 17733 - protein, 234 aa, Sorghum bicolor
  misc_feature: The sequence is a functional homolog of SEQ ID NO 1017 in the 10/412,699 US patent application
  misc_feature: The sequence is a functional homolog of SEQ ID NO 521 in the 10/374,780 US patent application
  misc_feature: The sequence is a functional homolog of SEQ ID NO 22 in the 10/374,780 US patent application
  misc_feature: The sequence is a functional homolog of SEQ ID NO 231 in the 11/479,226 US patent application
  misc_feature: The sequence is a functional homolog of SEQ ID NO 858 in the 10/225,066 US patent application
  misc_feature: The sequence is a functional homolog of SEQ ID NO 88 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: The sequence is a functional homolog of SEQ ID NO 86 in the 10/412,699 US patent application
  misc_feature: The sequence is a functional homolog of SEQ ID NO 1640 in the 11/479,226 US patent application
  misc_feature: The sequence is a functional homolog of SEQ ID NO 2 in the 10/225,066 US patent application
  misc_feature: The sequence is a functional homolog of SEQ ID NO 254 in the 10/374,780 US patent application
  misc_feature: The sequence is a functional homolog of SEQ ID NO 30 in the 10/714,887 US patent application
  misc_feature: The sequence is a functional homolog of SEQ ID NO 30 in the 11/435,388 US patent application
  misc_feature: The sequence is a functional homolog of SEQ ID NO 808 in the 10/412,699 US patent application
  misc_feature: The sequence is a functional homolog of SEQ ID NO 202 in the 10/714,887 US patent application
  misc_feature: The sequence is a functional homolog of SEQ ID NO 202 in the 11/435,388 US patent application
  misc_feature: Ceres ANNOT ID no. 8681544
  misc_feature (158)..(217): Pfam ID: WRKY Pfam Description: WRKY DNA -binding domain
MEGGQLSACLPGFLVPDHYAFPLPLPLQLPSSQNKLFQMPFVVDQEAETENHGGGGMLSSDHCGLYPLPALPFGSCSGAAGAATACGGKPTAGFMPSAIVAEEVCTSVTTKLGCNDSNGTWWKGSAATTIAERGKMKVRRKMREPRFCFQTRSDVDVLDDGYKWRKYGQKVVKNSLHPRSYFRCTHSNCRVKKRVERLSTDCRMVMTTYEGRHTHSPCSDDASSADHTDCFTSF

SEQ ID NO: 17734 - DNA, 834 bp, Sorghum bicolor
  misc_feature: Ceres ANNOT ID no. 8681536
  misc_feature: Encodes the peptide sequence at SEQ ID NO 17735
atggcggccggggcaaggcactgccacacagtgtcctccagcgtcagcatggctgggattgggattatgctttgctttgtagggcgtggtgagaatgctgtgtggtgcagccagtggcggagccaggaatttgtgactggggcatacccctggctccgccactgggtgcagcgacataggctttctagaggaaaatatctggagaattatgatgtgaacttaaacattatcgcatccgactaccttttcaaacttttgcttattggtgattctggtgttgggaaatcatgcttgcttctcagatttgcggatgattcatatttggacagctacatcagcacaattggggttgattttaaaattcggacagtcgagcaggatgggaagaccataaaacttcaaatctgggatactgctgggcaagagcgcttcaggacaatcaccagcagctactaccgcggagcccatggaatcattattgtatatgacgtgacagaccaagaaagcttcaataatgtgaagcaatggttaaatgaaattgaccgttatgcaagtgacaatgttaacaagctccttgttgggaacaagagcgatctaactgccaacaaagttgttgcaactgagacagcaaaggcgtttgctgatgagatgggcatcccattcatggagacgagtgccaaaaacgccaccaacgtggagcaggccttcatggctatggctgcatccatcaaggataggatggccagccaaccagcagcggccaacgcaaggccagcgacggtgcagatccgtgggcaacccgtcaaccagaagacgtcttgctgctcgtcctaa

SEQ ID NO: 17735 - protein, 277 aa, Sorghum bicolor
  misc_feature: Useful for making plants with altered lignin content
  misc_feature: Functional homolog of the protein sequence given in SEQ ID NO 12946
  misc_feature: Useful for making plants with modulated oxidative stress sensitivity
  misc_feature: Functional homolog of the protein sequence given in SEQ ID NO 13074
  misc_feature: Useful for making plants with altered alkaloid content
  misc_feature: Functional homolog of the protein sequence given in SEQ ID NO 13220
  misc_feature: Ceres ANNOT ID no. 8681536
  misc_feature (84)..(243): SWISSPROT Homolog: EC 2.7.11.1 Non-specific serine/threonine protein kinase
  misc_feature (84)..(245): Pfam ID: Ras Pfam Description: Ras family
  misc_feature (84)..(198): Pfam ID: Miro Pfam Description: Miro-like protein
MAAGARHCHTVSSSVSMAGIGIMLCFVGRGENAVWCSQWRSQEFVTGAYPWLRHWVQRHRLSRGKYLENYDVNLNIIASDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVATETAKAFADEMGIPFMETSAKNATNVEQAFMAMAASIKDRMASQPAAANARPATVQIRGQPVNQKTSCCSS

SEQ ID NO: 17736 - DNA, 1029 bp, Sorghum bicolor
  misc_feature: Ceres ANNOT ID no. 8681525
  misc_feature: Encodes the peptide sequence at SEQ ID NO 17737
atggatttcagcggtgaaatcgacgacttctccctgcagctcatccgcgagcagcttctcggcggcgaggcttgcctccccgtcgtccctaacgccgcggcgtactctggcttgtcagttcatcccacgcaggcggcgttccaccagcacgctgcggcgttcttgccgcagcatcagcaacagcaggtcgcgtacgtcgacttgacgaacgagtacgccgcggatgctgccactgccgcctcgcacggcgaggcggcggccttccgggcggagccggtgatgatccggttcgggggcgagccttcgccggtgtcggaccctagccggagaccgatgctcaccatctctctgcctccgacctcgcacgcctggggcccggcgggcgccgtggaggtacaggtacaggcacaggccgcggcggcggcggccctggtggacgtgaacgactttcgcaagtaccgcggcgtgcggcagcggccgtggggcaagttcgcggcggagatccgcgaccccaagaagcgcgggtcccgcgtgtggctcggcacctacgacaccgccatcgaggccgcgcgcgcctacgaccgcgcggcgttccgcatgcgcggcgccaaggccatcctcaacttccccaacgaggtgggctcccgcggcgcggacttcctcgcaccgccaccgccgccgccgcccgcgcaggccgcggcgacgacgacgtcgtcccagaacaaacggaagctgccgcacgacgccgagtccgagccagcagccaacaagtccgtcaaggctgaggcgttcggatcgccggcgtcgtcccccgcgacgacgacgacgacaacgacaacgacaacgaccaccgcggcctcgacggtgacgacgtgctctccgtcgtcggaggctacaggagcccaccacgaggtgtttcccatgacgccgtcgagctggacgtgggagcagctggagggcgtgttcggaagcctgtcgccgctgtcgccacacccgcagctcggcttcccggaggtcaccgtcaattaa

SEQ ID NO: 17737 - protein, 342 aa, Sorghum bicolor
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: Useful for making plants with altered lutein content
  misc_feature: Useful for making plants with modulated biomass
  misc_feature: Useful for making plants with modulated flowering time
  misc_feature: Functional homolog of the protein sequence given in SEQ ID NO 13470
  misc_feature: Ceres ANNOT ID no. 8681525
  misc_feature (151)..(203): Pfam ID: AP2 Pfam Description: AP2 domain
MDFSGEIDDFSLQLIREQLLGGEACLPVVPNAAAYSGLSVHPTQAAFHQHAAAFLPQHQQQQVAYVDLTNEYAADAATAASHGEAAAFRAEPVMIRFGGEPSPVSDPSRRPMLTISLPPTSHAWGPAGAVEVQVQAQAAAAAALVDVNDFRKYRGVRQRPWGKFAAEIRDPKKRGSRVWLGTYDTAIEAARAYDRAAFRMRGAKAILNFPNEVGSRGADFLAPPPPPPPAQAAATTTSSQNKRKLPHDAESEPAANKSVKAEAFGSPASSPATTTTTTTTTTTTAASTVTTCSPSSEATGAHHEVFPMTPSSWTWEQLEGVFGSLSPLSPHPQLGFPEVTVN

SEQ ID NO: 17738 - DNA, 1404 bp, Sorghum bicolor
  misc_feature: Ceres ANNOT ID no. 8681557
  misc_feature: Encodes the peptide sequence at SEQ ID NO 17739
atgtcttgcttccgctgcttcagcagcagcaggaccgagaggggcacgggcgagaagcgtcgagaggggtcggcgtcgccggcggccgcctcgttcccgtccaccgtctccacgggcgcgccctccaacctgaccttcttctccacggcgtcgtcggccgtcggcacgagccactccgaggactccagcgcggtcatgcggccggcggcgagcaagtcgtcgggctcgggctcggtctcggtctcgtcggcgcggagcatcccggagctgtacgaggagaggggagccagcaccctccgcgagttcgggttccgggagctccgggccgccaccagcgacttcagccgcctgctcaaggtcggcgagggcggcttcggcagcgtttacaagggcgtcgtccggctacctggcgggcccgccggcggcacggtggttgccatcaagaaactcaatcccaacggtcatcagggccacaagcaatggttggcagaagtgcatttcctgggagttgttgagcacccaaatctcgtcaagctcattgggtactgcgctgctcgaagtgagcgaggtcctcagaggctactggtctatgagttcatgacgaacaagaccctggacgatcatctattcaataaagcatatcccgtccttccatgggacatcaggttggagatagcactggatgccgctgagggattgctgtacctccacgagggattagaagttcaggtcatatatcgcgatttcaaagcttcaaatgtactgctggacgagaagtttagagcaaaactttcagatttcggattggcaagggaaggaccatcggctggtgatactcacgtctctacagcagttatggggaccttgggctatgcagctccagattacattgagacaggccatctcactacaaagagtgatgtgtggagttttggagtagttctatatgagatcctcactggacggcgctcaatggagaggaaccgtcccaagaacgagcagaaacttctcgaatgggtgaggctgtatcctgttgaaagtaagcaattcagcaagatcatagataaaaggcttgagggccactactctaagcagggcattagaaaaattgccaagttggccaatagctgccttgcaaagcagagaagggaccgtccaacaatgagagaagtggtcgagagcctgaagcaagcaatgcagcacaaggagttagatgggaaatcagggagtttgggtgagactccaccaccagagcaagtatctggaaaaccaaccacagaggatgttgccgtggcatcagcaaggcggaggatgcttcatctggctgccctaggtgagaatgcaaacagcattgcgaggaggagattcatgctcatgaggactgcggctactactactacataa

SEQ ID NO: 17739 - protein, 467 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8681557
  misc_feature (99)..(408): SWISSPROT Homolog: EC 2.7.11.1 Non-specific serine/threonine protein kinase
  misc_feature (114)..(395): Pfam ID: Pkinase Pfam Description: Protein kinase domain
MSCFRCFSSSRTERGTGEKRREGSASPAAASFPSTVSTGAPSNLTFFSTASSAVGTSHSEDSSAVMRPAASKSSGSGSVSVSSARSIPELYEERGASTLREFGFRELRAATSDFSRLLKVGEGGFGSVYKGVVRLPGGPAGGTVVAIKKLNPNGHQGHKQWLAEVHFLGVVEHPNLVKLIGYCAARSERGPQRLLVYEFMTNKTLDDHLFNKAYPVLPWDIRLEIALDAAEGLLYLHEGLEVQVIYRDFKASNVLLDEKFRAKLSDFGLAREGPSAGDTHVSTAVMGTLGYAAPDYIETGHLTTKSDVWSFGVVLYEILTGRRSMERNRPKNEQKLLEWVRLYPVESKQFSKIIDKRLEGHYSKQGIRKIAKLANSCLAKQRRDRPTMREVVESLKQAMQHKELDGKSGSLGETPPPEQVSGKPTTEDVAVASARRRMLHLAALGENANSIARRRFMLMRTAATTTT

SEQ ID NO: 17740 - DNA, 624 bp, Sorghum bicolor
  misc_feature: Ceres ANNOT ID no. 8681596
  misc_feature: Encodes the peptide sequence at SEQ ID NO 17741
atgctgacgaggcggcacggagggttccggctcggccggaagctgctcagcgcctggcgatgggcgctctgccaccgccggcgccgccgcggccgcgggtacctccgcctgcagcagccgtggcaacaaggaggacgaggcagcagcaaatccccgtcgacatccccgctgccggatgaagcagcggtgcgcgccaagcagcagctcgtggtgcagcagcagcagcagcgcgatgagtctggtggctcgccgcggatgctgacgtgggggcggtcgctggcgcggcggatgaggctcctgcggcggcgtgcgggaggggggaaggaccaccaccgccaccggctgctggaggacaacgccgcggcggaggccacgacgcccaaggggcaggtggccgtgtacgtgggcggcgccgagcccggcggggagtcgatgcggtacgtggtccccgtggtgtacttcaaccacccgctgttcggggagctgctgcgcgaggccgaggaggagttcggcttccagcaccccggcgggatcaccatcccgtgcgccgcctcgcgcttcgagcgcgcagccgccgtggccgccgggaagaagcaggtgcctgctggtgctggatggtggtag

SEQ ID NO: 17741 - protein, 207 aa, Sorghum bicolor
  misc_feature: Useful for making plants with modulated cold sensitivity
  misc_feature: Functional homolog of the protein sequence given in SEQ ID NO 13454
  misc_feature: Useful for making plants with modulated nitrogen use efficiency
  misc_feature: Functional homolog of the protein sequence given in SEQ ID NO 13811
  misc_feature: Ceres ANNOT ID no. 8681596
  misc_feature (93)..(195): Pfam ID: Auxin_inducible Pfam Description: Auxin responsive protein
MLTRRHGGFRLGRKLLSAWRWALCHRRRRRGRGYLRLQQPWQQGGRGSSKSPSTSPLPDEAAVRAKQQLVVQQQQQRDESGGSPRMLTWGRSLARRMRLLRRRAGGGKDHHRHRLLEDNAAAEATTPKGQVAVYVGGAEPGGESMRYVVPVVYFNHPLFGELLREAEEEFGFQHPGGITIPCAASRFERAAAVAAGKKQVPAGAGWW

SEQ ID NO: 17742 - DNA, 1044 bp, Sorghum bicolor
  misc_feature: Ceres ANNOT ID no. 8681598
  misc_feature: Encodes the peptide sequence at SEQ ID NO 17743
atggacactttttctcatgtaccccctggattccgtttccaccccactgacgaggaactcgtcgattactacctcaggaagaaggtggcgtccaacaagatcgaccttgacgtcataaaagacgtcgatctgtacaaaattgagccctgggatctccaagagaagtgcaagattgggatggaggagcagaacgagtggtacttcttcagccacaaggacaagaagtacccgacggggtctcgcaccaaccgggcgaccaccgccggcttctggaaggcgacggggcgcgacaagcccatctacaccaagagctgcctcgtcgggatgaggaagacgctcgtcttctacaggggccgtgcgcccaacggccagaagtccgactggatcatgcacgagtaccgcctcgagaccaccgagaacgggaccgcccctgaggaaggatgggtggtctgcagggtgttcaagaagcgagtggcgaccgtgcggagaatggccgacggcgcgccgtggttcgacgaccacgtcgccggcggcgggttcatgccggacctcattggctcgccgaggcagctgatgcaccaccaccaccacccaaacgcggtgtacagcggcggtcagcagcagctctaccactgcaagccggagctggagtaccatcaccttctgcccagccaagacgccttcttgcagcagcttcctcagttggtggagagccccaagcctcctcccgcctacattgccgccgcccaaggcagctgcagcctccagctccagtcccccgacgaggccactgggtacaccacccagcaaccggccctgatgatggaggccgccgcttacatggacgactcggtcaccgattggagagtgctcgacaagttcgtcgcgtctcagctcttcagccacggcgacggcacagcgaaagaggccggctactccagtccggcgcaggtgtttcaggctgagaacaagcaaccagaagaagcactggactacgcctccacatctgcctctggtggcggcgaagcgaacatgtggaaatag

SEQ ID NO: 17743 - protein, 347 aa, Sorghum bicolor
  misc_feature: Useful for biocontainment applications
  misc_feature: Functional homolog of the protein sequence given in SEQ ID NO 13684
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: The sequence is a functional homolog of SEQ ID NO 1729 in the 11/479,226 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Useful for making plants with modulated biomass
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 194 in the 10/374,780 US patent application
  misc_feature: The sequence is a functional homolog of SEQ ID NO 898 in the 10/225,066 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: Useful for making plants with altered cell wall content and/or composition
  misc_feature: Useful for making plants with altered lignin content
  misc_feature: Functional homolog of the protein sequence given in SEQ ID NO 12949
  misc_feature: Useful for making plants with altered carbohydrate content
  misc_feature: Functional homolog of the protein sequence given in SEQ ID NO 13622
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: Ceres ANNOT ID no. 8681598
  misc_feature (7)..(136): Pfam ID: NAM Pfam Description: No apical meristem (NAM) protein
MDTFSHVPPGFRFHPTDEELVDYYLRKKVASNKIDLDVIKDVDLYKIEPWDLQEKCKIGMEEQNEWYFFSHKDKKYPTGSRTNRATTAGFWKATGRDKPIYTKSCLVGMRKTLVFYRGRAPNGQKSDWIMHEYRLETTENGTAPEEGWVVCRVFKKRVATVRRMADGAPWFDDHVAGGGFMPDLIGSPRQLMHHHHHPNAVYSGGQQQLYHCKPELEYHHLLPSQDAFLQQLPQLVESPKPPPAYIAAAQGSCSLQLQSPDEATGYTTQQPALMMEAAAYMDDSVTDWRVLDKFVASQLFSHGDGTAKEAGYSSPAQVFQAENKQPEEALDYASTSASGGGEANMWK

SEQ ID NO: 17744 - DNA, 603 bp, Sorghum bicolor
  misc_feature: Ceres ANNOT ID no. 8681626
  misc_feature: Encodes the peptide sequence at SEQ ID NO 17745
atgtctttcaccggcacgcaggacaagtgcaaaacctgcgacaagacggtccacttcatcgacctcctcaccgccgacggcgtctcgtaccacaagacatgcttcaagtgcagccactgcaagggcacactctcgattagcagctactcttccatggacggtgtcctgtactgcaagacgcactttgaacagctcttcaaggagacagggaccttctccaagaaatttcaaggtggagcatcttcaaccaagaccgaccaggcaaaggctccgagcaagctatcatctgcattctctggaactcaagataaatgcgcagcctgccagaaaaccgtgtatccattggagaagatgacgttggaaggcgagtcttaccacaagagctgcttcaagtgctcgcacgggggctgcatcctgacaacctcctcctacgccgcgctcaatgggatcctctactgcaagatccacttctcgcagctgttcaaggagaagggcagctacaaccacctcatccagacggcgcagaccaagaagaacgaggctgcggaggccgcaccggaggcaccggcggatgcaggcgcggctgagccagaagcagcgtag

SEQ ID NO: 17745 - protein, 200 aa, Sorghum bicolor
  misc_feature: The sequence is a functional homolog of SEQ ID NO 1308 in the 11/479,226 US patent application
  misc_feature: The sequence is a functional homolog of SEQ ID NO 612 in the 10/412,699 US patent application
  misc_feature: Useful for making plants with modulated heat sensitivity
  misc_feature: Functional homolog of the protein sequence given in SEQ ID NO 13762
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
  misc_feature: Useful for making plants with altered carbohydrate content
  misc_feature: Functional homolog of the protein sequence given in SEQ ID NO 13763
  misc_feature: Ceres ANNOT ID no. 8681626
  misc_feature (10)..(62): SWISSPROT Homolog: EC 2.7.11.1 Non-specific serine/threonine protein kinase
  misc_feature (105)..(161): Pfam ID: LIM Pfam Description: LIM domain
  misc_feature (10)..(66): Pfam ID: LIM Pfam Description: LIM domain
MSFTGTQDKCKTCDKTVHFIDLLTADGVSYHKTCFKCSHCKGTLSISSYSSMDGVLYCKTHFEQLFKETGTFSKKFQGGASSTKTDQAKAPSKLSSAFSGTQDKCAACQKTVYPLEKMTLEGESYHKSCFKCSHGGCILTTSSYAALNGILYCKIHFSQLFKEKGSYNHLIQTAQTKKNEAAEAAPEAPADAGAAEPEAA

SEQ ID NO: 17746 - DNA, 393 bp, Sorghum bicolor
  misc_feature: Ceres ANNOT ID no. 8681659
  misc_feature: Encodes the peptide sequence at SEQ ID NO 17747
atgtggtgggagtgggaaggcggcggtggggaagcgccgcgggaggagacccccgtcgacttcgacttcatctccctcctttccaagcccaaggattactacaagatactggaagtagactacaatgcgtcagaggagacgatcaggtccagctatatccgccttgcactgaaatggcaccctgataagaagcagggcgaagaaagttcaacctccaaatttcaggaaattaacgaggcataccaagttctgagtaatcctgcaaaaaggcaagagtatgacaagaaaggcattctatatgttcaagatcagaatgtagtggactacctgaaccggcacaaggggctaatacttacctgcaatggtcttggcataaggtactcagtatggtga

SEQ ID NO: 17747 - protein, 130 aa, Sorghum bicolor
  misc_feature: Useful for making plants with modulated heat sensitivity
  misc_feature: Functional homolog of the protein sequence given in SEQ ID NO 13683
  misc_feature: Ceres ANNOT ID no. 8681659
  misc_feature (32)..(94): Pfam ID: DnaJ Pfam Description: DnaJ domain
MWWEWEGGGGEAPREETPVDFDFISLLSKPKDYYKILEVDYNASEETIRSSYIRLALKWHPDKKQGEESSTSKFQEINEAYQVLSNPAKRQEYDKKGILYVQDQNVVDYLNRHKGLILTCNGLGIRYSVW

SEQ ID NO: 17748 - DNA, 687 bp, Sorghum bicolor
  misc_feature: Ceres ANNOT ID no. 8681669
  misc_feature: Encodes the peptide sequence at SEQ ID NO 17749
atggcgagggagcggcgggagataaagaggatagagagcgcggcggcgcggcaggtcacgttctccaagcgccgccgcggcctcttcaagaaggccgaggagctctccgtgctgtgcgatgccgacgtcgcgctcatcgtcttctcctccacggggaagctctcccagttcgccagctccagtatgaatgagatcattgacaagtacaacacacattctaaaaacctggggaaagcagaagagccttctcttgacttgaacttagaacatagcaaatacgcaaatttgaacgagcaacttgtggaagcaagccttagactcaggcagatgagaggtgaagaacttgagggattgagtgttgaagaactccagcaattggagaagaacctggaaactggtctgcacagggtgcttcaaacaaaggatcaacaattcttggaacagatcagcgaccttgaacggaagagtacacagctggcagaggagaacatgcaactgaggaatcaagtatcccagatacctccagctggcaaacaagcagttgctgatactgaaaatgttattgctgaagatgggcaatcctctgaatcagtgatgactgcgttgcactctggaagttcacaggataatgatgatggttcggatgtatctctaaagttagggttgccttgtgttgcatggaagtaa

SEQ ID NO: 17749 - protein, 228 aa, Sorghum bicolor
  misc_feature: Useful for making plants with altered alkaloid content
  misc_feature: Functional homolog of the protein sequence given in SEQ ID NO 13063
  misc_feature: The sequence is a functional homolog of SEQ ID NO 1453 in the 10/374,780 US patent application
  misc_feature: Useful for making plants with modulated flowering time
  misc_feature: Functional homolog of the protein sequence given in SEQ ID NO 13660
  misc_feature: Useful for making plants with modulated biomass
  misc_feature: Functional homolog of the protein sequence given in SEQ ID NO 13659
  misc_feature: The sequence is a functional homolog of SEQ ID NO 1955 in the 10/412,699 US patent application
  misc_feature: The sequence is a functional homolog of SEQ ID NO 1949 in the 10/412,699 US patent application
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8681669
  misc_feature (9)..(59): Pfam ID: SRF-TF Pfam Description: SRF-type transcription factor (DNA-binding and dimerisation domain)
  misc_feature (69)..(172): Pfam ID: K-box Pfam Description: K-box region
MARERREIKRIESAAARQVTFSKRRRGLFKKAEELSVLCDADVALIVFSSTGKLSQFASSSMNEIIDKYNTHSKNLGKAEEPSLDLNLEHSKYANLNEQLVEASLRLRQMRGEELEGLSVEELQQLEKNLETGLHRVLQTKDQQFLEQISDLERKSTQLAEENMQLRNQVSQIPPAGKQAVADTENVIAEDGQSSESVMTALHSGSSQDNDDGSDVSLKLGLPCVAWK

SEQ ID NO: 17750 - DNA, 105 bp, Sorghum bicolor
  misc_feature: Ceres ANNOT ID no. 8681650
  misc_feature: Encodes the peptide sequence at SEQ ID NO 17751
atggtcaacaagatctaccacctcgctagcccccgcatcttcgtgcactacaaattgaatcccatcaagaccatcatatccccttacctcgtcgacctcagctag

SEQ ID NO: 17751 - protein, 34 aa, Sorghum bicolor
  misc_feature: Useful for making plants with altered cell wall content and/or composition
  misc_feature: Functional homolog of the protein sequence given in SEQ ID NO 14572
  misc_feature: Useful for making plants with altered carbohydrate content
  misc_feature: Functional homolog of the protein sequence given in SEQ ID NO 13747
  misc_feature: Ceres ANNOT ID no. 8681650
MVNKIYHLASPRIFVHYKLNPIKTIISPYLVDLS

SEQ ID NO: 17752 - DNA, 762 bp, Sorghum bicolor
  misc_feature: Ceres ANNOT ID no. 8681679
  misc_feature: Encodes the peptide sequence at SEQ ID NO 17753
atggggaagtacatgcgcagcaagtgcaggggggccgcgggcgaggaggtcgccgcggtcgaggtcacgcaggttgtcggcgtcaggacgaggtccaggtccgcggcggcgaccggcggtgtcgcgaaggtcgctccgaggaggaagaaggcgctgacgcccgccgcgaacgtgccggcgggggagcctgccgccgtgggcgctggcggggacggcgggagctgctacatccacctgcgaagccgcatgctgttcatggcaccgcctcagccgcagccgtcggttccgacgcccgcggaggctgctggtgcaggacagcagggcgcggcgctcgtggctgggctctcgcgttgctccagcacggcgtcgtcggtggacgtcgggggccagaacaagagccacgcctgccgctccggcgctgcggaggttggcggggatcacgccccggatgtctcggcgagcaactcggggaacggcccagaccgcgagaggagagagatgacgccatcgagccgggcgcacggcgagctcagcgatctggagtcggatctggcggggcacaagactggccggtccttgccggcggcaacgtcggccccggtgccgatcgtgccaccagcacaagagatcgaggagttcttcgcagccgccgaggcggcccaggccaagcgcttcgcttccaagtacaacttcgacttcgtccgcggtgtgcccctcgaagccggcggccggtttgagtggacgccggtggtcagcatctga

SEQ ID NO: 17753 - protein, 253 aa, Sorghum bicolor
  misc_feature: The sequence is a functional homolog of SEQ ID NO 2 in US patent 7256280
  misc_feature: Ceres ANNOT ID no. 8681679
  misc_feature (201)..(251): Pfam ID: CDI Pfam Description: Cyclin-dependent kinase inhibitor
MGKYMRSKCRGAAGEEVAAVEVTQVVGVRTRSRSAAATGGVAKVAPRRKKALTPAANVPAGEPAAVGAGGDGGSCYIHLRSRMLFMAPPQPQPSVPTPAEAAGAGQQGAALVAGLSRCSSTASSVDVGGQNKSHACRSGAAEVGGDHAPDVSASNSGNGPDRERREMTPSSRAHGELSDLESDLAGHKTGRSLPAATSAPVPIVPPAQEIEEFFAAAEAAQAKRFASKYNFDFVRGVPLEAGGRFEWTPVVSI

SEQ ID NO: 17754 - DNA, 1686 bp, Sorghum bicolor
  misc_feature: Ceres ANNOT ID no. 8681686
  misc_feature: Encodes the peptide sequence at SEQ ID NO 17755
atggtgctcgtcggcttcctcctcacgctgcccctcctcttcctcgtcttcggcggccgctggggcagcagctccttcccttcgtcgtcctcctcctcctctccgcccgtcgtttccaagcccgccgtcggccgcaacgtggacgccggcgaccgcggcgcgacgcctcagggccaaaaacctgtcgctctgaaaaacgtctctgcatcgacggcaacatctgtgtcccaggataagcttctgggcggactactgccctcggcattcgacgaatcctcgtgccagagccgctacaagtcgaacctgtaccggaagccatcccctttcccgctctccccctacctggcgcagaagctgaggaagtacgaggcgtaccacaagaagtgcggcccggggacgaagcgctaccggcgggccgtgaagcagctcaaggccgggcgcaacgccgacaactcggagtgcaagtacgtggtgtggttcccttgcaacggcctgggcaaccgcatgctcaccatcgcgtccaccttcctctacgcgctgctcaccgaccgggtgctcctcatgcacgtctcggcggagcaggagggcctcttctgcgagccgttcccgggcagctcgtgggtgctcccggggaacttcccgcagaacaacccgcagaagctccacatcggcgcgccggagagctacgccaacatgctcaagagcaacgtcgtccgcaacgacgtcgaccccgccagcgtgccggcgtcgtcgctgccggcgtacgtgtacctccacgtggaacagttccagctgaagctgtctgacaacgtcttctgcgacgaggaccaggcgatgctcggcaagttcaactggatgatcctcaagtccgacagctacttcgcgccggcgctgttcctgacgccgatgttcgaggcggagctcgccaggatgttcccgcagaaggaggccgtgttccaccacctgggacggtacctcttccacccgacgaaccgagtgtggggcatcatcaggagatactacgaggcgtaccttgccagagtggacgagaagatcgggttccagatccggatcttccctgagaagccgatcaagttcgagaacatgtacgaccagctgatgcggtgcgtcagggagcagcggctgctgccggagctcggcaccgccgagacgacgacggcgacgacgaacaacgcgacagccgacgccgccgccgggaatggcaaggtgaaggcggtgctgatcgcgtcgctctactcggggtactacgagaagatccgcggcatgtactacgagagccccaccaagagcggggagatcgtggcggtgttccagccgagccacgaggagcagcagcagtacacgtcgaacgagcacaaccagaaggcgctggcggagatctacctgctcagctactgcgacaagatcacgatgagcgcctggtccaccttcggctacgtcgcgtacagcttcgccggcgtgaagccgtggatcctgctccggccggactggaacagggagacctccgacgtggcgtgcgtccggtccacgtccatggagccgtgcctgcactcgccgccgatcctcgggtgcagagccaagagggacgtcgacgtagccgctgtcaagccgtacgtccggcactgcgaggacgtcggcttcggcctcaagttgttcgatagctaa

SEQ ID NO: 17755 - protein, 561 aa, Sorghum bicolor
  misc_feature: Useful for making plants with altered cell wall content and/or composition
  misc_feature: Functional homolog of the protein sequence given in SEQ ID NO 14023
  misc_feature: Ceres ANNOT ID no. 8681686
  misc_feature (73)..(386): SWISSPROT Homolog: EC 2.4.1.69 Galactoside 2-alpha-L-fucosyltransferase
  misc_feature (49)..(533): Pfam ID: XG_FTase Pfam Description: Xyloglucan fucosyltransferase
MVLVGFLLTLPLLFLVFGGRWGSSSFPSSSSSSSPPVVSKPAVGRNVDAGDRGATPQGQKPVALKNVSASTATSVSQDKLLGGLLPSAFDESSCQSRYKSNLYRKPSPFPLSPYLAQKLRKYEAYHKKCGPGTKRYRRAVKQLKAGRNADNSECKYVVWFPCNGLGNRMLTIASTFLYALLTDRVLLMHVSAEQEGLFCEPFPGSSWVLPGNFPQNNPQKLHIGAPESYANMLKSNVVRNDVDPASVPASSLPAYVYLHVEQFQLKLSDNVFCDEDQAMLGKFNWMILKSDSYFAPALFLTPMFEAELARMFPQKEAVFHHLGRYLFHPTNRVWGIIRRYYEAYLARVDEKIGFQIRIFPEKPIKFENMYDQLMRCVREQRLLPELGTAETTTATTNNATADAAAGNGKVKAVLIASLYSGYYEKIRGMYYESPTKSGEIVAVFQPSHEEQQQYTSNEHNQKALAEIYLLSYCDKITMSAWSTFGYVAYSFAGVKPWILLRPDWNRETSDVACVRSTSMEPCLHSPPILGCRAKRDVDVAAVKPYVRHCEDVGFGLKLFDS

SEQ ID NO: 17756 - DNA, 801 bp, Sorghum bicolor
  misc_feature: Ceres ANNOT ID no. 8681692
  misc_feature: Encodes the peptide sequence at SEQ ID NO 17757
atggcgtccactgtaacagccgccaacagccatggaagcgtcctgcgtacccataccgccccctcctccaggcagctcgccggttggagcagcaggcgcacgcttgccatgcctgcacaccacgcgccgtcacccagagctcgggtcgtcgccgtccgagccgccggcacccagcggccgacctggttgcccggactggacccgcctcctcacctcgacggcacactaccaggtgacttcggcttcgatcccttgggcctcggcgaggatccggcaagcttgaagtggtacgttcaggccgagctcgtgcactgccggttcgctatggcaggggtcgccggcatccttttcactgacttgctccgtgtatcagggaacagcgacctccccgtgtggtttgaagcaggtgcggcgaaattcgaattcgcaaacaccacggcgctcttcttcgttcagcttctcttgatggggttcgctgaaaccaagaggtacatggacttcaaaaatccaggatcacaagcagaggaaggaacgttcatagggttagaggctgcacttgcaggtcaacagccaggctaccctggaggccctctgtttaatccactaggacttgcgaaggatatagagaatgctcatgaagagaagctcaaagaaatcaagaatgggaggttggcaatggtagccatgcttggcttcatggtgcaagcatccgtaactcatgccggccccatcgacaatcttttgacacacctttcggacccgttcaacaaaaatatcattcacgcattctcctcttcctaa

SEQ ID NO: 17757 - protein, 266 aa, Sorghum bicolor
  misc_feature: Useful for making plants with modulated nitrogen use efficiency
  misc_feature: Functional homolog of the protein sequence given in SEQ ID NO 14301
  misc_feature: Ceres ANNOT ID no. 8681692
  misc_feature (67)..(237): Pfam ID: Chloroa_b-bind Pfam Description: Chlorophyll A-B binding protein
MASTVTAANSHGSVLRTHTAPSSRQLAGWSSRRTLAMPAHHAPSPRARVVAVRAAGTQRPTWLPGLDPPPHLDGTLPGDFGFDPLGLGEDPASLKWYVQAELVHCRFAMAGVAGILFTDLLRVSGNSDLPVWFEAGAAKFEFANTTALFFVQLLLMGFAETKRYMDFKNPGSQAEEGTFIGLEAALAGQQPGYPGGPLFNPLGLAKDIENAHEEKLKEIKNGRLAMVAMLGFMVQASVTHAGPIDNLLTHLSDPFNKNIIHAFSSS

SEQ ID NO: 17758 - DNA, 1815 bp, Sorghum bicolor
  misc_feature: Ceres ANNOT ID no. 8681689
  misc_feature: Encodes the peptide sequence at SEQ ID NO 17759
atggggaggcaaagcaatagctacgggagcgggggcgacgaggagcggctgcccctccgcggcgtgctggagacgcagcagcgggcgccggggacgccgccgccggtccaccacgccgcggagcagctgaaggaggcgaggcgcgggggcagcaggctctggcgcgcgtccgtgcgcgccgggctggtgctctgcctgctgaccgtcccggccgtcctgctgctgctgcggtggcaggccgacgcctcgccgcagtgggtcttcgacttcgaggcccccgaggaagacgacgaccaagatatacaagatgatatgtccgatgatctatctccatcgccacaaatagcgtacgaccgacttctgggtggccttctggttgagggttttgatgagaaatcatgtagaagcaggtatcagtttgcacgctatcacaattcaccaagcataccttctgcatacctcatagagaggttaaggaaacaagaagctttgcagaaaaagtgtggtccaggcaccaaagcatacaaggaagcctcaaagcagctgaagtatggtcaaagcatcaatacgacagattgcaactatctgtatctgattatccatgctggcttagggaaccggatgcttgagatcacttcagcattcctttatgcgctacttacaaaccggattttgctcgtggaccgttataaggagattgcagaccttttttgtgaaccctttcctggaacatcgtggttggttccttcagatttccctctgaacaatgacgagttcagtcagactagtcctgagagctatggcaacatgctccagaataaagttttcggtggaaatacagatcgatctttggctggtaatagacctccctatgtgtatctccaccttgatggcacctatggtttccatgacaaacttttcttctgtgaagacgaccaacagttcctgcaagaggtttcatggttgatcatgagaacagacatgtactttgtgccgtccctatttctcattccagctttccaagatgaactcagcaggctatttcctgagaaagacactgttttccatcacttggcacgctatctttttcatccgacaaataatgtttggtattcagttacaaaatacttccggtcctacctggccaaagctgaaaaaagagtgggaattcagatcagaatatatgaaaccaaaggtatcttacaaagaaatggtccgttcccacacattttgaatcagatcctctcatgtgctcaaaatgaaaagctgcttccagaagttagtatggcagagggagcagcagctgagactcagaataaccgaacagcagctgggactcagaataaccgaacgattgctgttctaacaacttctttgagctcttggtacagtgatcagattcagaagaagtacgatgagcaaccagctgttgatggcataactgtcaaagtgttccagccgagccacgaggagtaccagaggtcaaggaacaagaagcacaacatgaaggcacttgctgagatctatctactgagcatgagcgatgaactgataaccagtggcttttccacgtttgggtacgctgctcaggggctcgctggcctgaagccatggatcatgtttaagtcggagaaccacgtgatgccagacccaccgtgcggccgtgccatgtccattgagccgtgcttccatcaggctcccttctacgactgcaaagcgaagaaggacgctgatttgggcaaggtagtgccttatgtgaggcactgcgaggacgtgagctgggggctgaagattgtaaatcaaactcatttgtag

SEQ ID NO: 17759 - protein, 604 aa, Sorghum bicolor
  misc_feature: Useful for making plants with altered carbohydrate content
  misc_feature: Functional homolog of the protein sequence given in SEQ ID NO 14024
  misc_feature: Useful for making plants with altered cell wall content and/or composition
  misc_feature: Functional homolog of the protein sequence given in SEQ ID NO 14025
  misc_feature: Ceres ANNOT ID no. 8681689
  misc_feature (291)..(599): SWISSPROT Homolog: EC 2.4.1.69 Galactoside 2-alpha-L-fucosyltransferase
  misc_feature (86)..(573): Pfam ID: XG_FTase Pfam Description: Xyloglucan fucosyltransferase
MGRQSNSYGSGGDEERLPLRGVLETQQRAPGTPPPVHHAAEQLKEARRGGSRLWRASVRAGLVLCLLTVPAVLLLLRWQADASPQWVFDFEAPEEDDDQDIQDDMSDDLSPSPQIAYDRLLGGLLVEGFDEKSCRSRYQFARYHNSPSIPSAYLIERLRKQEALQKKCGPGTKAYKEASKQLKYGQSINTTDCNYLYLIIHAGLGNRMLEITSAFLYALLTNRILLVDRYKEIADLFCEPFPGTSWLVPSDFPLNNDEFSQTSPESYGNMLQNKVFGGNTDRSLAGNRPPYVYLHLDGTYGFHDKLFFCEDDQQFLQEVSWLIMRTDMYFVPSLFLIPAFQDELSRLFPEKDTVFHHLARYLFHPTNNVWYSVTKYFRSYLAKAEKRVGIQIRIYETKGILQRNGPFPHILNQILSCAQNEKLLPEVSMAEGAAAETQNNRTAAGTQNNRTIAVLTTSLSSWYSDQIQKKYDEQPAVDGITVKVFQPSHEEYQRSRNKKHNMKALAEIYLLSMSDELITSGFSTFGYAAQGLAGLKPWIMFKSENHVMPDPPCGRAMSIEPCFHQAPFYDCKAKKDADLGKVVPYVRHCEDVSWGLKIVNQTHL

SEQ ID NO: 17760 - DNA, 1917 bp, Sorghum bicolor
  misc_feature: Ceres ANNOT ID no. 8681690
  misc_feature: Encodes the peptide sequence at SEQ ID NO 17761
atgcagcaacgcaaggccaaggtcgtctggggcggcgccgagagcgcggcggcgcaggagatcccggcgatggcgatggcacgcaacggcagctggcctgaggtcgaaggagcctcggagcactcaccagtgccgcggaagaagaggctggccctggacgagaagcggtggaacactgtggtcaatgtcatgctcgtcgccttcgtcatggctgtgccgccggtcatcgttgtcttcgctgggggcggcatcgtgccatcggtctggatcgcggccgccaaggcccagctgcgccgaggttccagccatgtctccttcccgtacgcaagaaacccacctgacaaacttctcggtggcctcctgcccgatggactcgacgagagatcatgccgcagcaggtacgagtcttccatgtacagccggaacccggcacggcgaccttctccgcacctcatagcaaagctgcggagacacgaagagctccagagacggtgcgggccgaacaccgacgcgtacagccgcgccgtccagcacctgagggccggcaagagcgtcgactcgcccgagtgcaagtacgtggtctccatctcgtaccgcggcctcggcaaccgcatcctggccgccgcgtcggcgttcctctacgcggtgctcaccgaccgcgtcctcctcgtggacccgagcaacgagatggacgagctcttctgcgagcctttccccggcacgacgtggctgctaccgcggcgggacttccccctggcgagctacaccaacttcagcatcgacaccgccgagagctacggcaacatgctgaagaacaaggtgctcagcgccgacgtgccgctgccggcgttcgtgtacctccacctcgaccacgactacggcgacgaggacaagatgttcttctgcgacgacgaccagcggctgctgtcgaacgtgcagtggctggtcatgaggaccgacatgtacaccgtgccggggctgttcctggtcacggcgttccaggaggagctcgacatgctgttcccggagcgcgacgccgtgttccaccacctggcgcggtacctgttccacccaaccaaccacgtctggggcctcgtcacgcggtactaccgcgcgtacctctcccgggcggagctccggctcggcgtccaggtgcgcaacttcgacccctggacgctggagtcgccggtcgtcctccggcagatcacgtcgtgcctgtggaaggagaagctgctcccggaggttcttgacacggaagagcgctccatgccgctgatgccgggcggcagcaccagaaccacggccgttctagtcacctctctccggtcgtggtactacgaacgcatcaaggggctgtactgggatcgcgcgacggcgaccggcgaggacgtgagcgtgcaccagccgagccacgaggggcagcagcagtacggcaagaagtcgcacgacgacagggcctgggcggagatgtacctgctgagcctgtgcgacgtgctggtgaccagcggctggtccacgttcgggtacgtcgcgcaggggatcggcggcatgacgccgtgggtgttgcacaagcccacgaacgtcacgtcgccgccggaaccgccgtgcttccgggacatgtccatggagccgtgcttccacgcgccgcacgtctacgactgcaagctgaagcgtggagccgacacagggaaaatgctgccgcacgtcaggaactgcgaggacgctagtggaggtggagtagtggtgatgtatggctccccttatgaggaaggtatgttttttggcaccattgctctaggatccaaagcttttagtgaccatgttcctttaattattgactttggagttcatgaggatataactaaccttccgcgctggatgctaggagacttgctacaatttgatgggacaacatag

SEQ ID NO: 17761 - protein, 638 aa, Sorghum bicolor
  misc_feature: Useful for making plants with altered cell wall content and/or composition
  misc_feature: Functional homolog of the protein sequence given in SEQ ID NO 14023
  misc_feature: Ceres ANNOT ID no. 8681690
  misc_feature (127)..(578): SWISSPROT Homolog: EC 2.4.1.69 Galactoside 2-alpha-L-fucosyltransferase
  misc_feature (85)..(556): Pfam ID: XG_FTase Pfam Description: Xyloglucan fucosyltransferase
MQQRKAKVVWGGAESAAAQEIPAMAMARNGSWPEVEGASEHSPVPRKKRLALDEKRWNTVVNVMLVAFVMAVPPVIVVFAGGGIVPSVWIAAAKAQLRRGSSHVSFPYARNPPDKLLGGLLPDGLDERSCRSRYESSMYSRNPARRPSPHLIAKLRRHEELQRRCGPNTDAYSRAVQHLRAGKSVDSPECKYVVSISYRGLGNRILAAASAFLYAVLTDRVLLVDPSNEMDELFCEPFPGTTWLLPRRDFPLASYTNFSIDTAESYGNMLKNKVLSADVPLPAFVYLHLDHDYGDEDKMFFCDDDQRLLSNVQWLVMRTDMYTVPGLFLVTAFQEELDMLFPERDAVFHHLARYLFHPTNHVWGLVTRYYRAYLSRAELRLGVQVRNFDPWTLESPVVLRQITSCLWKEKLLPEVLDTEERSMPLMPGGSTRTTAVLVTSLRSWYYERIKGLYWDRATATGEDVSVHQPSHEGQQQYGKKSHDDRAWAEMYLLSLCDVLVTSGWSTFGYVAQGIGGMTPWVLHKPTNVTSPPEPPCFRDMSMEPCFHAPHVYDCKLKRGADTGKMLPHVRNCEDASGGGVVVMYGSPYEEGMFFGTIALGSKAFSDHVPLIIDFGVHEDITNLPRWMLGDLLQFDGTT

SEQ ID NO: 17762 - DNA, 960 bp, Sorghum bicolor
  misc_feature: Ceres ANNOT ID no. 8681770
  misc_feature: Encodes the peptide sequence at SEQ ID NO 17763
atggcagccacggcttcgttcccggtggtgaacatggagaagctggagaccgaggagaaggccacggccatggagatcatccgcgacgcctgcgagaactggggcttcttcgagctgctgaaccatggcatctctcacgagctgatggacgaggtggagcggctgaccaaggcgcactacgccaacttccgggaggccaagttccaggagttcgcggcgcggacgctggaggctggcgacaagggtgccgacgtcaaggacgtggactgggagagcaccttcttcgtccgccacctcccggcctccaacctcgccgacctccccgacgtcgacgaccactacaggcaagtgatgaagcaattcgcatcggagatccagaagctgtcggagaagctgctggacctgctgtgcgagaacctgggcctggagcccggctacctcaagtccgccttcgctggctccaacggccccacgttcggcaccaaggtgagcgcgtacccgccgtgcccgcgcccggacctcgtcgacggcctccgcgcgcacaccgacgccggcggcatcatcctgctgttccaggacgaccaggtcagcggcctgcagctgctcaaggacggcgagtgggtggacgtgccgcccatgcgccacgccatcgtcgtcaacatcggcgaccagctggaggtgatcaccaacggccgctacaagagcgtcatgcaccgcgtgctcacccgccccgacggcaaccgcatgtccatcgcctccttctacaacccgggcgccgacgccgtcatcttcccggcaccagcgctcgtcggcgccgccggcgccgaggaggagcgcgccggccaggccacgtacccgaggttcgtgttcgaggactacatgaacctgtacgtgcgccacaagttcgaggccaaggagccacggttcgaggccatgaagtcggccatcgccaccgcgtga

SEQ ID NO: 17763 - protein, 319 aa, Sorghum bicolor
  misc_feature: Useful for making plants with modulated heat sensitivity
  misc_feature: Functional homolog of the protein sequence given in SEQ ID NO 12924
  misc_feature: Ceres ANNOT ID no. 8681770
  misc_feature: Up-regulated in root tissues in response to salicylic acid treatment
  misc_feature: Up-regulated in shoot tissues in response to salicylic acid treatment
  misc_feature: Up-regulated in shoot tissues in response to methyl jasmonate treatment
  misc_feature: Up-regulated in root tissues in response to methyl jasmonate treatment
  misc_feature (1)..(314): SWISSPROT Homolog: EC 1.14.17.4 Aminocyclopropanecarboxylate oxidase
  misc_feature (157)..(257): Pfam ID: 2OG-FeII_Oxy Pfam Description: 2OG-Fe(II) oxygenase superfamily
MAATASFPVVNMEKLETEEKATAMEIIRDACENWGFFELLNHGISHELMDEVERLTKAHYANFREAKFQEFAARTLEAGDKGADVKDVDWESTFFVRHLPASNLADLPDVDDHYRQVMKQFASEIQKLSEKLLDLLCENLGLEPGYLKSAFAGSNGPTFGTKVSAYPPCPRPDLVDGLRAHTDAGGIILLFQDDQVSGLQLLKDGEWVDVPPMRHAIVVNIGDQLEVITNGRYKSVMHRVLTRPDGNRMSIASFYNPGADAVIFPAPALVGAAGAEEERAGQATYPRFVFEDYMNLYVRHKFEAKEPRFEAMKSAIATA

SEQ ID NO: 17764 - DNA, 960 bp, Sorghum bicolor; identical to SEQ ID NO: 17762
  misc_feature: Ceres ANNOT ID no. 8681774
  misc_feature: Up-regulated in root tissues in response to salicylic acid treatment
  misc_feature: Up-regulated in shoot tissues in response to salicylic acid treatment
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 17765

SEQ ID NO: 17765 - protein, 319 aa, Sorghum bicolor; identical to SEQ ID NO: 17763
  misc_feature: Useful for making plants with modulated heat sensitivity
  misc_feature: Functional homolog of the protein sequence given in SEQ ID NO 12924
  misc_feature: Ceres ANNOT ID no. 8681774
  misc_feature: Up-regulated in root tissues in response to salicylic acid treatment
  misc_feature: Up-regulated in shoot tissues in response to salicylic acid treatment
  misc_feature: Up-regulated in shoot tissues in response to methyl jasmonate treatment
  misc_feature: Up-regulated in root tissues in response to methyl jasmonate treatment
  misc_feature (1)..(314): SWISSPROT Homolog: EC 1.14.17.4 Aminocyclopropanecarboxylate oxidase
  misc_feature (157)..(257): Pfam ID: 2OG-FeII_Oxy Pfam Description: 2OG-Fe(II) oxygenase superfamily

SEQ ID NO: 17766 - DNA, 1491 bp, Sorghum bicolor
  misc_feature: Ceres ANNOT ID no. 8681776
  misc_feature: Up-regulated in root tissues in response to salicylic acid treatment
  misc_feature: Up-regulated in shoot tissues in response to salicylic acid treatment
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 17767
atggcgtccctacgccgcctccccgtcgccgtcctcctcgccgtggcggttccgctcctcttcctttgtccggcagaggcggggacggtgggcgtgaactacggccgcgtggcgaacaacctgccgaatccggcggcggtggtgcagctgctgaagcagcagggcgtcgggcaggtgaagctgtacgacgccgaccccaccgtgctgcgcgcgctggccaacaccggaatcaaggtggtggttgcgctgcccaacgagcagctcgccgcggcggcgtcgcgcgcgtcgtacgcgctcctgtgggtgcgccgcaacgtggcggcctactacccggcgacgcagatccacggcatcgccgtgggcaacgaggtgttcgcgtccgccaagaacgtcacggcgcagctggtccccgccatgacaaacgtgcacgccgcgctggcaaggctcggcctcgacaacgccgtcaaggtgtcgtcgcccatcgcgctcaccgcgctcgcgtcgtcgtacccgtcgtcggcgggcgcgttccgggaggacctcgcgcaggccgtcatgaagcccatgctcgacttcctggcgcagaccgggtcgtacctcatggtgaacgcctacccgttctttgcctactccggcaatgccggcgacatctccctcgactacgcgctgttccgccccaacgccggcgtgctcgatgccgggaacggcctcaagtactacagcctcctcgacgcccagctcgacgccgtgttcgccgcggtcagcaagctcgggaactacaatgccgtacgcgttgtggtctccgagaccgggtggccgtccaagggcgacgccaacgaggcaggcgcttcggcggccaacgccgcagcgtacaacggcaacctggcgcgccgcgtgctttccggcaacgctggcactcctcgccgccccgacgccgacatcgacgtgtacctcttcgcgctcttcaacgagaaccagaagcccgggcccacctctgaacgcaattacggagtcttctacccgaaccagcagaaggtgtacgacgtcgacttcgtcctcggtggcggcggcaacccttcaggcggcggcagccagggcaacaatggcctcgggtggcaggagaacggcgggccgagcagcggcagcggcagcaccagcaccagcggcaatccgccgagcggggtgaaggtcacgaccggggaggcgtggtgcgtggcgaatgcgatcgtcggggagcagcggctgcaggcggcgctggactacgcgtgcggccccggcggcgcggactgcaaggccatccagcccggcgcggcgtgcttcgagcccaacaccatggtcgcgcacgcctcctacgccttcaacgactactaccagcgcaagggccgttccatcgggacctgcgacttcgccggcgccgcctacgtcgtcaaccaggcaccaagtaagctgccgccactcatcttctcatcgtgccatttcctaccgagctaa

SEQ ID NO: 17767 - protein, 496 aa, Sorghum bicolor
  misc_feature: Useful for making plants with altered carbohydrate content
  misc_feature: Functional homolog of the protein sequence given in SEQ ID NO 13866
  misc_feature: Useful for making plants with altered cell wall content and/or composition
  misc_feature: Functional homolog of the protein sequence given in SEQ ID NO 14573
  misc_feature: Useful for making plants with modulated drought sensitivity
  misc_feature: Useful for making plants with modulated water use efficiency
  misc_feature: Functional homolog of the protein sequence given in SEQ ID NO 13472
  misc_feature: Ceres ANNOT ID no. 8681776
  misc_feature: Up-regulated in root tissues in response to salicylic acid treatment
  misc_feature (30)..(349): SWISSPROT Homolog: EC 3.2.1.39 Glucan endo-1,3-beta-D-glucosidase
  misc_feature (30)..(351): Pfam ID: Glyco_hydro_17 Pfam Description: Glycosyl hydrolases family 17
  misc_feature (402)..(493): Pfam ID: X8 Pfam Description: X8 domain
MASLRRLPVAVLLAVAVPLLFLCPAEAGTVGVNYGRVANNLPNPAAVVQLLKQQGVGQVKLYDADPTVLRALANTGIKVVVALPNEQLAAAASRASYALLWVRRNVAAYYPATQIHGIAVGNEVFASAKNVTAQLVPAMTNVHAALARLGLDNAVKVSSPIALTALASSYPSSAGAFREDLAQAVMKPMLDFLAQTGSYLMVNAYPFFAYSGNAGDISLDYALFRPNAGVLDAGNGLKYYSLLDAQLDAVFAAVSKLGNYNAVRVVVSETGWPSKGDANEAGASAANAAAYNGNLARRVLSGNAGTPRRPDADIDVYLFALFNENQKPGPTSERNYGVFYPNQQKVYDVDFVLGGGGNPSGGGSQGNNGLGWQENGGPSSGSGSTSTSGNPPSGVKVTTGEAWCVANAIVGEQRLQAALDYACGPGGADCKAIQPGAACFEPNTMVAHASYAFNDYYQRKGRSIGTCDFAGAAYVVNQAPSKLPPLIFSSCHFLPS

SEQ ID NO: 17768 - DNA, 1788 bp, Sorghum bicolor
  misc_feature: Ceres ANNOT ID no. 8681825
  misc_feature: Up-regulated in root tissues in response to salicylic acid treatment
  misc_feature: Encodes the peptide sequence at SEQ ID NO 17769
atgatgatgatgagcggtcgagcgggcggcggcgccaccgcggggcggtacccgttcacggcgtcgcagtggcaggagctggagcaccaggcgctcatctacaagtgcctggcgtctggcaagcccatcccgtcctacctcatgccgccgctccgccgcatcctcgactccgccctcgccacgtcgccgtccctcgccttcccgccgcaaccctcgttggggtggggctgtttcgggatgggcttcagcaggaagcccgacgaggacccggagcccggccggtgccggcggacggacggcaagaagtggcgctgctccaaggaggcgtacccggactccaagtactgcgagaagcacatgcaccggggcaagaaccgttcaagaaagcctgtggaaatgtccttggccacaccggcgccggcctctgcggtgtcctccgccacaagcgccacagccgccgccgccgccgccaccaccaccacctcgtcgccagcaccgtcctaccgcccagcgcccacctcgcacgacgcctcgccgtaccacgcgctgtacggcggcggcagtccgtactcggcgtcggcgcgtcccgccggtggccccggcccgtaccatcatcccgcgcaggtgagccccttccacctccacctcgagaccacccacccgcacccgccgccgtcctactactccgtagaccagcgggactacgcgtacgggcacgccaccaaggaggtcgtcggcgagcacgccttcttctccgatggcgcggccgagcgggaccgccagcatgccgccggccagtggcagttcaagcagctcgggatggacacgaagccgagccccacgtctctgttccccgtcgccgggtacggcaacggcgctggtgcgtcgccgtacggcgttgatctgggagccaaggaagacgacgaggaagaaaggcggcgccagcagcagcagcactgcttcgttcttggtgccgacctgcggctggagcggccgtcgtcgggccatgacgccgccaccgcgcagaagccgctccggcccttctttgacgagtggccgcacgagaagggaaacaagggtgggtcatggatggggcttgacggcgagacgcagctctccatgtccatccccatggccgccagcgacctccccgtcacctcccgctaccgtaatggtgcgcactgtgcacagcccctgagacactggcaaggtgtcagctgtgaccggccctgcggcatggtgtccggtgagctcgttactgtagatgtggcctctggcaccggcagccttcaaagcctgcacttgctgtctgcttggcacggtgcccgcctgctggtcgcgagtcatgggcgcaagtaccggacgctcacacatgacgggatgtacagtgtgacctggtttttcttttggtttgcgatgtcagagctcagcgacagcatttctcgtgtcagagctctgccgccgacgaaaccaccggctcgtggtaaccttgttgtcgttggagggatccagatggccgcggaggtggatcagaaagtggtggtgcacgtgcggtccacgggtgatgcgccgatcctaaagcaatccaaattcaagatttcaggacgagataagtttttgaaggtcatagagtttcttcgccgacaacttcatcaagatacactgtttgtctatatcaacagtgcattttcgccaaacccagatgaactggtaattgacttgtataataactttggaattgatgggaagctggtggtaaattatgctttgtcagcagcatggggctaa

SEQ ID NO: 17769 - protein, 595 aa, Sorghum bicolor
  misc_feature: The sequence is a functional homolog of SEQ ID NO 1781 in the 10/374,780 US patent application
  misc_feature: Ceres ANNOT ID no. 8681825
  misc_feature (501)..(595): Pfam ID: APG12 Pfam Description: Ubiquitin-like autophagy protein Apg12
  misc_feature (89)..(134): Pfam ID: WRC Pfam Description: WRC
  misc_feature (17)..(53): Pfam ID: QLQ Pfam Description: QLQ
MMMMSGRAGGGATAGRYPFTASQWQELEHQALIYKCLASGKPIPSYLMPPLRRILDSALATSPSLAFPPQPSLGWGCFGMGFSRKPDEDPEPGRCRRTDGKKWRCSKEAYPDSKYCEKHMHRGKNRSRKPVEMSLATPAPASAVSSATSATAAAAAATTTTSSPAPSYRPAPTSHDASPYHALYGGGSPYSASARPAGGPGPYHHPAQVSPFHLHLETTHPHPPPSYYSVDQRDYAYGHATKEVVGEHAFFSDGAAERDRQHAAGQWQFKQLGMDTKPSPTSLFPVAGYGNGAGASPYGVDLGAKEDDEEERRRQQQQHCFVLGADLRLERPSSGHDAATAQKPLRPFFDEWPHEKGNKGGSWMGLDGETQLSMSIPMAASDLPVTSRYRNGAHCAQPLRHWQGVSCDRPCGMVSGELVTVDVASGTGSLQSLHLLSAWHGARLLVASHGRKYRTLTHDGMYSVTWFFFWFAMSELSDSISRVRALPPTKPPARGNLVVVGGIQMAAEVDQKVVVHVRSTGDAPILKQSKFKISGRDKFLKVIEFLRRQLHQDTLFVYINSAFSPNPDELVIDLYNNFGIDGKLVVNYALSAAWG

SEQ ID NO: 17770 - DNA, 2202 bp, Sorghum bicolor
  misc_feature: Ceres ANNOT ID no. 8681801
  misc_feature: Encodes the peptide sequence at SEQ ID NO 17771
atgaagggcgcgtggaagcagagcggcgtggcggccgtggccgaccacctcggccacctcggcggagcagggctcgtcgggcggacgcgtcccgtcaggctctgcctctacggcctcgcgctcaccttcgccgggttcgcggtcttcctctgtttcgcgcccaccctccccgtgccgcccccagcctcgtcgccggccgcggcgtggttcgacggcctgatcgcctccgcgtctccgtaccgcacgcaggtctcgggcttcctctcgtccctgttccccgccaactcctcctccacggtgcctcctgctcctggtggcgtcgcgccgaggcgtgccgggccgagcggcggcgggttcgcggcgagcggttcccgaggcaatggctccatcgcggctcgaccccgcgaggagcagttgggaagcggaggtggagttccgcccagcagcgtaggcgcaggagcaggcgaagctcccagcggcaaggaagcgccagttcctggggctgctactgcggcggtgccgagcggggggccgcccgatgatcatgcgcgaggcggtgccgaggccaaacattccgccgcgagtgccgctgccgaggcgaagggtgagcctcgacctggactcccgagtggtggttcagcccagaacggcacgttggcgaaaggaggcgtgtctgttcggatcaacggctccgacgccaacgcgagttccgtggatgccggagatggcaatgggatgagagcgagtgcaaggaatgctgccggctccacgcaccaattgggaagcgggactgcagctttaggcaacggcactgctgttgcagtcattaatcagactgcgagtgcagttgcagaggccatggacggcaatggaagagcagctgcaggcaacaaccagaccgtcctaattcaggcttcagcaggtaacaagaaccagagttcagctgcttcaaatggaagtcatagcagtccagccaataagcagaatgaatcaactgctagtcctcaggggagcactagtccggtgaaagatcaatctgcacgaggggccatcccaatagccagaaacaacagtgttgtgccggtgaaagcagatgctaatgccggtcggcgcatgaaggttgattggattgagaacatggccagctgcgatatgttctacgggaattgggtccgagatgactcgtatcctctgtatcctgcgggatcatgtcctcacgtcgatgagtccttcaactgccacctcaacggccggcctgacaaagattacgagaggctccggtggcaacccagcggatgcagaatcccaagattgaacccaactgatatgttggagaggctgagggggaagaggctggtgtttgtcggtgattcgctcaacaggaacatgtgggaatccctgatttgtatcttgaggaattctgtcaaagacaagagtaaggtttttgaggtatccggcaggagccaattcagggctgagggctcctactctttcttgttccaggactacaattgcagtgtggagttcttccgctcccctttccttgttcaggaatgggagatgccaatcagcaatggaaagggtaccagggaaactctcaggcttgacattattgattcagcgtttccaagatacaagaacgcagatatcgttatcttcaacactggtcactggtggacgcatgacaaaacttctctagggaaagattactatcaagagggcgaccgcgtgtacagtgagctggatgtccatgatgcctttcggagagctctcaacacctgggccaagtgggttgattccaatgtaaaccccaagaaaaccactgtgtttttcagaggctactcagcatcccatttcagtgggggtcaatggaattcaggcggcagttgtgacaaggaaacagagccaataatgaatgaccagtacctcacgccatacccaacaaagatgagcattttggaggaggtgctccatgggatgaaaacacccgttgtgtacctgaacataacaaggatgactgactacaggaaggaggctcacccttcagtctaccgcaagcagaagttgactgaagaggaaagaaaatcgcctgagctataccaggactgcagccactggtgccttcctggagtaccggactcctggaacgagcttctctacgcacagattttgctgaaacagcagcatacgatgcaacaataa

SEQ ID NO: 17771 - protein, 733 aa, Sorghum bicolor
  misc_feature: Useful for making plants with altered cell wall content and/or composition
  misc_feature: Functional homolog of the protein sequence given in SEQ ID NO 13772
  misc_feature: Ceres ANNOT ID no. 8681801
MKGAWKQSGVAAVADHLGHLGGAGLVGRTRPVRLCLYGLALTFAGFAVFLCFAPTLPVPPPASSPAAAWFDGLIASASPYRTQVSGFLSSLFPANSSSTVPPAPGGVAPRRAGPSGGGFAASGSRGNGSIAARPREEQLGSGGGVPPSSVGAGAGEAPSGKEAPVPGAATAAVPSGGPPDDHARGGAEAKHSAASAAAEAKGEPRPGLPSGGSAQNGTLAKGGVSVRINGSDANASSVDAGDGNGMRASARNAAGSTHQLGSGTAALGNGTAVAVINQTASAVAEAMDGNGRAAAGNNQTVLIQASAGNKNQSSAASNGSHSSPANKQNESTASPQGSTSPVKDQSARGAIPIARNNSVVPVKADANAGRRMKVDWIENMASCDMFYGNWVRDDSYPLYPAGSCPHVDESFNCHLNGRPDKDYERLRWQPSGCRIPRLNPTDMLERLRGKRLVFVGDSLNRNMWESLICILRNSVKDKSKVFEVSGRSQFRAEGSYSFLFQDYNCSVEFFRSPFLVQEWEMPISNGKGTRETLRLDIIDSAFPRYKNADIVIFNTGHWWTHDKTSLGKDYYQEGDRVYSELDVHDAFRRALNTWAKWVDSNVNPKKTTVFFRGYSASHFSGGQWNSGGSCDKETEPIMNDQYLTPYPTKMSILEEVLHGMKTPVVYLNITRMTDYRKEAHPSVYRKQKLTEEERKSPELYQDCSHWCLPGVPDSWNELLYAQILLKQQHTMQQ

SEQ ID NO: 17772 - DNA, 1341 bp, Sorghum bicolor
  misc_feature: Ceres ANNOT ID no. 8681830
  misc_feature: Encodes the peptide sequence at SEQ ID NO 17773
atgctgttgctgttccgttgcttcgtggggtcgtcggagccgtcggcggcggcggccaggagtagcgggagcgggagcgagagcggcgggagcgagaagaaggcggtgcggcggatgcggagcgcgacggcgcggctgcggtcgctgtcgctggacgacctgtcgcgggcgctggcctcgtcgggcctgcacgccttcacgcaggcggagctcagcgccgccacgcgggggctctccagcagcaacttcatcggcgagggtgggttcggacccgtctacaagggcttcctcgacgagcggcttcggcccggggagatcgagccgcagcacgtcgccgtcaagtacctcgacgccgacgggccgcagggccaccgcgagtggctggcggaggtggtgtacctggggatgttgaagcatccgcatctggtgaagctcatcgggtacggctgccaggatgagcagaggatgctcgtgtacgagtacatggccagaggaagcctcgagcaccacctcttcaagaatctgctgtcgaccttgccgtggtgcacgcggctgaagatcgcggtgggcgcggcaaaggggctggcgttcctgcacgaggccgacacgccagtcatctaccgcgacttcaaggcctccaacatcctgctcgactccgattacactgcaaagctctcagactttggactggccaaggagggcccacagggcgacgacacccacgtcaccacccgtgttatggggacacacggctacgccgcgccggagtacattctcaccgggcacctgacggcgaagagcgacgtgtacagcttcggcgtggtgctcctggagctgctgtcggggaggcgcagcgtggacaagcggcggcgcgggcgggagcagcacctggtggactgggcgcgcccgtacctgcgccacacggagcggctgcaccgggtgatggacccctgcctggacggccagtactccgccaaggccgcgcacaaggccgccatgctcgcctacaactgcctgcacagcgtgcccaagtcccgccccaccatgcgcgacgtcgtcgacgcgctccagccgctgctcgccatgtgcagcgacgtgcccgcggggcccttcgtgtacacggtcccgcccgagtccgaagacaatggcaaggccgacgacgacgaggcggtggcggcggcggccgctgccaggaagaagtgcctcgcgtcggccgtgcattcgcacgccgagggcgaccaccggacgtttgcgaaccaacggtgcgcgagctccgtggccgggcacaggagctcctcggcgtcctcctcgcccaaggagagcagggacaggggagcctag

SEQ ID NO: 17773 - protein, 446 aa, Sorghum bicolor
  misc_feature: Useful for making plants with modulated drought sensitivity
  misc_feature: Functional homolog of the protein sequence given in SEQ ID NO 14078
  misc_feature: Ceres ANNOT ID no. 8681830
  misc_feature (63)..(362): SWISSPROT Homolog: EC 2.7.11.1 Non-specific serine/threonine protein kinase
  misc_feature (78)..(356): Pfam ID: Pkinase Pfam Description: Protein kinase domain
MLLLFRCFVGSSEPSAAAARSSGSGSESGGSEKKAVRRMRSATARLRSLSLDDLSRALASSGLHAFTQAELSAATRGLSSSNFIGEGGFGPVYKGFLDERLRPGEIEPQHVAVKYLDADGPQGHREWLAEVVYLGMLKHPHLVKLIGYGCQDEQRMLVYEYMARGSLEHHLFKNLLSTLPWCTRLKIAVGAAKGLAFLHEADTPVIYRDFKASNILLDSDYTAKLSDFGLAKEGPQGDDTHVTTRVMGTHGYAAPEYILTGHLTAKSDVYSFGVVLLELLSGRRSVDKRRRGREQHLVDWARPYLRHTERLHRVMDPCLDGQYSAKAAHKAAMLAYNCLHSVPKSRPTMRDVVDALQPLLAMCSDVPAGPFVYTVPPESEDNGKADDDEAVAAAAAARKKCLASAVHSHAEGDHRTFANQRCASSVAGHRSSSASSSPKESRDRGA

SEQ ID NO: 17774 - DNA, 1494 bp, Sorghum bicolor
  misc_feature: Ceres ANNOT ID no. 8681839
  misc_feature: Encodes the peptide sequence at SEQ ID NO 17775
atgcgcgcactgagccacggcagcagcatgcgcgcccacgtcgccctggccctcgcggcgctggtgctggccggcgacgccctgcacccgtcgctggccgccgccggcttcgactacaaggatgccctcagcaagaccatcatattcctcgaggcgcagcgctccgggaagctgccgcccaacaaccgcgtcaagtggcgcggcgactccgcgctcgacgacggcaagctcgccaatgtggatctcaccggcgggtactacgacgccggcgacaacgtcaagtacgggctgccgctggcgttcacggtgaccacgctcgcatggacggtgctggcgttcaagcccgagctggagcagaccaaggagctggagcacgtgcacgaggccatcaggtggggcaccgactacctgctcaaatgcgccgccaggaagaacaagctgtgggtgcaggtcggcgaccccaacttggaccaccagtgctgggtgcggccggagaacatgaaggcgccgcggacgctgtacgagatcgacgagaagacgcccgggacggagatcgccgccgagacggccgccgccttcgccgcctcctccatggtgttccgcaacgacaagaagtactcgcgcgcgctcctcaacaaggccaagctgctgttcctgttcgccaaggctcaccagggcagctacgacggcgagtgccccttctactgctcctactcgggctacaacgacgagctgctgtgggctgcgacgtggctttacctggcgacgaagcgtcaggtgtacgcggacttcatcacccacgaggccatctcgtcgagcgtggccgaattcagctgggacctcaagttccccggcgcgcaggtgctcctggccgagttcaacatgacgtccggcggcggcgcgcagaacttcaaggtgcaggcggacaacttcgtgtgcgcggtgctcccggacacgccgttccaccaggtgttcatcaccccgggcggcgtgatccacctccgggacggcgccaacacgcagtacgtgacgagcacgtcgttcctgttcgtggtctactccgacctgctgctgcggacggggcagtcggtgatgtgcgggaaccagcccgtggcgccggcgcggctgcgggagttcgcgcggcagcagatggactacctgctgggcgccaacccgcggcacagctcctacgtcgtgggcttcggcgccaactcgcccacgcagccgcaccaccgcggggcgtcgacgcccgtgctgccacccggcaccgacgtcaactgcgggctcagcttcggggagtggatggcgcccgacaggcccaaccccaacgagctcaccggcgccatcgtcggcgggcccgacaagaacgacggcttcgtggacaagcgcggcaactcctcctacaccgagccatgcacctacatcaactcgctcgcaatcggcccgctcgccgcgctcgccgtccgcggcgcgcagctcgtcgcaacgcactga

SEQ ID NO: 17775 - protein, 497 aa, Sorghum bicolor
  misc_feature: Useful for making plants with altered cell wall content and/or composition
  misc_feature: Functional homolog of the protein sequence given in SEQ ID NO 14574
  misc_feature: Ceres ANNOT ID no. 8681839
  misc_feature (30)..(496): SWISSPROT Homolog: EC 3.2.1.4 Cellulase
  misc_feature (38)..(484): Pfam ID: Glyco_hydro_9 Pfam Description: Glycosyl hydrolase family 9
MRALSHGSSMRAHVALALAALVLAGDALHPSLAAAGFDYKDALSKTIIFLEAQRSGKLPPNNRVKWRGDSALDDGKLANVDLTGGYYDAGDNVKYGLPLAFTVTTLAWTVLAFKPELEQTKELEHVHEAIRWGTDYLLKCAARKNKLWVQVGDPNLDHQCWVRPENMKAPRTLYEIDEKTPGTEIAAETAAAFAASSMVFRNDKKYSRALLNKAKLLFLFAKAHQGSYDGECPFYCSYSGYNDELLWAATWLYLATKRQVYADFITHEAISSSVAEFSWDLKFPGAQVLLAEFNMTSGGGAQNFKVQADNFVCAVLPDTPFHQVFITPGGVIHLRDGANTQYVTSTSFLFVVYSDLLLRTGQSVMCGNQPVAPARLREFARQQMDYLLGANPRHSSYVVGFGANSPTQPHHRGASTPVLPPGTDVNCGLSFGEWMAPDRPNPNELTGAIVGGPDKNDGFVDKRGNSSYTEPCTYINSLAIGPLAALAVRGAQLVATH

SEQ ID NO: 17776 - DNA, 720 bp, Sorghum bicolor
  misc_feature: Ceres ANNOT ID no. 8681857
  misc_feature: Encodes the peptide sequence at SEQ ID NO 17777
atgtcgtcgtcgccggagacggaggccgcgagcagcagcagcagcagcagcagcagcaggaagttcaagggcgtgcggaagcgcaagtggggcaagtgggtgtcggagatccggctgcccaacagccgcgagcgcatctggctgggctcctacgacgcccccgacaaggccgcgcgtgccttcgacgccgccttcgtctgcctccgcggccggggcgccgcgggcgcggacctcaacttcccggactcgccgccgccgtgccgggccggagggtgcagcagcgacccgcgggaggtgcaggcggccgcgctctcccacgccaaccgcgccgccgtcacggcccagcaggcggccgcggcgctcatcatggacgccgacgccgacatcggtggcggctgcggctcggcgccgccgtgggactattactactccgtggcgcacgacgcgggcggcggcgtcgtccttggtggtggcgccgctaccagcgcggccgaggtggtggcgcccgtgcgcgccgacgggagcatcgactggcggcccgtcatggcgcacccgccgccgctcttctcccctaccggctggggcagcaatgcgtacgacttcctgcaggtgccgccaccggcggcggctgtggtagacgaggacatggatgacggcatccatggcgcgagcgcttctctctggagcttcgactcgagagactcctacttcagatactaa

SEQ ID NO: 17777 - protein, 239 aa, Sorghum bicolor
  misc_feature: The sequence is a functional homolog of SEQ ID NO 172 in the 11/375,241 US patent application
  misc_feature: The sequence is a functional homolog of SEQ ID NO 800 in the 11/435,388 US patent application
  misc_feature: Ceres ANNOT ID no. 8681857
  misc_feature (20)..(71): Pfam ID: AP2 Pfam Description: AP2 domain
MSSSPETEAASSSSSSSSSRKFKGVRKRKWGKWVSEIRLPNSRERIWLGSYDAPDKAARAFDAAFVCLRGRGAAGADLNFPDSPPPCRAGGCSSDPREVQAAALSHANRAAVTAQQAAAALIMDADADIGGGCGSAPPWDYYYSVAHDAGGGVVLGGGAATSAAEVVAPVRADGSIDWRPVMAHPPPLFSPTGWGSNAYDFLQVPPPAAAVVDEDMDDGIHGASASLWSFDSRDSYFRY

SEQ ID NO: 17778 - DNA, 1107 bp, Sorghum bicolor
  misc_feature: Ceres ANNOT ID no. 8681883
  misc_feature: Encodes the peptide sequence at SEQ ID NO 17779
atgtgcggcggcgcgatcctcgacgacctccgcgagccggagctgcgccgggtcacggaccgggacatctggcagaagaagaagcccaagaggggcggcggcggcgggaggcgctcgttcgcggcggaggaccatgaggacttcgaggccgacttcgcggatttcgaggctgactccggcgattcggatttggagctcggggaaggggctgacgacgatgtcgtcgagatcaagcccttcgccgccaaggggactttctcaggagatggtttaagcaccatgactactgctgattatgatgcccctgttgcaaggtcagccaaaaggaagagaaagaatcaatacaggggtatccgcaagcgcccttggggcaagtgggctgctgagatcagagatcctcagaagggtgttcgtgtttggcttggtactttcaatagtcctgaggaagctgcaagagcttatgatgctgaagcacgcaggattcgtggcaagaaggccaaggttaactttcctgatgcaccagcagttggtcagaagcgccgttctggctcagcttctgctaaagcacccaagtcaagtgttgaacagaagcctgtcgtcaaagcacctatgaccaaccttgccaacacaaatgcatccttctaccaatctgttaactacccctccaacaatccatttgttcagcatgccaatatgccattcgttccagcaatgaactttactgcttctgttgaggatcctatcatgaatctgcactctgaccagggaagtaactcctttggctgctcagacttggcatgggagaatgataccaagacaccagacatcacatccattgctcctatttccactattgctgaaggtgatgagtctgcatttgtcaacagcaattcaaacagctcaatgttgcctcctgtcctggagaacagtgctgttgatttcactgatgggctgacagatttagaatcctatatgaggtttcttctggatggtggtgcaagtgattcagttgatagccttctgaaccttgatggatcacaagatgttggtagcaacatggacctctggagctttgatgacatgcccattgccggcgatttcttctga

SEQ ID NO: 17779 - protein, 368 aa, Sorghum bicolor
  misc_feature: Useful for making plants with altered lignin content
  misc_feature: Functional homolog of the protein sequence given in SEQ ID NO 13219
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: Ceres ANNOT ID no. 8681883
  misc_feature (113)..(164): Pfam ID: AP2 Pfam Description: AP2 domain
MCGGAILDDLREPELRRVTDRDIWQKKKPKRGGGGGRRSFAAEDHEDFEADFADFEADSGDSDLELGEGADDDVVEIKPFAAKGTFSGDGLSTMTTADYDAPVARSAKRKRKNQYRGIRKRPWGKWAAEIRDPQKGVRVWLGTFNSPEEAARAYDAEARRIRGKKAKVNFPDAPAVGQKRRSGSASAKAPKSSVEQKPVVKAPMTNLANTNASFYQSVNYPSNNPFVQHANMPFVPAMNFTASVEDPIMNLHSDQGSNSFGCSDLAWENDTKTPDITSIAPISTIAEGDESAFVNSNSNSSMLPPVLENSAVDFTDGLTDLESYMRFLLDGGASDSVDSLLNLDGSQDVGSNMDLWSFDDMPIAGDFF

SEQ ID NO: 17780 - DNA, 1374 bp, Sorghum bicolor
  misc_feature: Ceres ANNOT ID no. 8681869
  misc_feature: Encodes the peptide sequence at SEQ ID NO 17781
atgaagaagaccctaaacaagttatggccggcgctcgcggagagcaaactcgccgtcgcgctgctcgccggcctctttgtcgcggcggtgatctttctctccgtgccgacgcagttcgcagtccggggcacaaacggtgaagaaattgcaccggcgacagcgacggcgacggcgacctctgttgcgcctgtgcatcctcctctggagccgatctgcgacctctccgaccggcgctacgacggctgcgagatgtggggcgacgcgcgcacggcgagtggcgccgacaagtcggtggtctacttcatcccgccgccgcagcagctcgctaccgcggcggcggccacctggagcatccgctctcagtcccgcaagatcgtcggcgtccgtgaggtgatcgtccggtccctggacgcgtccagcctccacgaggcgcccggctgcacggtgcgccgggacgtgccggccgtggtgttcgcgctcggcggcctcacgtccaactactggcacgccttcagcgacgtgctggtgccgctcttcacgacggcgcgggccttcgggggcgacgtcgacctcctcgccaccggcgccggtggccaggcctggttcctcggcaagtacgaccgcgtcctccgcgcgctctcgcggtacgacgtggtcgacctcgacgccgacggtgacgtcgtgcggtgctaccaccacgtcgtcgtcggcctccgcggccaccgcgacttcgacatcgacgcggcgcgcgccccgaacgggtacgacatgctcgccttccgcgagttcgtccgtgccgcctactccctgccgccgccgcccgccgcagcgctaccgtgcaaatctggcggcggcggaacgaggccgcggctcatgctcgtcctccggggacgcacgcggcggttcgtgaacgagggcgcgatcgtggacgcgatcgagcgcgcgggcttcgaggtggcgcgcatggatgagacggcgtcctggggaagcgtgggcgcggtggcgcgcgaggtggacgcgtgcgacgtgctcgtgggcgcgcacggcgccgggctgaccaacatggtgttcctgcgcgcgggcgccgtggtggtgcaggtgatcccgtgggggaagatggagccctacggggaagggttcttcggcgccccggcggcgcacatggggctccggcacgtcgcctacagcatcgccgccgaggagagcacgctgtacgagaggtacggcaaggaccacccggtgatggccgaccccgacgtgttctacaggaacggcagcaacgccaagttctactggtgggagcagagcatccggctcaacaccaccaggttcgcgccgacgctgcagatggtgaagcggatgctgcgagagtga

SEQ ID NO: 17781 - protein, 457 aa, Sorghum bicolor
  misc_feature: Useful for making plants with altered carbohydrate content
  misc_feature: Functional homolog of the protein sequence given in SEQ ID NO 14537
  misc_feature: Ceres ANNOT ID no. 8681869
MKKTLNKLWPALAESKLAVALLAGLFVAAVIFLSVPTQFAVRGTNGEEIAPATATATATSVAPVHPPLEPICDLSDRRYDGCEMWGDARTASGADKSVVYFIPPPQQLATAAAATWSIRSQSRKIVGVREVIVRSLDASSLHEAPGCTVRRDVPAVVFALGGLTSNYWHAFSDVLVPLFTTARAFGGDVDLLATGAGGQAWFLGKYDRVLRALSRYDVVDLDADGDVVRCYHHVVVGLRGHRDFDIDAARAPNGYDMLAFREFVRAAYSLPPPPAAALPCKSGGGGTRPRLMLVLRGRTRRFVNEGAIVDAIERAGFEVARMDETASWGSVGAVAREVDACDVLVGAHGAGLTNMVFLRAGAVVVQVIPWGKMEPYGEGFFGAPAAHMGLRHVAYSIAAEESTLYERYGKDHPVMADPDVFYRNGSNAKFYWWEQSIRLNTTRFAPTLQMVKRMLRE

SEQ ID NO: 17782 - DNA, 900 bp, Sorghum bicolor
  misc_feature: Ceres ANNOT ID no. 8681924
  misc_feature: Encodes the peptide sequence at SEQ ID NO 17783
atgcataagcagcagcagcagcagcatacggagcggtggggcgatctcctcgacgacgatggcggcgacttcgacctcggcgtgctcctcccgccgccggtcgtcgtcgggcccgacgccaacggcttgaagaaggtgatcgagtaccacatcgacgacgagggcaacaaggtcaaggtcaccaccaccacgcgggtccgcaaggtgcgccgctctaggagggccatcgagcgccgctcgtggcccaagttcggcgacgccgccaaggaggccgccggatctcggctcaccatggtctccactgaggagatcttcttcgatcgcacacgtgcagcatcaggaaacacaggcgacggagcagggccatctacttccgctgattcactggccaagggaaacgataaaccaggaggaggcctcctcatggtttgcagaacctgcgggaagaagggtgaccactggacctcaaagtgcccctacaaggatcttgctccacagcagggcgaaagctctggcgacaggcctcctagcgccgacggctctggcggcgcagccggcggcaagggtgggagtggagcatatgttcctgtgttcaagaggctgggtggcgacagaagtggagcggatgtgatgaggcgcaggaacgacgagaactcggtccgcgtgagcaacctctcggaggacgctagggatcctgacctcgcagagctgttcggccagtttgggcagcttagccgcgtctatgtagcaatagacagggtgactggagagagcagggggtttggcttcgtcaactttgttcacagggaggatggcgagagggctatcaacaagctcaatgggtacggttacgacaaccttatcctgcacgtcgaatgggcagcgccaaggcccaactag

SEQ ID NO: 17783 - protein, 299 aa, Sorghum bicolor
  misc_feature: Useful for making plants with altered alkaloid content
  misc_feature: Functional homolog of the protein sequence given in SEQ ID NO 14575
  misc_feature: Ceres ANNOT ID no. 8681924
  misc_feature (203)..(294): SWISSPROT Homolog: EC 5.2.1.8 Peptidylprolyl isomerase
  misc_feature (220)..(291): Pfam ID: RRM_1 Pfam Description: RNA recognition motif. (a.k.a. RRM, RBD, or RNP domain)
MHKQQQQQHTERWGDLLDDDGGDFDLGVLLPPPVVVGPDANGLKKVIEYHIDDEGNKVKVTTTTRVRKVRRSRRAIERRSWPKFGDAAKEAAGSRLTMVSTEEIFFDRTRAASGNTGDGAGPSTSADSLAKGNDKPGGGLLMVCRTCGKKGDHWTSKCPYKDLAPQQGESSGDRPPSADGSGGAAGGKGGSGAYVPVFKRLGGDRSGADVMRRRNDENSVRVSNLSEDARDPDLAELFGQFGQLSRVYVAIDRVTGESRGFGFVNFVHREDGERAINKLNGYGYDNLILHVEWAAPRPN

SEQ ID NO: 17784 - DNA, 2550 bp, Sorghum bicolor
  misc_feature: Ceres ANNOT ID no. 8681964
  misc_feature: Encodes the peptide sequence at SEQ ID NO 17785
atgccttcgctctcctgccacaacctcctcgacctcgccgcggccgacgaggtgcccctgccgtcgcccacgccgcttcgcctcccgcgcgtcatgtccgtcgcgtccccggcctcgcccacctcgccatccccggccgccccgccgcgccgcgtcatcgtctcccaccgcctcccgctccgcgcgtcgccggacccggccgcgccgttcgggttcaacttctccgtcgactccggcaccgtcgcgtaccagctccgctcggggctgcccgccaacgcgcccgtcctccacatcggcaccctcccagcggccgcggcggaggccgcctcagatgagttgtccaactacctgctggccaatttctcgtgcctgccggtgtaccttcccaccgacctccaccaccgcttctaccacggattctgcaagcactacctctggccgctcctccattacctgctcccgctgacgccgtcgtcgctcggcggcctcccgttccagcggacgctctaccactccttcctctcggcgaacagggccttcgccgaccgcctcaccgaggtgctgtctcccgacgaggacctcgtctggatccacgattaccacctcctcgcgctcccgaccttcctccgcaagcgcttcccgcgcgccaaggtcggattcttcctccactcgcccttcccctcgtcggagatcttccgcacaatccccgtgcgggatgacctcgtccgcgccctcctcaacgccgacctcgtcggcttccatacctttgactacgcgcgccacttcctgtccgcgtgctcgcggctgctcggcctcgactaccaatccaagcgcggttacatcggcatcgagtactacggccgcaccgtgacggtcaagatactccccgtcgggatcgacatgggccagctcagatcggtggtctcggcgccggagacggaggatgtggtgcggcgggtgaccgagacgtacaaggggcggcgcctcatggtcggcgtcgacgacgtcgatctgttcaaggggatcgggctcaagttcctggcgatggagcagctgctcgtagagcaccgggagctccgcggccgcgccgtgctcgtgcagatcgccaaccctgcgcgcagcgaggggcgcgacgtgcagggcgtgcaggacgaagccagggccatcagcgcccgggtcaatgcgcgttttggcacccccggctacacgccgatcgtgctcatcgacggcccggtgacgcctcaggagaaggctgcctactacgcggccgccgagtgctgcgtcgtgagcgccgtgcgcgacgggctcaaccggattccctacatctacacggtgtgccggcaggagagcaccgcgctcggagacgacgcgcccaagcggagcgtcatcgtgctctccgagttcgtcggttgctccccgtccctgagcggcgcgatccgcgtcaacccctggagcgtggagtccgtcgcggaggccatgaacgccgcgctgcggatgtccgaggccgagcagcggctgcggcacgagaagcactacaagtacgtgagcacccacgacgtcgcctactgggcgcggtccttcgactcggacctgcagcgcgcctgcaaggaccatttctcgcgccggcattgggggatcgggttcggcatgagcttcaaggtggtggcccttggccccaatttccggcggctctccgtggagcacattgtcccgtcatatcgtaggacggagaaccggctgattctcctggactacgacggcaccgtgatgccagagaattccatcgacaggacgccgagcagtgaggtcatctctgtgttgaatcgtctgtgcgaggaccccaagaacagagtgttcatcgtgagcggtcgggggaaggacgagctcagcaggtggttcgccccctgcgagaagctgggcatcgccgcggagcacggttacttcacaaggtggagcagggacgcgccatgggagatctcaggattggccgccgacttcgactggaagaagaccgcggagcctgtgatgcagctgtacacggaggcaacagatggctcctacatcgagcacaaggagagcgccatcgtctggcaccaccacgaggcggatcctgacttcggttcctgccaggccaaggaactgctcgaccatctcgaaaacgtgctcgccaacgaacccgtggtggtgaagagaggccagcacatcgtcgaggttaacccccagggcatcagcaaaggcgtggtcgtggaaggcctcctgtcgtccatggtcaaaacggggaagccgccggacttcgtgctgtgcatcggcgacgaccggtcggacgaggacatgttcgagagcatcgtgtgcccatccaacagcagcctgaagctcccggccagcagcgaggtgttcgcgtgcacggtgggcaagaagccgagcatggccaaatactacctggacgacaccgtggatgtgatcaagatgctcgacggcctggccagcgcgccgtcgcagcggcctaggccggcggtgcagctcagggtgtcgttcgaaggttcgctctga

SEQ ID NO: 17785 - protein, 849 aa, Sorghum bicolor
  misc_feature: Useful for making plants with altered carbohydrate content
  misc_feature: Functional homolog of the protein sequence given in SEQ ID NO 14000
  misc_feature: Ceres ANNOT ID no. 8681964
  misc_feature: Up-regulated in root tissues in response to methyl jasmonate treatment
  misc_feature: Up-regulated in shoot tissues in response to methyl jasmonate treatment
  misc_feature (462)..(829): SWISSPROT Homolog: EC 3.1.3.12 Trehalose-phosphatase
  misc_feature (49)..(533): Pfam ID: Glyco_transf_20 Pfam Description: Glycosyltransferase family 20
  misc_feature (582)..(818): Pfam ID: Trehalose_PPase Pfam Description: Trehalose-phosphatase
MPSLSCHNLLDLAAADEVPLPSPTPLRLPRVMSVASPASPTSPSPAAPPRRVIVSHRLPLRASPDPAAPFGFNFSVDSGTVAYQLRSGLPANAPVLHIGTLPAAAAEAASDELSNYLLANFSCLPVYLPTDLHHRFYHGFCKHYLWPLLHYLLPLTPSSLGGLPFQRTLYHSFLSANRAFADRLTEVLSPDEDLVWIHDYHLLALPTFLRKRFPRAKVGFFLHSPFPSSEIFRTIPVRDDLVRALLNADLVGFHTFDYARHFLSACSRLLGLDYQSKRGYIGIEYYGRTVTVKILPVGIDMGQLRSVVSAPETEDVVRRVTETYKGRRLMVGVDDVDLFKGIGLKFLAMEQLLVEHRELRGRAVLVQIANPARSEGRDVQGVQDEARAISARVNARFGTPGYTPIVLIDGPVTPQEKAAYYAAAECCVVSAVRDGLNRIPYIYTVCRQESTALGDDAPKRSVIVLSEFVGCSPSLSGAIRVNPWSVESVAEAMNAALRMSEAEQRLRHEKHYKYVSTHDVAYWARSFDSDLQRACKDHFSRRHWGIGFGMSFKVVALGPNFRRLSVEHIVPSYRRTENRLILLDYDGTVMPENSIDRTPSSEVISVLNRLCEDPKNRVFIVSGRGKDELSRWFAPCEKLGIAAEHGYFTRWSRDAPWEISGLAADFDWKKTAEPVMQLYTEATDGSYIEHKESAIVWHHHEADPDFGSCQAKELLDHLENVLANEPVVVKRGQHIVEVNPQGISKGVVVEGLLSSMVKTGKPPDFVLCIGDDRSDEDMFESIVCPSNSSLKLPASSEVFACTVGKKPSMAKYYLDDTVDVIKMLDGLASAPSQRPRPAVQLRVSFEGSL

SEQ ID NO: 17786 - DNA, 1320 bp, Sorghum bicolor
  misc_feature: Ceres ANNOT ID no. 8681978
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 17787
atgcgggtgctggaggaggacctcttcccctccaccccaggcaaggtgaagatcgagcgggcgggcgccatgaaccggcagctccaccgctgcttcgcgtccaccagcaccatgttcctgtgggcgctgttcctcgtcgccatgacggcgtcctacctcagcttccagtccttcgtcgacacctcctccaagtacttcgccgcctcatggggcggcctgcactgggagcggcagatccgcgcgtccgccgcgcccaggcggccaccgggttccgccgccggggccgggatgtcggtgctggtgaccggcgccgcgggcttcgtcggcacccactgctccctcgcgctccgcaagcgtggcgacggcgtcgtcggcgtcgacaacttcaacgcctactacgacccctcgctcaagaaggcgcgcaaggcgctgctcgcctcccacggggtgttcgtcgtcgagggcgacatcaacgacggccgcctactcgccaagctcttcgacgtcgtgcccttcacccacgtgctccacctcgccgcgcaggccggcgtgcgctacgccatggagaacccggcgtcgtacgtgcactccaacatcgccggcctcgtcacgctcctcgaggcctgcaaggacgccgacccgcagccggccatcgtctgggcctcgtcgtcctcagtctacggcctcaacgacaaggtccctttctcggagcgcgaccgcaccgatcagccggcctcgctctacgcggccaccaagaaggccggcgaggagatcacgcacacgtacaaccacatctacggcctctccatcaccggcctccgcttcttcaccgtgtacgggccctggggccgccccgacatggcctacttctccttcacccgcaacatcctgcaggggaaacccatcacggtgtaccgcggcaaggaccacgtcgacctggcccgcgacttcacctacatcgacgacattgtcaagggctgcctcggctccctggacacggccggcaagagcaccggcacggggggcaagaagcgtgggccggcgccctacaggatcttcaacctcggcaacacctcgcccgtcacggtgcccaacctggtgtccatcctggagaagcacctccgcgtcaaggccaagaagcacgtggtcgagatgcccggcaatggcgacgtgcccttcacccacgccaacatctcactcgccagggagcagctcgggtacaagccctccactaacctcgacgtcggcctcaagaagttcgtcaagtggtacctgtcctactacggctacaccaggggatccaagaactcgcgacaatga

SEQ ID NO: 17787 - protein, 439 aa, Sorghum bicolor
  misc_feature: Useful for making plants with altered carbohydrate content
  misc_feature: Functional homolog of the protein sequence given in SEQ ID NO 14576
  misc_feature: Useful for making plants with altered cell wall content and/or composition
  misc_feature: Functional homolog of the protein sequence given in SEQ ID NO 14577
  misc_feature: Ceres ANNOT ID no. 8681978
  misc_feature (1)..(435): SWISSPROT Homolog: EC 5.1.3.6 UDP-glucuronate 4-epimerase
  misc_feature (99)..(356): Pfam ID: Epimerase Pfam Description: NAD dependent epimerase/dehydratase family
MRVLEEDLFPSTPGKVKIERAGAMNRQLHRCFASTSTMFLWALFLVAMTASYLSFQSFVDTSSKYFAASWGGLHWERQIRASAAPRRPPGSAAGAGMSVLVTGAAGFVGTHCSLALRKRGDGVVGVDNFNAYYDPSLKKARKALLASHGVFVVEGDINDGRLLAKLFDVVPFTHVLHLAAQAGVRYAMENPASYVHSNIAGLVTLLEACKDADPQPAIVWASSSSVYGLNDKVPFSERDRTDQPASLYAATKKAGEEITHTYNHIYGLSITGLRFFTVYGPWGRPDMAYFSFTRNILQGKPITVYRGKDHVDLARDFTYIDDIVKGCLGSLDTAGKSTGTGGKKRGPAPYRIFNLGNTSPVTVPNLVSILEKHLRVKAKKHVVEMPGNGDVPFTHANISLAREQLGYKPSTNLDVGLKKFVKWYLSYYGYTRGSKNSRQ

SEQ ID NO: 17788 - DNA, 1356 bp, Sorghum bicolor
  misc_feature: Ceres ANNOT ID no. 8682006
  misc_feature: Encodes the peptide sequence at SEQ ID NO 17789
atggcggtggagatcctcgagtcctgcatggtgaaacccagcgacgacgcggggacgacgacgacacccatgcacgtggtctggctctccaacctcgacctgctcgtggccaggagccacacgcccaccatctacgtgtaccggcggcccgccagccctgacgtcccgggcttcttctcgccggacgtcctcaaggccgccctgtccaaggcgctcgtccccttctaccccctcgccggccggctcgcgcaggacggcgctggtcgcccggagatccactgtaccggcgacggcgcgctcttcgtcaccgcgcgcgccgacgttaccctccaggacctcgccaccgccggcgggctcgccccgtcggatgagctgcggcagatgcttgtcccctccgcagccgacgacggcgaagaccgcgccggcatcttggccatgttccaggtgacgtccttcaagtgcggcggggtgtgcgtgggcgcggcgatccaccacacggcggcggacggcctcgcggcgctcgacttcgtcaacacgtgggccgccatcgccagcaagggcgtcgacgaggccgcgccgcgcccgtggctggaccgcacgctcctccgcgcgcgctcccctcccgacgtgcgcttcgaccacagcgagtactcccggcgcggcggcggcgatccaaaggcggcgagggtcccgttcgactccgccatcctgcccatgtctaaggcccagctggacgcgctcaagggcggcggcggcgaaggcagcaagaaggtgtccacgttcaaggccgtggtcgcccacgtgtggcggtgcgcgtgcacggcgcgcgggctggcgcaagacgaggacacgcgtctgtacatgaccgccgacgcgcggtcccgcgtccggccgccgctcccggaaggctacctcggcaacgccatcttccgcgcgtcgacggtggccaaggcgggggacgtcgtctcggagccgctcgacgccgtcgcgggcagggtgtccggcgccaccgcgcggctggacgacgagtacgtgcggtcgctggtggactgcctggagcaggtggtgagcgacgcggcggggctgcgcaagggggagtgggtcatgccggagaccgacctgtgggtgataagctggcaggggctgcccatctacgacgccgacttcggctggggccgcccggcgttcatgggccgggcgtgcctccagttcagcggcctcgtgtacctcgtccccggccccgacggcgacggccgcctcgacgtcgtcgtggccatggagcccaagagcctggccaggttcaaggagctgttctatgagctcgagggtgcagctgttccgtgcatggccaactga

SEQ ID NO: 17789 - protein, 451 aa, Sorghum bicolor
  misc_feature: Useful for making plants with altered carbohydrate content
  misc_feature: Functional homolog of the protein sequence given in SEQ ID NO 14578
  misc_feature: Ceres ANNOT ID no. 8682006
  misc_feature (1)..(440): SWISSPROT Homolog: EC 2.3.1.144 Anthranilate N-benzoyltransferase
  misc_feature (1)..(441): Pfam ID: Transferase Pfam Description: Transferase family
MAVEILESCMVKPSDDAGTTTTPMHVVWLSNLDLLVARSHTPTIYVYRRPASPDVPGFFSPDVLKAALSKALVPFYPLAGRLAQDGAGRPEIHCTGDGALFVTARADVTLQDLATAGGLAPSDELRQMLVPSAADDGEDRAGILAMFQVTSFKCGGVCVGAAIHHTAADGLAALDFVNTWAAIASKGVDEAAPRPWLDRTLLRARSPPDVRFDHSEYSRRGGGDPKAARVPFDSAILPMSKAQLDALKGGGGEGSKKVSTFKAVVAHVWRCACTARGLAQDEDTRLYMTADARSRVRPPLPEGYLGNAIFRASTVAKAGDVVSEPLDAVAGRVSGATARLDDEYVRSLVDCLEQVVSDAAGLRKGEWVMPETDLWVISWQGLPIYDADFGWGRPAFMGRACLQFSGLVYLVPGPDGDGRLDVVVAMEPKSLARFKELFYELEGAAVPCMAN

SEQ ID NO: 17790 - DNA, 468 bp, Sorghum bicolor
  misc_feature: Ceres ANNOT ID no. 8682040
  misc_feature: Encodes the peptide sequence at SEQ ID NO 17791
atggcccggccgcagcaacggtaccgcggcgtgcggcagcgccactggggctcctgggtctccgagatccgccaccctctcctgaaggcgcggatatggctgggcaccttcgagacggcggaggacgcggcgcgcgcctacgacgaggcggctcggatcatgtgcgggccacgcgcgcgcaccaacttccccgccgacgcctccgacccgcccgccgccgccgcctccccgtcgttcctctccgcggcgctcgtcgagaagctgcaccggttcaacctggcgtccgtgcaggccacgcagcggcagagggaggcggcggctgcagcctccgcggccgctgccgccgcctccgccgcgacgccaccgccgggcgcgcagtggggcggcaggttcctggaggagcagcacgtggagcagatgatcgaggagctgctggactccaacttctccatggagatttgctgctag

SEQ ID NO: 17791 - protein, 155 aa, Sorghum bicolor
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 14579
  misc_feature: Ceres ANNOT ID no. 8682040
  misc_feature (6)..(57): Pfam ID: AP2 Pfam Description: AP2 domain
MARPQQRYRGVRQRHWGSWVSEIRHPLLKARIWLGTFETAEDAARAYDEAARIMCGPRARTNFPADASDPPAAAASPSFLSAALVEKLHRFNLASVQATQRQREAAAAASAAAAAASAATPPPGAQWGGRFLEEQHVEQMIEELLDSNFSMEICC

SEQ ID NO: 17792 - DNA, 2280 bp, Sorghum bicolor
  misc_feature: Ceres ANNOT ID no. 8682068
  misc_feature: Encodes the peptide sequence at SEQ ID NO 17793
atggcgatcctgtcggaggtcgccaccgaggtgcttatccctctcgccgcggccgtcggcatcgccttcgccgtcgcgcagtgggtcctcgtctcgcgcgtcaagctggctccatcgtccggacgcgacaaggacgtgctcgccgagtcgctgatcgaggaggaagaggggctgaacgaccacaacgtggtggtgcggtgcgccgagatccagtgcgccatcgccgagggcgcgacgtcgttcctcttcaccgagtaccggtacgtgggcgccttcatgtgcgtcttcgccgccgtcatcttcgtcttcctcggctccgtcgacgggttcagcacccagagccggccctgcgcgtacagcgagggcaaacagtgcaagcccgcgctgttcaacgccgtcttcagcaccgtcgccttcctgctcggcgccgccacctccgtcgtgtcggggttcctcggcatgaaggtcgccacgtacgccaacgcccgcaccacgctcgaggccaggaagggcgtcggcagggcctttgtcaccgcgttccggtccggcgccgtcatgggcttcctgctcgcgtccagtggcctcctcgtgctctacgtcgccatcaacctgttcaagctctactacggcgatgactgggaagggctgttcgagtccatcaccggctatggcctcggtgggtcttccatggcgctgttcggaagggtcggtggcggcatctacaccaaggcggccgacgtcggcgcggaccttgtcggcaaagttgagaggaacatccctgaagatgatcccagaaaccctgctgtgatcgccgacaacgtcggagacaacgtcggcgacatcgccgggatgggatcagatctcttcggctcatacgccgaatcctcctgcgccgccctcgtcgtggcatccatctcctcgtttggtgtcagtcatgacttcaccgggatgtgctacccgctgctggtgagctccgtcggcatcgtcgtctgcctcgtcaccacgctcttcgcaaccgacttcttcgagatcaaggacgtcaaacagatcgagcctgcactgaagaagcagctcatcatctcgacggcgctgatgaccgccggcatcgcgctcatcacttggctggcactccctgctaacttcacaatcttcaatttcggtgaacagaaggaagttagcaactggggattgttcttgtgtgttgcaattggtctctgggctggtttgatcatcggatacgtcacggaatactatacgagcaatgcatacagccctgtgcaggacgtggccgacgcctgcagaaccggcgcggcgaccaacgtcatattcgggctggctctgggatacaagtcggtgataatccccatcttctccatcgccgtcggcatctacgtcagcttcaccgtcgcggcgatgtacggcatcgccgtggcggcactcggcatgctgagcacgatcgcgacgggcctctccatcgacgcgtacggccccatcagcgacaacgcgggcggcatcgcggagatggcagggatgagccacaggatccgcgagcggaccgacgcgctcgacgcggccgggaacacgacggccgccatcggcaagggcttcgccatcggctccgccgcgctggtgtcgctggcgctgttcggcgcgttcgtgagcagggcgggcgtgaaggtggtggacgtgctgtccccgaaggtgatcatcgggctggtgacgggcgcgatgctcccgtactggttctcggcgatgacgatgaagagcgtgggccgggccgcgctggagatggtggaggaggtccggcggcagttcgccaccatcccggggctgatggaggggacggggaagcccgactacgcgcggtgcgtgaagatctcgacggacgcgtcgatccggcagatggtcccgccgggcgcgctggtgatgctgacgccgctggtggtgggcacgctgctgggcgtgcacacgctggccggggtgctcgccggcgcgctggtgtccggggtgcaggtggccatctccgcctccaacacgggcggcgcgtgggacaacgccaagaagtacatcgaggccggggccagcgagcacgcccggtcgctggggcccaagggatccgactgccacaaggccgccgtcatcggggacaccatcggcgacccgctcaaggacacgtcgggaccctcgctcaacatcctcatcaagctcatggctgtcgagtccctcgtcttcgcgccgttcttcgccgcccacggcggcatcctcttcaagctcttctag

SEQ ID NO: 17793 - protein, 759 aa, Sorghum bicolor
  misc_feature: Useful for making plants with modulated water use efficiency
  misc_feature: Functional homolog of the protein sequence given in SEQ ID NO 13830
  misc_feature: Ceres ANNOT ID no. 8682068
  misc_feature (1)..(757): SWISSPROT Homolog: EC 3.6.1.1 Inorganic diphosphatase
  misc_feature (6)..(745): Pfam ID: H_PPase Pfam Description: Inorganic H+ pyrophosphatase
MAILSEVATEVLIPLAAAVGIAFAVAQWVLVSRVKLAPSSGRDKDVLAESLIEEEEGLNDHNVVVRCAEIQCAIAEGATSFLFTEYRYVGAFMCVFAAVIFVFLGSVDGFSTQSRPCAYSEGKQCKPALFNAVFSTVAFLLGAATSVVSGFLGMKVATYANARTTLEARKGVGRAFVTAFRSGAVMGFLLASSGLLVLYVAINLFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGVSHDFTGMCYPLLVSSVGIVVCLVTTLFATDFFEIKDVKQIEPALKKQLIISTALMTAGIALITWLALPANFTIFNFGEQKEVSNWGLFLCVAIGLWAGLIIGYVTEYYTSNAYSPVQDVADACRTGAATNVIFGLALGYKSVIIPIFSIAVGIYVSFTVAAMYGIAVAALGMLSTIATGLSIDAYGPISDNAGGIAEMAGMSHRIRERTDALDAAGNTTAAIGKGFAIGSAALVSLALFGAFVSRAGVKVVDVLSPKVIIGLVTGAMLPYWFSAMTMKSVGRAALEMVEEVRRQFATIPGLMEGTGKPDYARCVKISTDASIRQMVPPGALVMLTPLVVGTLLGVHTLAGVLAGALVSGVQVAISASNTGGAWDNAKKYIEAGASEHARSLGPKGSDCHKAAVIGDTIGDPLKDTSGPSLNILIKLMAVESLVFAPFFAAHGGILFKLF

SEQ ID NO: 17794 - DNA, 687 bp, Sorghum bicolor
  misc_feature: Ceres ANNOT ID no. 8682081
  misc_feature: Encodes the peptide sequence at SEQ ID NO 17795
atgggcaagatcgagtacgccgtggtggcgcgcggtgcggtggtgctggcggagcactacggcgcgtcggcggcgggcggcaacgcgggcgccgtggcgaggcaggtcctcgagcgcctccccgccggcggcgccggtggcgacgactgcaacgtctcgtacacgcaggacctccacgtgttccacgtcaagcgcaccgacggcctcaccgcgctctgcatggccgacgacgccgccgggcggcgtgttccgttcgcgttcctggaggacatccacgggaggttcgtcaaggcgtacggccgcgcggcgctcaccgcgctcgcgtacgccatgaacgacgagttctccagggttctggcccagcagatggactactactccaacgacgccagcgcggacaggataaaccgcatgaggggtgagatcgaccaggtccggaacgtgatgatagacaacatcgacagggtgctggagaggggtgagcgtctggagctgctggtggacaagacggcaaccatgcaggggaacaccatgcgcttcaagcgccaagctcgccgcttcaggaacaccatgtggtggaggaacgtcaagctcaccgccgcggtgatattcatcctcaccgtaatattgtacctcgtgctcgcctacatgtgtcacggcttcaccctaccatcctgtgttccgtga

SEQ ID NO: 17795 - protein, 228 aa, Sorghum bicolor
  misc_feature: Useful for making plants with modulated heat sensitivity
  misc_feature: Functional homolog of the protein sequence given in SEQ ID NO 13180
  misc_feature: Ceres ANNOT ID no. 8682081
  misc_feature (131)..(219): Pfam ID: Synaptobrevin Pfam Description: Synaptobrevin
MGKIEYAVVARGAVVLAEHYGASAAGGNAGAVARQVLERLPAGGAGGDDCNVSYTQDLHVFHVKRTDGLTALCMADDAAGRRVPFAFLEDIHGRFVKAYGRAALTALAYAMNDEFSRVLAQQMDYYSNDASADRINRMRGEIDQVRNVMIDNIDRVLERGERLELLVDKTATMQGNTMRFKRQARRFRNTMWWRNVKLTAAVIFILTVILYLVLAYMCHGFTLPSCVP

SEQ ID NO: 17796 - DNA, 849 bp, Sorghum bicolor
  misc_feature: Ceres ANNOT ID no. 8682088
  misc_feature: Encodes the peptide sequence at SEQ ID NO 17797
atggggctgagggagatcgagtccacattgccgccggggttcaggttctaccccagcgacgaggagctggtgtgccactacctctacaagaaggtggccaacgagcacgcggcgaagctgacggcgagcgagtggtacttcttcagcttcagggaccgcaagtacgcgacgggttcgcgcacgaaccgcgccaccaagacggggtactggaaggccaccggcaaggaccgcgaggtgcgcagcccggccacccgcggcgtcgtcggcatgaggaagacgctcgtcttctaccagggccgcgcccccaacggcgtcaagtcctgctgggtcatgcacgagttccgcctcgactcgccgcacacgccaccaaaggaggactgggtgctgtgcagggtgttccagaagcggaaagacagcgagcaagacaacggcggcggctcctcgtcgccgacgacctttgccggcgcatcgcagtcgcagggggtcctgccggagccggaccagcccaccagcatgatggacgcgtcgtacgtagtcgaccagccgggctctaccgccggaatattcgctgcaccgccgcatcatcatcaggagaacctgatgagcctcggtattggtggcctggacgcgttgctgatgaacggagcgatgtggcagtacacctcgtcgtcggttttcgatcacttcccgcagcaggaagtgaccagctcgccgacgatgatggggctaggcagctccaggggaggaggaggagacggcggctgcagcagcagcttcttctacgacagcggcttcgaggacatggccaacattgggggcatggggttcccacagggatggactggctga

SEQ ID NO: 17797 - protein, 282 aa, Sorghum bicolor
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: Ceres ANNOT ID no. 8682088
  misc_feature (10)..(117): Pfam ID: NAM Pfam Description: No apical meristem (NAM) protein
MGLREIESTLPPGFRFYPSDEELVCHYLYKKVANEHAAKLTASEWYFFSFRDRKYATGSRTNRATKTGYWKATGKDREVRSPATRGVVGMRKTLVFYQGRAPNGVKSCWVMHEFRLDSPHTPPKEDWVLCRVFQKRKDSEQDNGGGSSSPTTFAGASQSQGVLPEPDQPTSMMDASYVVDQPGSTAGIFAAPPHHHQENLMSLGIGGLDALLMNGAMWQYTSSSVFDHFPQQEVTSSPTMMGLGSSRGGGGDGGCSSSFFYDSGFEDMANIGGMGFPQGWTG

SEQ ID NO: 17798 - DNA, 1494 bp, Sorghum bicolor
  misc_feature: Ceres ANNOT ID no. 8682098
  misc_feature: Encodes the peptide sequence at SEQ ID NO 17799
atggcgctcacgtccatgctcccgttcgcgccctcgaacacctcgctatcctactcctcccgcgcctcaaccgccgccgcgttcgctcctcgtggggcccacttcgccgcgtacggaaggagcggcggcggtggcgcccaatcactggcgtgcgccgcgcctcgccgctgcggacgggctccgcggcggcgccgcggagggggcctggtggtctgggcgtcggccgactactacgcgacgctgggcgtgccacgcgccgcgagtaacaaggacatcaaggccgcgtaccggaagctcgcgcgccagtaccatcctgatgtcaataaggagcctggagcaaccgaaaagtttaaagagataagtgcagcgtatgaggtgctgtcagatgaaaagaagagggcgttgtatgaccaatatggtgaagctggggttaagagtgcagttggaggccccggtggagcttacacaactaatccatttgatctgtttgagacattctttggagcaagcatgggtggcttttctggcatggaccagagctcgtttaggacaagcaggcgaaacactgctgttcagggtgaagacatcagatatgatgtgattctggggttcacagaggcgatatttggaacagagaaagatattatattatctcatttggaaacatgcgatacatgtggtggttctggatcaaaggctggttccaagatgagaatatgttccacatgtggtgggcgagggcaagtaatgcgaactgaacaaacaccatttggtctgttctctcaggtttctatttgccccacttgcgcaggagagggcgaagtcatttcagagtattgcaggaaatgttccggagagggtcgtatccgtgtcagaaaggagatcaaagtaaaaatccctccaggagtgagcaaaggcagtactcttcgtgtacgtggggaaggtgatgcaggaccaaaaggtgggcctcctggagatctctttgtttgccttgatatagaggaaccatcagatatcaggagggatggtataaacttgtattcaactgtgtcaataagctatcttgaagctattttgggcaccgttaagggggtcagaactgttgatggaaccagtgaccttcgaatacctccaggtacccaacctggtgatgtaattgtcttagcgaagcaaggagttccatcattgaataagccatctatacgtggtgatcatttgttcactgttaaagttgcaatacccaagcgcataagtgggcgtgaaagggaattacttgaggaacttgcatctttgagtaatggtggctttgctcgaacagacgccaagccaaaacctgcccagccaaaacgcgtacatcaagagaaagaagtaggtgctagtcaagaagatacagacaaatctaaagaagcagagggtgactggttgaagaaacttacagattttgctgggtccattgttaatggtgctgcaaagtggctgaatgacaacctgtag

SEQ ID NO: 17799 - protein, 497 aa, Sorghum bicolor
  misc_feature: Useful for making plants with modulated heat sensitivity
  misc_feature: Functional homolog of the protein sequence given in SEQ ID NO 13683
  misc_feature: Ceres ANNOT ID no. 8682098
  misc_feature (307)..(429): Pfam ID: DnaJ_C Pfam Description: DnaJ C terminal region
  misc_feature (76)..(137): Pfam ID: DnaJ Pfam Description: DnaJ domain
  misc_feature (210)..(294): Pfam ID: DnaJ_CXXCXGXG Pfam Description: DnaJ central domain (4 repeats)
MALTSMLPFAPSNTSLSYSSRASTAAAFAPRGAHFAAYGRSGGGGAQSLACAAPRRCGRAPRRRRGGGLVVWASADYYATLGVPRAASNKDIKAAYRKLARQYHPDVNKEPGATEKFKEISAAYEVLSDEKKRALYDQYGEAGVKSAVGGPGGAYTTNPFDLFETFFGASMGGFSGMDQSSFRTSRRNTAVQGEDIRYDVILGFTEAIFGTEKDIILSHLETCDTCGGSGSKAGSKMRICSTCGGRGQVMRTEQTPFGLFSQVSICPTCAGEGEVISEYCRKCSGEGRIRVRKEIKVKIPPGVSKGSTLRVRGEGDAGPKGGPPGDLFVCLDIEEPSDIRRDGINLYSTVSISYLEAILGTVKGVRTVDGTSDLRIPPGTQPGDVIVLAKQGVPSLNKPSIRGDHLFTVKVAIPKRISGRERELLEELASLSNGGFARTDAKPKPAQPKRVHQEKEVGASQEDTDKSKEAEGDWLKKLTDFAGSIVNGAAKWLNDNL

SEQ ID NO: 17800 - DNA, 1014 bp, Sorghum bicolor
  misc_feature: Ceres ANNOT ID no. 8682105
  misc_feature: Encodes the peptide sequence at SEQ ID NO 17801
atggatgtgttgggcggtgtcaaattcagctcccacaaaaaacattttccaaatgaagagaagtttgaagactcaaagctacaacactatgcattattctcacataatgtactggaagctgctgtggttgtgagctcaactcttataaatgctaagaacccaacaaggcatgtatttcatactgtaacagacaaacataattgtgctgcaatgagaatgtggttcttggcaaatcccataggaaaaattgctattcaggtccaaaacatagaagagtttacttggctaaattcgaggtacagtccagttttgaagcaactggcgtcccatttcatgatgaacttctacttcaagatccatcaaaataggttgagccaaaacaagttccagaatcccaagtacttgtccattctcaaccatttgaggttttattttcctgagatcttcccagagcttaataaggtgttgtttcttgatgatgatactgtagtccagcaggatctaagtaatctttggtcaatggatctgaaaggtaaggttaatggcgctgtccatacctgtggagcgactttccataggtttgataggtacctcaacttctcaaatcccctaattgctaagcagtttgatcagcgtgcttgtggctgggcgtatggcatgaacatgttcgatttgtctgagtggaggaagcagaatattactgatgtctaccactactggcagaatatgaacgcaaataggcaactatggaagttacgaacgcttctagcatgtcttgtcacattttggagccgcacattccctcttgatcgctcgtggcaatgtggcatctctttgggtctagggtacaagccggatgtcgaccaaagagatatggagcgcgcggcggtcctacactacaatggaaatcaaaaaccttggcttgagattggaatactaagatatcgcaaattttggtccagatatgtcaatttcgaccatgcttttctacatgaatgcaatatacatccgtga

SEQ ID NO: 17801 - protein, 337 aa, Sorghum bicolor
  misc_feature: Useful for making plants with altered cell wall content and/or composition
  misc_feature: Functional homolog of the protein sequence given in SEQ ID NO 13899
  misc_feature: Useful for making plants with altered carbohydrate content
  misc_feature: Functional homolog of the protein sequence given in SEQ ID NO 13900
  misc_feature: Ceres ANNOT ID no. 8682105
  misc_feature (6)..(311): Pfam ID: Glyco_transf_8 Pfam Description: Glycosyl transferase family 8
MDVLGGVKFSSHKKHFPNEEKFEDSKLQHYALFSHNVLEAAVVVSSTLINAKNPTRHVFHTVTDKHNCAAMRMWFLANPIGKIAIQVQNIEEFTWLNSRYSPVLKQLASHFMMNFYFKIHQNRLSQNKFQNPKYLSILNHLRFYFPEIFPELNKVLFLDDDTVVQQDLSNLWSMDLKGKVNGAVHTCGATFHRFDRYLNFSNPLIAKQFDQRACGWAYGMNMFDLSEWRKQNITDVYHYWQNMNANRQLWKLRTLLACLVTFWSRTFPLDRSWQCGISLGLGYKPDVDQRDMERAAVLHYNGNQKPWLEIGILRYRKFWSRYVNFDHAFLHECNIHP

SEQ ID NO: 17802 - DNA, 756 bp, Sorghum bicolor
  misc_feature: Ceres ANNOT ID no. 8682135
  misc_feature: Encodes the peptide sequence at SEQ ID NO 17803
atggatcaccaccatcaccatcaccaccaccaccatcatcacatgatcccgggccaagagccgtcggcggcggacggcgcagccccggacagcttcttccttggtcccgccgcggccgtcatcttccccggaggcgccggggcctcgggagccggctcgtcgtcgtcgggcgccgcggccctcggatcctccgtggggggaggaggtgggccgtcgccgtccagctcctcgccgtcgctgagccggtacgagtcccagaagcgccgggactggaacacgttcgggcagtacctgcgcaaccaccggccgccgctgtcgctgtcgcggtgcagcggcgcgcacgtgctggagttcctcaagtacatggatcagttcggcaagaccaaggtgcacacgccggtgtgccccttctacgggcatcccaacccgcccgcgccgtgcccgtgcccgctccgccaggcctggggctccctcgacgcgctcatcggccgcctccgcgccgcctacgaggagaacggcggcacgcccgagatgaaccccttcggcgcgcgcgccgtgcggctctacctgcgcgaggtgcgcgagacgcaggcgcgggccagggggatcagctacgagaagaagaagcgcaagaagccgtcggcggcttcggccgcggcggcggggccgtcgtccgagggaagcccgccaccggggccgtccggcggcggaggaggacccgacacgtcggtgtcgccgcagttcatcatgccgtga

SEQ ID NO: 17803 - protein, 251 aa, Sorghum bicolor
  misc_feature: Useful for making plants with modulated low light sensitivity
  misc_feature: Functional homolog of the protein sequence given in SEQ ID NO 14143
  misc_feature: Useful for making plants with modulated nitrogen use efficiency
  misc_feature: Functional homolog of the protein sequence given in SEQ ID NO 13437
  misc_feature: Useful for making plants with modulated flowering time
  misc_feature: Functional homolog of the protein sequence given in SEQ ID NO 13982
  misc_feature: Useful for making plants with modulated biomass
  misc_feature: Functional homolog of the protein sequence given in SEQ ID NO 13338
  misc_feature: Useful for biocontainment applications
  misc_feature: Functional homolog of the protein sequence given in SEQ ID NO 13983
  misc_feature: Ceres ANNOT ID no. 8682135
MDHHHHHHHHHHHHMIPGQEPSAADGAAPDSFFLGPAAAVIFPGGAGASGAGSSSSGAAALGSSVGGGGGPSPSSSSPSLSRYESQKRRDWNTFGQYLRNHRPPLSLSRCSGAHVLEFLKYMDQFGKTKVHTPVCPFYGHPNPPAPCPCPLRQAWGSLDALIGRLRAAYEENGGTPEMNPFGARAVRLYLREVRETQARARGISYEKKKRKKPSAASAAAAGPSSEGSPPPGPSGGGGGPDTSVSPQFIMP

SEQ ID NO: 17804 - DNA, 912 bp, Sorghum bicolor
  misc_feature: Ceres ANNOT ID no. 8682140
  misc_feature: Encodes the peptide sequence at SEQ ID NO 17805
atggggctgagggacatcgagctgacgctgccgccggggttccggttctaccccagcgacgaggagctggtgtgccactacctgcacggcaaggtggccaacgagcggctcgccggcgccggtgcagccatggtggaggtggatctgcacacccacgagccgtgggaactccctgacgttgcgaagctgagcacgaacgagtggtacttcttcagcttccgcgaccgcaagtacgcgacggggctgcgcaccaaccgcgccaccaagtccggctactggaaggccaccggtaaggaccgcgtcatccacaaccccagggccggcggccaccaccaccaccgcgccatcgtcggcatgcgcaagaccctcgtcttctaccgcggccgcgcacccaacggcatcaagaccagctgggtgatgcatgaattccggatggagaatccccacaccccgcccaaggaggactgggttctgtgcagggttttctataagaagaaggccgacgccatggactacgccatggccgacagcgagcaggacgtcggcatgcatatgcctcgcggcggcgctgactcgagcagctattcgcctcctccgttccccgcgctcggcggcagccacttccaccaccatcatctgacaccgctgacagaccaccacggcggcggctgcctgaacaacgaattccccggcatggcggcgctgctgcagcacaacaacggcatgttcgaccctcacgtcgtccagcctcaccttcacgacagtgtcgtccttgctgggccgccggctgctgcagcggcggcggggtcaacaagggacggcggcgagcagtgtggcagcggggtgctcatggacctaggactcgacgagcactacacctacaacagctacaacagcctgctgcagatgtga

SEQ ID NO: 17805 - protein, 303 aa, Sorghum bicolor
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: Useful for making plants with altered terpenoid content
  misc_feature: Functional homolog of the protein sequence given in SEQ ID NO 13140
  misc_feature: Useful for making plants with modulated light quality sensitivity
  misc_feature: Functional homolog of the protein sequence given in SEQ ID NO 13618
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: Useful for making plants with altered lignin content
  misc_feature: Functional homolog of the protein sequence given in SEQ ID NO 12985
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 476 in the 10/666,642 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: Useful for making plants with altered cell wall content and/or composition
  misc_feature: Functional homolog of the protein sequence given in SEQ ID NO 14383
  misc_feature: The sequence is a functional homolog of SEQ ID NO 2416 in the 10/374,780 US patent application
  misc_feature: The sequence is a functional homolog of SEQ ID NO 914 in the 10/225,066 US patent application
  misc_feature: Useful for biocontainment applications
  misc_feature: Functional homolog of the protein sequence given in SEQ ID NO 13684
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Useful for making plants with modulated biomass
  misc_feature: Useful for making plants with altered carbohydrate content
  misc_feature: Functional homolog of the protein sequence given in SEQ ID NO 13622
  misc_feature: The sequence is a functional homolog of SEQ ID NO 1064 in the 10/225,066 US patent application
  misc_feature: The sequence is a functional homolog of SEQ ID NO 2838 in the 10/374,780 US patent application
  misc_feature: The sequence is a functional homolog of SEQ ID NO 682 in the 11/435,388 US patent application
  misc_feature: The sequence is a functional homolog of SEQ ID NO 2472 in the 10/374,780 US patent application
  misc_feature: The sequence is a functional homolog of SEQ ID NO 520 in the 11/435,388 US patent application
  misc_feature: The sequence is a functional homolog of SEQ ID NO 974 in the 10/225,066 US patent application
  misc_feature: The sequence is a functional homolog of SEQ ID NO 612 in the 11/435,388 US patent application
  misc_feature: The sequence is a functional homolog of SEQ ID NO 344 in the 10/666,642 US patent application
  misc_feature: The sequence is a functional homolog of SEQ ID NO 854 in the 11/435,388 US patent application
  misc_feature: Ceres ANNOT ID no. 8682140
  misc_feature (10)..(146): Pfam ID: NAM Pfam Description: No apical meristem (NAM) protein
MGLRDIELTLPPGFRFYPSDEELVCHYLHGKVANERLAGAGAAMVEVDLHTHEPWELPDVAKLSTNEWYFFSFRDRKYATGLRTNRATKSGYWKATGKDRVIHNPRAGGHHHHRAIVGMRKTLVFYRGRAPNGIKTSWVMHEFRMENPHTPPKEDWVLCRVFYKKKADAMDYAMADSEQDVGMHMPRGGADSSSYSPPPFPALGGSHFHHHHLTPLTDHHGGGCLNNEFPGMAALLQHNNGMFDPHVVQPHLHDSVVLAGPPAAAAAAGSTRDGGEQCGSGVLMDLGLDEHYTYNSYNSLLQM

SEQ ID NO: 17806 - DNA, 996 bp, Sorghum bicolor
  misc_feature: Ceres ANNOT ID no. 8682157
  misc_feature: Encodes the peptide sequence at SEQ ID NO 17807
atgtcgtccaactgcggtgaggagaaggagctggtctgcgtgaccggcgccggcggcttcatcggctcctgggtggtcaaggagttgctccagcgtggctaccgtgtcaggggaactgcgagggaccctgcggacagcaagaacgcccacctgctggctctggatggcgccaaggagcgcctcaccctgtgccgcgccgacgtcctcgaccgcgcctccctccacgccgccttcgccggctgcaacggcgtcttccacgtcgcctccccggtctccaacgacccggagctggtgccggtggcggtggagggcacccggaacgtcatcaacgccgcggcggacgaaggcgcgcgccgcgtcgtcttcacctcctcctacggcgccgtccacatggaccccaaccgtagccccgacgccgtcctcgacgagacatgctggagcgactacgacttctgcaagcgatcagacaacctgtactgctgcgccaagatgatggcggagatcacggcgacggaggaggcggcggcgcgggggctgcagctggccgtggtgcttccctgcatgaccatgggccccatgctgcagcagacgctcaacttcagcaccaaccacgtcgcgcgctacctcatgggcaccaagcgctccatccccaacgccgtcgccgcctacgtcgacgtccgcgacgtcgcgcgcgcgcacgtcctcgcctacgagcgccccagcgcgtgcggacgctacctctgcatcggcaccgtgctgcaccgcgaacagctcgtcgccatgctcaaggaactcttcccgcagtaccccgtcacagccaagtgcgaggacgacggcaagccgatggcgaagccgttcaagttctccaaccagaggctcagggacctgggcttggagttcactccgctcaggaagagcttgtacgagaccgtggtgtgcctgcagcagaagggtcacctgcctgtcatccaacaacagcagcgcgcgtacttgtaa

SEQ ID NO: 17807 - protein, 331 aa, Sorghum bicolor
  misc_feature: Useful for making plants with altered carbohydrate content
  misc_feature: Functional homolog of the protein sequence given in SEQ ID NO 13817
  misc_feature: Useful for making plants with altered cell wall content and/or composition
  misc_feature: Useful for making plants with altered lignin content
  misc_feature: Functional homolog of the protein sequence given in SEQ ID NO 13818
  misc_feature: Ceres ANNOT ID no. 8682157
  misc_feature (1)..(322): SWISSPROT Homolog: EC 1.1.1.219 Dihydrokaempferol 4-reductase
  misc_feature (12)..(250): Pfam ID: Epimerase Pfam Description: NAD dependent epimerase/dehydratase family
MSSNCGEEKELVCVTGAGGFIGSWVVKELLQRGYRVRGTARDPADSKNAHLLALDGAKERLTLCRADVLDRASLHAAFAGCNGVFHVASPVSNDPELVPVAVEGTRNVINAAADEGARRVVFTSSYGAVHMDPNRSPDAVLDETCWSDYDFCKRSDNLYCCAKMMAEITATEEAAARGLQLAVVLPCMTMGPMLQQTLNFSTNHVARYLMGTKRSIPNAVAAYVDVRDVARAHVLAYERPSACGRYLCIGTVLHREQLVAMLKELFPQYPVTAKCEDDGKPMAKPFKFSNQRLRDLGLEFTPLRKSLYETVVCLQQKGHLPVIQQQQRAYL

SEQ ID NO: 17808 - DNA, 1017 bp, Sorghum bicolor
  misc_feature: Ceres ANNOT ID no. 8682158
  misc_feature: Encodes the peptide sequence at SEQ ID NO 17809
atgtcgtcgtcctccgcctgcggtgatgaggaggaggaggagcagcagcagctggtctgcgtgaccggcgccggcggcttcatcggttcgtgggtggtcaaggagctgctccagcgcggctaccttgtcaggggaactgcaaggaaccctgagcacggcaagaacgcgcacctgctggctctggacggcgccaaggagcgtctcaccctgtgccgcgccgacgtcctcgacagcgcctccctccgcgccgccttcgtcggctgccacggcgtcttccacgtcgcctccccggtctccaacgacccggagctggttccggtggcggtggagggcacccggaacgtcatcaccgccgcggcggacgagggcgtgcgccgcgtcgtcttcacctcctcctacggcgccgtccacatggaccccaaccgcagccccgacgccgtcctcgacgagacctgctggagcgactacgacttctgcaagcgatcagacaacctgtactgctgcgccaagatgatggcggagatcacggcgacggaggtggcggcggcccgggggctgcagctggcagtggtggtgccgtgcataaccttggggccaatgctgcagcagacgctcaacgtcagcacccaccacatcttgcgctacgtcatgggcaccaagaggtccatccccaacgccgtcgccgcctacgtcgacatccgcgacgtcgcgcgcgcgcacgtcctcgcctacgagcgccccgccgcgcgcggccggtacctctgcatcggcaccgtgctgcaccgcgcacagctcgtcgccatgctcagggacctcttccccaagtaccccgtcacggccaagtgcgaagacgacggtaagccaatggtgaagccgtacaggttctccaaccagaggctcagagacctgggcttggaattcactccgctgagggagagcctgtacgagactgtggtgtgcttgcagcagaagggccacctgcctgtcatcaaacaaaaacaacgtgcgtgcttgtaa

SEQ ID NO: 17809 - protein, 338 aa, Sorghum bicolor
  misc_feature: Useful for making plants with altered carbohydrate content
  misc_feature: Functional homolog of the protein sequence given in SEQ ID NO 13817
  misc_feature: Useful for making plants with altered cell wall content and/or composition
  misc_feature: Useful for making plants with altered lignin content
  misc_feature: Functional homolog of the protein sequence given in SEQ ID NO 13818
  misc_feature: Ceres ANNOT ID no. 8682158
  misc_feature (19)..(329): SWISSPROT Homolog: EC 1.1.1.219 Dihydrokaempferol 4-reductase
  misc_feature (19)..(257): Pfam ID: Epimerase Pfam Description: NAD dependent epimerase/dehydratase family
MSSSSACGDEEEEEQQQLVCVTGAGGFIGSWVVKELLQRGYLVRGTARNPEHGKNAHLLALDGAKERLTLCRADVLDSASLRAAFVGCHGVFHVASPVSNDPELVPVAVEGTRNVITAAADEGVRRVVFTSSYGAVHMDPNRSPDAVLDETCWSDYDFCKRSDNLYCCAKMMAEITATEVAAARGLQLAVVVPCITLGPMLQQTLNVSTHHILRYVMGTKRSIPNAVAAYVDIRDVARAHVLAYERPAARGRYLCIGTVLHRAQLVAMLRDLFPKYPVTAKCEDDGKPMVKPYRFSNQRLRDLGLEFTPLRESLYETVVCLQQKGHLPVIKQKQRACL

SEQ ID NO: 17810 - DNA, 1743 bp, Sorghum bicolor
  misc_feature: Ceres ANNOT ID no. 8682179
  misc_feature: Encodes the peptide sequence at SEQ ID NO 17811
atgccgtcgcggcagcgccgacgcggcgacctcgccgtcgcggctgcgctgctggcgacggtggcgctggcggccggggccgacggcggcgcggagttcgattaccggaagctctcggggatcatcatcccggggttcgcgtccacgcagctgcgcgcgtggtcggtcctcgactgcccctactcgcccttcgacttcaacccccttgattccgtctggctcgacaccgccaagcttttctctgcagtgaattgctggcttaaatgcatgctgcttgaaccctataatcagacagaccatccggaatgcaagtcaaggcctgatagtggtctttctgcaattacagagttggaccctggttatattacagtatggaaagaatgggtcaaatggtgtgtagagtttggcattgaagctaatgcaattattgctgttccatatgattggagactgcccccatcaatgcttgaggagcgagatctgtattttcacaaattaaagttaacttttgaaattgctttgaaactccgaggagggccatctttggtatttgctcattcgatgggaaataatgtgtttcgctactttttggaatggttgaaactggaaattgctcccaagcactatatccagtggcttgatgaacatatacatgcatactttgcagttggcgctcctcttcttggatctactgaagcagttagaggtgctctttctggaacaacttttggtcttccagtcagtgagggcacagcacgattgatgtttaatgcatttggttcttctctatggcttatgccattctcaaaacactgcaaagctgataatatctactggaagcatttttttgagggaaaggcaggttgtcctcacagacaacaatgtgatgaagccgaatatatttcagactacgctggatggcccacagaccttgttaatattgaggttccttcagttcgagatggtactttgttcagaacaatagaggattatgaccctcagagcaaggcacttgtttatcagcttgagaagtattatcagggtgatccagttctgaaccctctaacaccctgggagagacccccaataaagaatgtattttgcatttacgggattgattcaaagactgaggtaggatattactttgcaccaagtggcaaaccatatccagacaactggataataactgatattatttatgagtttgaaggttccctactttcaaggcaggtatcctacaactccctctcatggtgcaagaattggcttggagcaaaagtgaacataacgagggctccacaggcagaacatgatggatctgatctgcaaacagccatgaatatcgatcaccatcatggccaggacatactaccaaacatgacgagggctccgcatgtgaagtacataacctactatgaagatgctgaaagtcttccgggatggagaacagcagtttgggagcttgataaagcaaatcacaggaatattgttaggacgcctgtactaatgcgtgagttatggcttgaaatgtggcacgacatgcatcctgattcaaaatcaaagttcgtgacgaaagctttccgaggtccgctaaggaacgacgactgccactgggactatggaaaggctcgatgtggctttccagaacactgtgaatacaggtatgtatttggcgatgtccatttgggaatgagctgcagactgaaaaatacatctgccaaccttcttcaacagtatctctga

SEQ ID NO: 17811 - protein, 580 aa, Sorghum bicolor
  misc_feature: The sequence is a functional homolog of SEQ ID NO 5 in US patent 7157619
  misc_feature: Ceres ANNOT ID no. 8682179
  misc_feature (41)..(392): SWISSPROT Homolog: EC 2.3.1.158 Phospholipid:diacylglycerol acyltransferase
  misc_feature (69)..(450): Pfam ID: LACT Pfam Description: Lecithin:cholesterol acyltransferase
MPSRQRRRGDLAVAAALLATVALAAGADGGAEFDYRKLSGIIIPGFASTQLRAWSVLDCPYSPFDFNPLDSVWLDTAKLFSAVNCWLKCMLLEPYNQTDHPECKSRPDSGLSAITELDPGYITVWKEWVKWCVEFGIEANAIIAVPYDWRLPPSMLEERDLYFHKLKLTFEIALKLRGGPSLVFAHSMGNNVFRYFLEWLKLEIAPKHYIQWLDEHIHAYFAVGAPLLGSTEAVRGALSGTTFGLPVSEGTARLMFNAFGSSLWLMPFSKHCKADNIYWKHFFEGKAGCPHRQQCDEAEYISDYAGWPTDLVNIEVPSVRDGTLFRTIEDYDPQSKALVYQLEKYYQGDPVLNPLTPWERPPIKNVFCIYGIDSKTEVGYYFAPSGKPYPDNWIITDIIYEFEGSLLSRQVSYNSLSWCKNWLGAKVNITRAPQAEHDGSDLQTAMNIDHHHGQDILPNMTRAPHVKYITYYEDAESLPGWRTAVWELDKANHRNIVRTPVLMRELWLEMWHDMHPDSKSKFVTKAFRGPLRNDDCHWDYGKARCGFPEHCEYRYVFGDVHLGMSCRLKNTSANLLQQYL

SEQ ID NO: 17812 - DNA, 447 bp, Sorghum bicolor
  misc_feature: Ceres ANNOT ID no. 8682184
  misc_feature: Encodes the peptide sequence at SEQ ID NO 17813
atggtttgctgcttgtgctgtgtagtttatcgttccggacgtggaggtactgctggtaacaagttccggatgtcactgggtctaccggtggcagctactgtgaactgtgctgataacactggagccaagaacctgtacatcatttctgtgaaaggaatcaaggggcgccttaacaggcttccttctgcctgtgttggtgacatggttatggcaactgtgaagaagggaaagcctgaccttaggaagaaggtgatgccagctgtcattgtgaggcagcgcaagccatggcgccgaaaggatggtgtctacatgtactttgaagacaatgctggagtgattgtgaacccaaagggagagatgaaaggttctgccatcactggacccatcggaaaggagtgtgctgatctctggcccaggattgctagcgcggcaaatgcgatcgtgtaa

SEQ ID NO: 17813 - protein, 148 aa, Sorghum bicolor
  misc_feature: Useful for making plants with modulated biomass
  misc_feature: Useful for making plants with modulated heat sensitivity
  misc_feature: Functional homolog of the protein sequence given in SEQ ID NO 14580
  misc_feature: Ceres ANNOT ID no. 8682184
  misc_feature (27)..(148): Pfam ID: Ribosomal_L14 Pfam Description: Ribosomal protein L14p/L23e
MVCCLCCVVYRSGRGGTAGNKFRMSLGLPVAATVNCADNTGAKNLYIISVKGIKGRLNRLPSACVGDMVMATVKKGKPDLRKKVMPAVIVRQRKPWRRKDGVYMYFEDNAGVIVNPKGEMKGSAITGPIGKECADLWPRIASAANAIV

SEQ ID NO: 17814 - DNA, 1146 bp, Sorghum bicolor
  misc_feature: Ceres ANNOT ID no. 8682193
  misc_feature: Encodes the peptide sequence at SEQ ID NO 17815
atggcttcctccacccagggtcaggtcatcacctgcaaagcggcggtagcgtacgagccgaacaagccgctcgtgatcgaggacgtgcaggtggcgccgccgcaggccggcgaggtccgcgtcaagatcctcttcaccgcgctctgccacaccgaccactacacctggagcggcaaggatcctgagggtctgtttccttgcattcttggccacgaagctgccggagttgtggaaagtgtcggcgaaggagtaactgaggtgcagcctggggatcatgtcattccttgttaccaagcagaatgcaaagaatgcaagttttgcaagagcggaaagaccaacctctgtggtaaggttcgtagtgccacaggcgtaggtgtcatgatgaatgatatgaagagcaggttctctgtaaatggaaagcccatttaccatttcatggggacatcaacattcagccagtacactgtggtgcatgatgtcagtgttgcaaagatcaacccacaggcccccctagataaagtctgcctgcttggttgtggtgttcctactggtcttggagcagtgtggaatactgcaaaggttgaagctggctctattgttgctgtttttggccttggcacagttggacttgcagttgctgagggtgcaaaagctgctggtgcttctcgaatcattggcattgacattgacaataaaaagtttgacgttgcaaagaactttggagttacagaatttgttaacccaaaagatcatgacaaaccaatacagcaggtcttagttgatcttacagatggtggcgtggattacagttttgaatgcattggaaatgtttcagttatgcgggctgcactggaatgctgccacaagggctggggaacctctgtcatcgttggcgtcgctgcttctggccaggagattgccacacggccattccagctcgtgactggtcgtgtctggaagggaacagctttcggtggcttcaagagccgaacccaggtcccatggcttgttgataagtacatgaacaaggaaattaaggtggacgagtacattacccacaacatgaacctggctgacatcaacgacgcgttccacctgctccacgaaggtggctgcctgcgctgcgtgctggcaatgcaaatttga

SEQ ID NO: 17815 - protein, 381 aa, Sorghum bicolor
  misc_feature: Useful for making plants with modulated heat sensitivity
  misc_feature: Functional homolog of the protein sequence given in SEQ ID NO 14109
  misc_feature: Ceres ANNOT ID no. 8682193
  misc_feature (4)..(380): SWISSPROT Homolog: EC 1.1.1.1 Alcohol dehydrogenase
  misc_feature (36)..(165): Pfam ID: ADH_N Pfam Description: Alcohol dehydrogenase GroES-like domain
  misc_feature (196)..(338): Pfam ID: ADH_zinc_N Pfam Description: Zinc-binding dehydrogenase
MASSTQGQVITCKAAVAYEPNKPLVIEDVQVAPPQAGEVRVKILFTALCHTDHYTWSGKDPEGLFPCILGHEAAGVVESVGEGVTEVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVEAGSIVAVFGLGTVGLAVAEGAKAAGASRIIGIDIDNKKFDVAKNFGVTEFVNPKDHDKPIQQVLVDLTDGGVDYSFECIGNVSVMRAALECCHKGWGTSVIVGVAASGQEIATRPFQLVTGRVWKGTAFGGFKSRTQVPWLVDKYMNKEIKVDEYITHNMNLADINDAFHLLHEGGCLRCVLAMQI

SEQ ID NO: 17816 - DNA, 1881 bp, Sorghum bicolor
  misc_feature: Ceres ANNOT ID no. 8682236
  misc_feature: Encodes the peptide sequence at SEQ ID NO 17817
atgcccgccgccgccagcgccatcggactctcgaccgcgggcgctgtcccgttccgcctccccgcctccggctgcgcccaccagggccacctccgcctccttcctcctcctcctcctgctgccgccgcctgccgccgccgcttgcttctccgctgcgccgcctcgtctggcggtggcggtggaggtggtgccggaggcagcggcggctccgacccggccctcgaagagcagcggcgccgccaggccgagctcgccgcgcgcattgcgtccggcgagttcaccgtgcaaggccccgggtggattgcgcctctcgttgggaagctctccaagttgggcccgccgggggagctcgccgccgcgctgctcaccagggtggcgggcgctggcgcggcgcgtggcggcccagagatcccacaggcactcgggtcgatcaacgccgtcgtgggtcaggccttcttcgtgcccctgtacgacctcttcctcacctacggcggcatctttcgcctcaactttggccctaagtcgtttcttattgtctccgatcctgctatcgctaagcacatcctgagggacaactccaaagcttattccaagggaatacttgcagagatattggagtttgtgatgggtaagggtttgatccctgctgacggggagatttggcgtgttcggaggcgtgctattgttcccgcgttgcatcagaagtatgtgactgcgatgattggtctctttggagaagcttcacatcgtctctgcgagaaattggacaaggcagcagcggatggggaggacgtggagatggagtcgttgttctctcgactcacattggatgtcatagggaaggcagtcttcaattatgattttgactcattatcttacgataacggaatagtcgaggcagtgtatgtaacactaagggaagcagagatgcgtagcacttctcctataccaacctgggaaataccaatatggaaggacatttccccacggcagaagaaggtcaacgaagctctcaagttgataaatagtactctagatgaactaattgccatatgcaagagaatggtagagcaagaagatcttcagtttcatgaggaatacatgaacgagcaagatcctagtattcttcacttccttttggcatctggagatgatgtatccagcaagcaactccgtgatgatttgatgaccatgctcatagctggtcatgagacttctgcggcagtcttgacatggacgttttatcttctatctaaggttgatagtgttctaggtgatggtttgccaacaattgaggatgtgaaaaaactgaagtacacgactcgggttattaatgaatcattgagactatatccacagccgccggttttaattcgtaggtcacttgaggatgatatgctcggagggtacccaattggccgaggagaagatatttttatttctgtctggaatcttcaccactgcccaaagcactgggatgatgcagaagttttcaacccagaaagatggcctttggatggaccaaatccgaacgagataaaccaaaatttcagttacttaccatttggtggcggaccaaggaaatgtgtaggtgacatgtttgccacttttgagaatgtggtggcaacagcaatgcttgtcaaacgatttgactttcagttggctccaggagcacctccggttgacatgacaactggagcaacgattcacacgactgagggattaaaaatgactgttactcgaaggacaagggcaccagtaattccaaacctggagatgaaaattatttctgattcacaagaacccgcactttctaccccatccatggttgttagtgctgcttctgttgcttcaggagaagatcaagggggcgtctcctga

SEQ ID NO: 17817 - protein, 626 aa, Sorghum bicolor
  misc_feature: Useful for making plants with altered cell wall content and/or composition
  misc_feature: Functional homolog of the protein sequence given in SEQ ID NO 14164
  misc_feature: Ceres ANNOT ID no. 8682236
  misc_feature (171)..(564): SWISSPROT Homolog: EC 1.14.15.3 Alkane 1-monooxygenase
  misc_feature (135)..(579): Pfam ID: p450 Pfam Description: Cytochrome P450
MPAAASAIGLSTAGAVPFRLPASGCAHQGHLRLLPPPPPAAAACRRRLLLRCAASSGGGGGGGAGGSGGSDPALEEQRRRQAELAARIASGEFTVQGPGWIAPLVGKLSKLGPPGELAAALLTRVAGAGAARGGPEIPQALGSINAVVGQAFFVPLYDLFLTYGGIFRLNFGPKSFLIVSDPAIAKHILRDNSKAYSKGILAEILEFVMGKGLIPADGEIWRVRRRAIVPALHQKYVTAMIGLFGEASHRLCEKLDKAAADGEDVEMESLFSRLTLDVIGKAVFNYDFDSLSYDNGIVEAVYVTLREAEMRSTSPIPTWEIPIWKDISPRQKKVNEALKLINSTLDELIAICKRMVEQEDLQFHEEYMNEQDPSILHFLLASGDDVSSKQLRDDLMTMLIAGHETSAAVLTWTFYLLSKVDSVLGDGLPTIEDVKKLKYTTRVINESLRLYPQPPVLIRRSLEDDMLGGYPIGRGEDIFISVWNLHHCPKHWDDAEVFNPERWPLDGPNPNEINQNFSYLPFGGGPRKCVGDMFATFENVVATAMLVKRFDFQLAPGAPPVDMTTGATIHTTEGLKMTVTRRTRAPVIPNLEMKIISDSQEPALSTPSMVVSAASVASGEDQGGVS

SEQ ID NO: 17818 - DNA, 834 bp, Sorghum bicolor
  misc_feature: Ceres ANNOT ID no. 8682232
  misc_feature: Encodes the peptide sequence at SEQ ID NO 17819
atgagaggaggaggagcggggcccacggcggcgttcatctccggcgacccgcctccagccgccgcggaggaggtggaggagaactccggtggcgagggggacgaggaggtggtggtggtggggcaggacgacgacgacctggagctggggctctgtctcggttccaagaagcagcagccgtcgccggcgccgtgccggatcctcacggcccgggaccttcagccggggtccctgtcgccggattcctccgtgtcctcttcctctcccgcggcaggtgcaggtgccgcagcgcccagcaagagggccaaggcggatgctgcccccaacgccaccacctcgccggggacggccgttcctggccatccacagagctatggagtagtgggatggccacccataagaactttcaggatgaacagcctatttaaccaggccaaagaaaatgcctctgaggctggcaccaagaagcccaccgttgaatctgacatgcaggaagacaaggaggagagcaagaaaggacgggtcgtcggttgggtgaaggtgaacatggaaggagatatcattggaaggaaggtggatctcaacgcccatcgatcttacaagacccttgcctcagcacttgagctcatgttcatgaagccgtccatcagtctttgcacttctagtagttctaagtctctaaagctattggacaactcatcggagtatcagctcacctatgaggacagggatggggactggatgctagttggagatgtaccctgggagatgtttgtaggttcagtgaagaggctcaagatcatgaggacctcagatgccaacggtctcggttag

SEQ ID NO: 17819 - protein, 277 aa, Sorghum bicolor
  misc_feature: The sequence is a functional homolog of SEQ ID NO 1149 in the 10/412,699 US patent application
  misc_feature: The sequence is a functional homolog of SEQ ID NO 742 in the 10/374,780 US patent application
  misc_feature: The sequence is a functional homolog of SEQ ID NO 1780 in the 10/412,699 US patent application
  misc_feature: The sequence is a functional homolog of SEQ ID NO 2008 in the 10/374,780 US patent application
  misc_feature: The sequence is a functional homolog of SEQ ID NO 678 in the 11/479,226 US patent application
  misc_feature: Ceres ANNOT ID no. 8682232
  misc_feature (40)..(277): Pfam ID: AUX_IAA Pfam Description: AUX/IAA family
MRGGGAGPTAAFISGDPPPAAAEEVEENSGGEGDEEVVVVGQDDDDLELGLCLGSKKQQPSPAPCRILTARDLQPGSLSPDSSVSSSSPAAGAGAAAPSKRAKADAAPNATTSPGTAVPGHPQSYGVVGWPPIRTFRMNSLFNQAKENASEAGTKKPTVESDMQEDKEESKKGRVVGWVKVNMEGDIIGRKVDLNAHRSYKTLASALELMFMKPSISLCTSSSSKSLKLLDNSSEYQLTYEDRDGDWMLVGDVPWEMFVGSVKRLKIMRTSDANGLG

SEQ ID NO: 17820 - DNA, 2223 bp, Sorghum bicolor
  misc_feature: Ceres ANNOT ID no. 8682252
  misc_feature: Encodes the peptide sequence at SEQ ID NO 17821
atgaatggcctgcgatctggatccacttcacccagtctggtcagggtccaaagtcttggttcttcaatgtctcatacctttgcttctgcagtaggttcatctatctcaagaagcaccacccctgacccccagctcatacggagaactccaagtccctgccttcctcctgttggagttcggatggggagttctgataaaaaagttgaagctgcagctgttgcttcacttaatcatgatggtgctgacattgcggcaactctgtctagcttaagcctatctggaaataagatgtcgaatgtggaaaatgaagttcagaatcatgtttaccagaactttggtgaccaggcagatgtgctgtttaatgtaccaaaggatcataggcaattttcacaacaaaatttaactcaaaataccaatgaagactcgcttaatgcccctgaatatgcagttttcccaaatggggggagtaacttcagtaatttgcatgctagtaagctggcatctcatagaaatagcaagttccctatgcagtcaccacatggtaatgcgaacaagaaaggatctttgatgagctcagctggttcagtttctcactaccagaacttgaatggtgatagccatggcattgatgtatctggacggcatatgaagactcatgcaggcggttttacttcatccatgctgaatcctgatggtgactatggcaatgttctttcgaaccatgggggatcgagttatcagggccaaccaacagagacaatgtacgcacaatacttgcaggcaaaccctgattccccccttggttcagctgcaagcatgagtcctttccaagggaggggttttactggttcaggacacttggatagtcctggatatcaaaaagcttaccttgggtcattatttgcccagcaaaagctacagtatgggataccatacctgggcaagtctggtgctcttaatcaaaatatatatggcaacgatcctgcatttggcattggaatgacttatctaacaagcccaccatctagtccgtatatctcatctcctcaaggccatgtcaggcaaggagatcgactgactcgacttccagccgtggtgaggaacactgctggaggatccatgggatcatggagttcagagaatggtctgatggataatggggggtcctccctgctggaggaattcaaaactaacaaaaccagatcttttgagctgttagatattgtaggccatgtggtagagttcagttcggatcagtatgggagtcgctttatacagcagaaactagaaactgcttctattgaagagaagaatatgatttttcctgagatccttccccaggcacgtaccttgatgactgatgttttcggaaactatgttatacagaagttctttgaatatggaactgaaacacaaacgaagcaactggcaaccctgctcaagggttatgtgttacagctgagtcttcaaatgtatggctgcagggtgattcagaaggctttggaagttgttgaagtggaacaacaaacacaaatggctttggagcttgatggatctatcatgagatgtgttcgtgatcagaatggcaaccatgtcatccaaaaatgtattgaatgcatccctcaggagaggatacgatttatcatttctgccttttacggacatgtggtggagctttccatgcatccctatggttgccgtgttattcagagggtattggaacattgtgatgatgaaagcacacaaaatgccatgatggaagagatcatgcagtctgtggttactttaacagaggaccagtatggtaattatgtaatccagcatgtcctgcagcatgggaaaccagaagagcgttctactataatcacacaactagctggacagatagtgaagatgagccaacagaaatttgcttctaatgttgttgagaagtgtcttacttttggtaatcctgagcaacgccagattctgatcaatgaaatgcttggcacaactgatgagaatgagccgttgcaggcaatgatgaaagaccagtttgcaaactatgtggtgcagaaggttctagagatatgtgatgaccagaaccgtgaattgattctttcccgtatcaaggtccacttgaatgcactgaaaagatacacctacgggaagcatattgtggcacgtgttgagaagcttattgccgcaggagaacggcgcattggcgccccatcctcctgctga

SEQ ID NO: 17821 - protein, 740 aa, Sorghum bicolor
  misc_feature: The sequence is a functional homolog of SEQ ID NO 1232 in the 10/666,642 US patent application
  misc_feature: Ceres ANNOT ID no. 8682252
  misc_feature (48)..(406): Pfam ID: NABP Pfam Description: Nucleic acid binding protein NABP
  misc_feature (443)..(477): Pfam ID: PUF Pfam Description: Pumilio-family RNA binding repeat
  misc_feature (407)..(441): Pfam ID: PUF Pfam Description: Pumilio-family RNA binding repeat
  misc_feature (479)..(514): Pfam ID: PUF Pfam Description: Pumilio-family RNA binding repeat
  misc_feature (588)..(622): Pfam ID: PUF Pfam Description: Pumilio-family RNA binding repeat
  misc_feature (551)..(585): Pfam ID: PUF Pfam Description: Pumilio-family RNA binding repeat
  misc_feature (515)..(549): Pfam ID: PUF Pfam Description: Pumilio-family RNA binding repeat
  misc_feature (624)..(658): Pfam ID: PUF Pfam Description: Pumilio-family RNA binding repeat
  misc_feature (666)..(700): Pfam ID: PUF Pfam Description: Pumilio-family RNA binding repeat
MNGLRSGSTSPSLVRVQSLGSSMSHTFASAVGSSISRSTTPDPQLIRRTPSPCLPPVGVRMGSSDKKVEAAAVASLNHDGADIAATLSSLSLSGNKMSNVENEVQNHVYQNFGDQADVLFNVPKDHRQFSQQNLTQNTNEDSLNAPEYAVFPNGGSNFSNLHASKLASHRNSKFPMQSPHGNANKKGSLMSSAGSVSHYQNLNGDSHGIDVSGRHMKTHAGGFTSSMLNPDGDYGNVLSNHGGSSYQGQPTETMYAQYLQANPDSPLGSAASMSPFQGRGFTGSGHLDSPGYQKAYLGSLFAQQKLQYGIPYLGKSGALNQNIYGNDPAFGIGMTYLTSPPSSPYISSPQGHVRQGDRLTRLPAVVRNTAGGSMGSWSSENGLMDNGGSSLLEEFKTNKTRSFELLDIVGHVVEFSSDQYGSRFIQQKLETASIEEKNMIFPEILPQARTLMTDVFGNYVIQKFFEYGTETQTKQLATLLKGYVLQLSLQMYGCRVIQKALEVVEVEQQTQMALELDGSIMRCVRDQNGNHVIQKCIECIPQERIRFIISAFYGHVVELSMHPYGCRVIQRVLEHCDDESTQNAMMEEIMQSVVTLTEDQYGNYVIQHVLQHGKPEERSTIITQLAGQIVKMSQQKFASNVVEKCLTFGNPEQRQILINEMLGTTDENEPLQAMMKDQFANYVVQKVLEICDDQNRELILSRIKVHLNALKRYTYGKHIVARVEKLIAAGERRIGAPSSC

SEQ ID NO: 17822 - DNA, 873 bp, Sorghum bicolor
  misc_feature: Ceres ANNOT ID no. 8682305
  misc_feature: Encodes the peptide sequence at SEQ ID NO 17823
atggagggtaaggaggaggatgttcggcttggcgccaaccgttactcggagcgtcagcccatcggcacggcggcgcagggcacggaggagaattcgaaggactacaaggaacccccggcggcgcctctgtttgaggctgaggagctgacgtcgtggtccttgtaccgcgccgggatcgccgagttcgtggccaccttcctcttcctctacatcagcatcctgacggtgatgggggtgagcaagtcgggcagcaagtgcggcaccgtgggcatccagggcatcgcctggtccttcggcggcatgatcttcgcgctggtgtactgcacggcgggcatctccggcggccacatcaacccggccgtcaccttcgggctcttgctggcgcggaagctgtcgctcacccgggcgctcttgtacatggtgatgcagtgcctgggcgccatctgcggcgccggcgtcgtcaagggcttccagcagacgctgtacatgggcgccggcggaggcgccaactccgtcaaccccgggtacaccaagggcgacggcctgggcgccgagatcgtcggcacgttcgtgctcgtctacaccgtcttctccgccaccgacgccaagcgaagcgcgcgtgactcgcatgtccccatcctcgcgccgctccccatcggtttcgccgtcttcctcgtccacctcgcaaccatccccatcaccggcacaggcatcaacccagcacgcagcctcggcgccgccatcgtctacaacaggtccaacgcatggaacgaccactggatcttctgggttggccccttcatcggcgccgctctcgccgccatctaccacgtggtcattatcagggccatccccttcaagagccgcgactaa

SEQ ID NO: 17823 - protein, 290 aa, Sorghum bicolor
  misc_feature: Useful for making plants with modulated water use efficiency
  misc_feature: Functional homolog of the protein sequence given in SEQ ID NO 14289
  misc_feature: Useful for making plants with modulated drought sensitivity
  misc_feature: Functional homolog of the protein sequence given in SEQ ID NO 14287
  misc_feature: Useful for making plants with modulated cold sensitivity
  misc_feature: Functional homolog of the protein sequence given in SEQ ID NO 14288
  misc_feature: Ceres ANNOT ID no. 8682305
  misc_feature (48)..(277): Pfam ID: MIP Pfam Description: Major intrinsic protein
MEGKEEDVRLGANRYSERQPIGTAAQGTEENSKDYKEPPAAPLFEAEELTSWSLYRAGIAEFVATFLFLYISILTVMGVSKSGSKCGTVGIQGIAWSFGGMIFALVYCTAGISGGHINPAVTFGLLLARKLSLTRALLYMVMQCLGAICGAGVVKGFQQTLYMGAGGGANSVNPGYTKGDGLGAEIVGTFVLVYTVFSATDAKRSARDSHVPILAPLPIGFAVFLVHLATIPITGTGINPARSLGAAIVYNRSNAWNDHWIFWVGPFIGAALAAIYHVVIIRAIPFKSRD

SEQ ID NO: 17824 - DNA, 417 bp, Sorghum bicolor
  misc_feature: Ceres ANNOT ID no. 8682323
  misc_feature: Encodes the peptide sequence at SEQ ID NO 17825
atggacaggaagctgtctatgatcaaggcgtgggaggagagcgagaagagcaaagcccaaaacaaggccgagaagaagatgctgtcggccatcatggcgtgggagaagacgaagaaggcggcagtggaagcgaagctgcgaacccgagagaggtctgagaagctggagaagaagaaggcggagtacgcagagaagatgaggaaccaagcggcaggcatccacaaggccgcggaagagaagcgcgcgtcggtggaggcgacgcgacgcgaggccatcctcaagtacgaggacatggcggtctacatccatccatacatacatactcctactactacatatattgctttcgtccctcaaaaatctttggctattgctttcttgtgtgctctgctgggtagtatggtgtattatatgtaa

SEQ ID NO: 17825 - protein, 138 aa, Sorghum bicolor
  misc_feature: The sequence is a functional homolog of SEQ ID NO 496 in the 11/435,388 US patent application
  misc_feature: The sequence is a functional homolog of SEQ ID NO 1773 in the 11/479,226 US patent application
  misc_feature: The sequence is a functional homolog of SEQ ID NO 20 in the 10/286,264 US patent application
  misc_feature: The sequence is a functional homolog of SEQ ID NO 876 in the 10/412,699 US patent application
  misc_feature: The sequence is a functional homolog of SEQ ID NO 1492 in the 11/479,226 US patent application
  misc_feature: The sequence is a functional homolog of SEQ ID NO 644 in the 11/435,388 US patent application
  misc_feature: The sequence is a functional homolog of SEQ ID NO 716 in the 10/412,699 US patent application
  misc_feature: Ceres ANNOT ID no. 8682323
  misc_feature (1)..(113): Pfam ID: Remorin_C Pfam Description: Remorin, C-terminal region
MDRKLSMIKAWEESEKSKAQNKAEKKMLSAIMAWEKTKKAAVEAKLRTRERSEKLEKKKAEYAEKMRNQAAGIHKAAEEKRASVEATRREAILKYEDMAVYIHPYIHTPTTTYIAFVPQKSLAIAFLCALLGSMVYYM

SEQ ID NO: 17826 - DNA, 567 bp, Sorghum bicolor
  misc_feature: Ceres ANNOT ID no. 8682320
  misc_feature: Encodes the peptide sequence at SEQ ID NO 17827
atgagggttctgattatagctttcctgtctgcgcaggacgttgctgccagaataatggccttctcacaacaaggcccaagggcagtgtgcatcatttcagcaactggagctgtttcaacagcaacccttcaccaggattcagactctgggggtgtggttacatacgagggtcgatttgagatcttgtgcctttctgggtcgtacttggtgctagatgatggtggcacacggacccgaagtggagggctttgcatagctttgtgtggtcctgaccacagggttattggtgggagtgtaggtggagtcctgacagcagctggaacagttcaggtgatagtggggagcttcatgtacggaggttcgaagaagaacaaggcgaaagctgaggcggacatcgagcccgaggaggcgaacgccggtgacgaagaggtggcccctgcgatggcactcgcggaccacagcagcatggcccctcctcctgagatgagcggcgggtgggcatcgggcatgatgaggcagatagactcgagaactcccaacatcgatatcaactcgatccgcgagtag

SEQ ID NO: 17827 - protein, 188 aa, Sorghum bicolor
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
  misc_feature: The sequence is a functional homolog of SEQ ID NO 1446 in the 10/666,642 US patent application
  misc_feature: The sequence is a functional homolog of SEQ ID NO 2606 in the 10/374,780 US patent application
  misc_feature: The sequence is a functional homolog of SEQ ID NO 296 in the 10/225,066 US patent application
  misc_feature: The sequence is a functional homolog of SEQ ID NO 74 in the 11/375,241 US patent application
  misc_feature: The sequence is a functional homolog of SEQ ID NO 878 in the 10/412,699 US patent application
  misc_feature: Ceres ANNOT ID no. 8682320
MRVLIIAFLSAQDVAARIMAFSQQGPRAVCIISATGAVSTATLHQDSDSGGVVTYEGRFEILCLSGSYLVLDDGGTRTRSGGLCIALCGPDHRVIGGSVGGVLTAAGTVQVIVGSFMYGGSKKNKAKAEADIEPEEANAGDEEVAPAMALADHSSMAPPPEMSGGWASGMMRQIDSRTPNIDINSIRE

SEQ ID NO: 17828 - DNA, 3414 bp, Sorghum bicolor
  misc_feature: Ceres ANNOT ID no. 8682361
  misc_feature: Encodes the peptide sequence at SEQ ID NO 17829
atggcggacgaggcggagtggatagaggctgaggtcgggaacgcgggcgcgggtcctccagcgcccggaggcggcgaggaaaccaagaggaagagggggaggcttaaaggtagcctcaacaagaacaagaagagcaacaaggataggacgcccaaggccaagaccgggaccaagcggaggcggaggcagcgcaccagcgaccgggacttgtcggtgcccgtggtgctcggggatctagggcgcggggtggcggccgggatcaggcagctcagggagaggaggccggcgcccaatgcgttcttcgaccgggacagcgacagctatactgagcatgatgatgatgaggaaactatgattaatcaagtcaaccacgagagtgctaaaacaggtgtttctgtaaagaagagaggaagaggaagacccagaaaaatggaagctgaccaactggatagtaagtcccagagttccaatggtaaaagcaatggccaaatgaattcgaatgctgctgggaagaaaaggggaaggggaagaccaaagaaactagcagtagaacaagtgtttagtaggtgccagttctccagtggtgaaacaaacaaaagtgatgctgaggcagcaaggagcaagcagtcaaggaatcataaacttctgcagaatgcaaagaagcggaaaagagatgtagggaaagagtctatgagaaaaaagttgaacaaagtggataaagaacaaaagcagttcccatccaccaaggatgaaaccctcgataaaaataatatgtggttcttcacaactattttttatgaatgcaaattctgttttaaaaatatccagaaagggagtaagatgttgactggggaaaatgccctcatgtgccaccagtgccagaggaaggacaaaccacgggttgtccagtgtcaatcatgcaaaaaaaagcgattctgtgtgccatgcatagaacaatggtatcctaatttgcatgaagatgaatttgctgtgaaatgcccatattgtcgcaagaactgtaattgcaaggcctgcctacggatgaagggagttgaagagcctccaaaaaaggagatctctaaagaaaatgaaattcgttatgcttgtcatatcgtaagcttgctgcttccctggatgagagaattgcgacaagaacagatggaggagaaggaagtagaggctaatatacgaggagtttcaatgaatgagataaaagtggaagaagctgaggttgacctagatgatcgtgtatattgtgacaggtgtagaacatctattgttgattttcatagaagctgcaagcattgtttctatgatctttgtcttaactgctgcaaggagcttcgcaaaggtgagatcgcaggaggagaagaggtggagtatgtgccacctgaacctaaaggtaggagttattcttttggcaagattcctctgtcaaaggatgctgatagaagtaagaactcctcaaatggtcagtcttacaacggcatgcctgctgttggcaaccccaataacggcctgttgctctggaaagcaaagagtgatggtagcataccttgtccaccaaaggaagtaggaggctgtggtagtacacttctggacctcaagtgcttgtttccagagaagacgcttgctgagatagaagatagagctgacaaagttctcaggagtgagacattagctaaagcaatggttagtagaagtgatcggtgcccttgctttgatcattcgggcaagataagaactgaaagcaaatcattacgggaggctgcaagcaggaaggactcaagtgataacttcctatactgtccagttgctactggtattcaagatgatgacatagtgcattttcagatgcattgggcaaaaggtgagcctgttgttgtttctgatgtccttcagttaacctctggtctgagttgggagccaatggtaatgtggcgggcattgcgggaaagatccaaaggcaaagcggaagatgagcaattagctgtttgggcgatagactgccttgattggtgtgaggtggaaattaacatacacaagttcttttcgggatatacaacaggcagaactcatgctaggactcactggcctcagatgcttaagctaaaagactggccttcttctagttcctttgacaagcgattgccgcgacatggtgccgaatttattagcgcattgccatttcgtgagtatacagatccacgatgtggcccactaaatcttgcagccaagcttcctgctggtgtcttgaagccagatcttggacccaaaagttacattgcttatgggctctacaaagagctaggcaggggtgattctgtgaccaagcttcactgtgacatatctgatgcggtaaatatcttaacacacacagctgaagtcacttgtcagactgatcaccgccaaattgaaaaaatccaaaaagacatgagagagcaagatctgcaggaactatatgggggtctaaaatcctgctctgagctgaagttgtcaccagctccaactgaatgcagggatgaatctgttgatgaaggattgaagacctcatatattagagaagacaattgtgtcaacagagacaactataatggtttggacatcaatgctttaccacctgatgacgatggagatgatgcaaaggataaagaatcatctcatgaatcagaatcacaaagtgaactaggtcagtgttcctatcacagcaacggggtcaacacaactgatggaatgcacagtggagctcattacatttcacacaatcaaaaaagcactgacagtatacaactcaagaaagttggcattaaacctcaaggagagaaatctgaaaaggttgattgcagtgagcaacagagcaccggtgccggtgctctgtgggatatcttccgcagacaggattctgataaattacaagattatcttaggaagcattgctctgaattccggcatatttactgcaatccagtgaaaaaggtatttcacccaattcatgatcagtctttctatttaactcaggagcataagagaaagctcaaggaagaatatggaattgaaccctggacgtttgaacagaagcttggtgaagctgttttcattcctgctggatgtcctcaccaagtgagaaatttgaagtcctgcatcaaagttgcgcttgattttgtttccccagaaaatgttggtgagtgtgttaagttgactggggagtttagacgacttccatctttccacaaagctaaagaagacaaactagagattaagaagatggctcttcatgccctgaacgaagctgtaaacttcttggatccttgttcctcagaagggttgaagattggggttggtgagaacagctgtggagatgaatctgcagatgagaagccgatgcctaaaaggcgaggcatcaaggagagctga

SEQ ID NO: 17829 - protein, 1137 aa, Sorghum bicolor
  misc_feature: The sequence is a functional homolog of SEQ ID NO 956 in the 10/666,642 US patent application
  misc_feature: The sequence is a functional homolog of SEQ ID NO 959 in the 10/666,642 US patent application
  misc_feature: The sequence is a functional homolog of SEQ ID NO 957 in the 10/666,642 US patent application
  misc_feature: Ceres ANNOT ID no. 8682361
  misc_feature (933)..(1054): Pfam ID: JmjC Pfam Description: JmjC domain
MADEAEWIEAEVGNAGAGPPAPGGGEETKRKRGRLKGSLNKNKKSNKDRTPKAKTGTKRRRRQRTSDRDLSVPVVLGDLGRGVAAGIRQLRERRPAPNAFFDRDSDSYTEHDDDEETMINQVNHESAKTGVSVKKRGRGRPRKMEADQLDSKSQSSNGKSNGQMNSNAAGKKRGRGRPKKLAVEQVFSRCQFSSGETNKSDAEAARSKQSRNHKLLQNAKKRKRDVGKESMRKKLNKVDKEQKQFPSTKDETLDKNNMWFFTTIFYECKFCFKNIQKGSKMLTGENALMCHQCQRKDKPRVVQCQSCKKKRFCVPCIEQWYPNLHEDEFAVKCPYCRKNCNCKACLRMKGVEEPPKKEISKENEIRYACHIVSLLLPWMRELRQEQMEEKEVEANIRGVSMNEIKVEEAEVDLDDRVYCDRCRTSIVDFHRSCKHCFYDLCLNCCKELRKGEIAGGEEVEYVPPEPKGRSYSFGKIPLSKDADRSKNSSNGQSYNGMPAVGNPNNGLLLWKAKSDGSIPCPPKEVGGCGSTLLDLKCLFPEKTLAEIEDRADKVLRSETLAKAMVSRSDRCPCFDHSGKIRTESKSLREAASRKDSSDNFLYCPVATGIQDDDIVHFQMHWAKGEPVVVSDVLQLTSGLSWEPMVMWRALRERSKGKAEDEQLAVWAIDCLDWCEVEINIHKFFSGYTTGRTHARTHWPQMLKLKDWPSSSSFDKRLPRHGAEFISALPFREYTDPRCGPLNLAAKLPAGVLKPDLGPKSYIAYGLYKELGRGDSVTKLHCDISDAVNILTHTAEVTCQTDHRQIEKIQKDMREQDLQELYGGLKSCSELKLSPAPTECRDESVDEGLKTSYIREDNCVNRDNYNGLDINALPPDDDGDDAKDKESSHESESQSELGQCSYHSNGVNTTDGMHSGAHYISHNQKSTDSIQLKKVGIKPQGEKSEKVDCSEQQSTGAGALWDIFRRQDSDKLQDYLRKHCSEFRHIYCNPVKKVFHPIHDQSFYLTQEHKRKLKEEYGIEPWTFEQKLGEAVFIPAGCPHQVRNLKSCIKVALDFVSPENVGECVKLTGEFRRLPSFHKAKEDKLEIKKMALHALNEAVNFLDPCSSEGLKIGVGENSCGDESADEKPMPKRRGIKES

SEQ ID NO: 17830 - DNA, 2526 bp, Sorghum bicolor
  misc_feature: Ceres ANNOT ID no. 8682394
  misc_feature: Encodes the peptide sequence at SEQ ID NO 17831
atgatgcccgaggcgctgcgtcagagccgataccacatgaagcgctgcttccagcggttcgtgtcccagggcagcaggctcatgaagcagcagcatctcctggaggagctccacggcggcggctcggcggacaacaacaagcagctggccgccgacggcttcctcggccacgtcatctcctgcacgcacgaggctgtggtgctgcctccctacgtggccttggccgtgcggaggaaccctggcgtctgggagtacatcaccgtccactccggcgacctcactgtccagcagatcacgccatccgactacctcaagcgcaaggaaatcctattcctatacgacaactcctcccagttggaggtgaacttgggcgccctggacctctccacgcctcgccttacgctgccttgttccatcggcaacggcatgcacttggtctccagattcctgtcctccaggctcggcggcggcggcggcaggacgaagaataaggcgctgctggactacctgctggcgctcaggtactaccggcggcggccgggcgaccagcagcagatcaataataagctgctcatcagcgacaccctcgacaccgtcggcaagctccaggcggcgctgctcctcgcccaggccttcgtctcggagcagcacccggacacgccgtaccagcagatggcgcacaggttccaggagtgggggctggagaaaggatggggcgacaccgccgaggcgtgcggccacacgctcgcctgcctcgccgaggtgctccaggcgccggaccctgccagcatacacaggttcttcagcagggtgccgtcggtgttcgacgtcgtcatcttctccgtccacggctacttcgggcagcacaaggtcctggggatgcccgacaccggtggccaggtcgtctacatcctggaccaagtcagagcgcttgaggaggagcttcttcagagaatcaaggggcagggcctcactttcacgcccaacatccttgtgctcacaaggctcataccagaagcaaagggcaccacctgcaacgtggagctggaacccattgagaacacaaggcactccagcatcctccgtgtgccattcaagacccaagatggccaggatctgccccactgggtctcccgcttcgacatttacccttacctagagagatacgctcaggattcctgtgccaagatcctagatatattggggcgcaaaccagacctggtcatcggcaattacactgatggcaacttagtagcttacctcgtgtcaaggaagcttggagttacccaggggacgatcgcgcatgccctcgagaagacgaagtatgaggattccgatgtcaagtggagagaaatggaccacaagtatcatttctcgtgccagtttactgctgatatgatcgcaatgaacaccagtgacttcatcatcgctagcacctaccaagaaatagcaggaagcaaagacaagcctggccagtatgagagccactatgcgttcacaatgccagggctctgccgcttcgctacaggcatcaatgtcttcgaccccaagttcaatatcgctgcccctggcgcggatcaatcagtttacttcccattcacacttaagcacaagcgcctcacagacctgcatccacagatcgaggcgctagtctacggcaaagaggaaaatgatgagcacataggctacttggaaaacaggaggaagccggtcatattttcaatggcaaggcttgacaaggtgaagaacatcacagggcttgttgaatggtatggtcaggacaaaaggctcagggtccttgtcaaccttgtagtcgtgggagggctcctggaccccacgcagtccaaggacagggaggagattgaggagataaacaagatgcacagtttgatcaacaagtaccagctcaaggggcagatccgctggataaaagcccagacagaccgtgtgcgcaacggggagctttaccgttgcatagcagataccaggggagcctttgttcagcctgcgctctatgaagcctttggactcactgtcatcgaggcaatgaactgtgggctgccaacctttgcaacaaatcagggaggccccgcagaaatcatcgtcgatgaggtctctggtttccatatcaacccacttgatggaaaagaggcaagcaacaagattgccaacttcttccagaaatgcaacgaagatcccatgtactggaacagaatgtccaccgctggactgcaacgcatctatgaatgctacacctggcagatctatgcaacaaaagttctgaacatggggtcaatgtatggcttctggaggactctggacaaagaagagaagcaggccaaacagcagtacctacagatgttctacaaccttcatttcaggaagctggcaaatgcggtgccgaaagtgggcgaacaacctgagcaagctacggcagtgccattgcctgataggtcggcaccaaggccaaaagaaaggcaaaaggacgcagataaggattcagaggtgagagctttatcatgctga

SEQ ID NO: 17831 - protein, 841 aa, Sorghum bicolor
  misc_feature: Useful for making plants with altered carbohydrate content
  misc_feature: Functional homolog of the protein sequence given in SEQ ID NO 13681
  misc_feature: Useful for making plants with altered cell wall content and/or composition
  misc_feature: Functional homolog of the protein sequence given in SEQ ID NO 13682
  misc_feature: The sequence is a functional homolog of SEQ ID NO 2 in US patent 7091398
  misc_feature: The sequence is a functional homolog of SEQ ID NO 12 in US patent 7091398
  misc_feature: Ceres ANNOT ID no. 8682394
  misc_feature (4)..(801): SWISSPROT Homolog: EC 2.4.1.13 Sucrose synthase
  misc_feature (1)..(553): Pfam ID: Sucrose_synth Pfam Description: Sucrose synthase
  misc_feature (556)..(746): Pfam ID: Glycos_transf_1 Pfam Description: Glycosyl transferases group 1
MMPEALRQSRYHMKRCFQRFVSQGSRLMKQQHLLEELHGGGSADNNKQLAADGFLGHVISCTHEAVVLPPYVALAVRRNPGVWEYITVHSGDLTVQQITPSDYLKRKEILFLYDNSSQLEVNLGALDLSTPRLTLPCSIGNGMHLVSRFLSSRLGGGGGRTKNKALLDYLLALRYYRRRPGDQQQINNKLLISDTLDTVGKLQAALLLAQAFVSEQHPDTPYQQMAHRFQEWGLEKGWGDTAEACGHTLACLAEVLQAPDPASIHRFFSRVPSVFDVVIFSVHGYFGQHKVLGMPDTGGQVVYILDQVRALEEELLQRIKGQGLTFTPNILVLTRLIPEAKGTTCNVELEPIENTRHSSILRVPFKTQDGQDLPHWVSRFDIYPYLERYAQDSCAKILDILGRKPDLVIGNYTDGNLVAYLVSRKLGVTQGTIAHALEKTKYEDSDVKWREMDHKYHFSCQFTADMIAMNTSDFIIASTYQEIAGSKDKPGQYESHYAFTMPGLCRFATGINVFDPKFNIAAPGADQSVYFPFTLKHKRLTDLHPQIEALVYGKEENDEHIGYLENRRKPVIFSMARLDKVKNITGLVEWYGQDKRLRVLVNLVVVGGLLDPTQSKDREEIEEINKMHSLINKYQLKGQIRWIKAQTDRVRNGELYRCIADTRGAFVQPALYEAFGLTVIEAMNCGLPTFATNQGGPAEIIVDEVSGFHINPLDGKEASNKIANFFQKCNEDPMYWNRMSTAGLQRIYECYTWQIYATKVLNMGSMYGFWRTLDKEEKQAKQQYLQMFYNLHFRKLANAVPKVGEQPEQATAVPLPDRSAPRPKERQKDADKDSEVRALSC

SEQ ID NO: 17832 - DNA, 3042 bp, Sorghum bicolor
  misc_feature: Ceres ANNOT ID no. 8682395
  misc_feature: Encodes the peptide sequence at SEQ ID NO 17833
atggggtcgaggaggggaaggcaacatcctggtgctggccacgccgcgcagcctccgcagccgggcgggagaggcgctgctcgtgctcagcagcccccgccgcagcctgctgcaggaagaggaggaggaggaggtcgtggagggatccagcagcaggggcgaggtggaggccgcacgtctcgtggcgggagtggagcgtggcgcccacgtggtgctggtgctacacctctgcagggggctgcctcgtcatccagcccttttgctcccgagctgcgccaagcaatggaggaggctcctcgtgagctcgcaccacaagcgccaccagtgcaggcggcaggtccttcgcagccatcgccagaggctcccccgcctgttcagcctagagagactgtgcctactgggcccactgcaggccaggagattattgtgcctaccgcacctccacaatcaagcaagtcattcaggtttcctttgcgcccaggaaagggcagtattggcaccaggtgcctggttaaggccaaccatttctttgctgagctgccagacaaggatcttcatcactacgatgtctcaatcacaccggaagttacctcaagggttgttggtcgagccatcatcaaggagctggtcaatctctacaagcaatcttacttgggtgggaggctaccggcctatgatggtaggaagagcctgtacacagccggcccactgccgtttacttcacaggaatttcatatcactttatttgacgatgatggtggccctggttccgagaggcgacgtaggaatttcaaagtagtcattaaatttgctgcacgagctgacctccaccgcctcgagctctttttagctgggaggcatgcagaagctcctcaagaggcattgcaggttctggatattgtgctgcgggaactgccttcatcaaggccaagatacgcaccatttggccggtcattcttttcgcctgacttgggccgaaggcagccccttggtgatggattagaaagctggcgtggattctaccagagcattcgtcctactcaaatgggcttgtcactcaacattgatatgtcagcgacagctttcattgagccattgcctgtaatcgaatttgttgcacagctgcttaattgtgaaattcactctaggccactctcagacgcggaacgggtgaagatcaagaaagccttgcgaggagttaaggtggaagttactcatcgtggaaacatgcggagaaagtatcgaatatctgggttaacaactcaggcgactcgagagttaacctttcctgttgatgaagggggtacaataaagtcagttgtacaatactttcaagagacatatggattttccattcaacacacctaccttccttgccttcaagttggcaatcaacagcgtccaaattacttgccaatggaggtctgcaaaatagtggagggacagaggtactccaagagattaaaccagaatcagatcagagctcttttggaggagacatgccagcacccacgcgatcgtgagcgtgatataattcggatggttaaacagaatgcctatgacaaggatgattatgcacaagagtttggcattaagattagcgatcgtctggcatcagttgaggcacggattttgccagctccacggcttaagtacaatgagactggtcgagagaaggactgcttacctagggttggtcagtggaatatgatgaacaagaaaatggtagatggtggtaaggtcagaagttggatatgtgtcaattttgctcgcaatgtgcaagacagtgttgttcgtgggttctgccatgaacttgcactgatgtgccaagcgtcaggaatggatttcgctcgggagcctgttcttccacctctatatgcacgtcctgatcaagtggagcgagctctgaaagctaggtaccatgatgccatgaacgttcttggacccaaacacaaggaacttgatttacttattggaatactacctgacaacaatggctcactttatggtgatttgaagcgtgtctgtgaaatagatcttgggatagtttcacagtgctgttgcacaaagcaggttttcaaaatgaacaacaaacaaattcttgcaaatcttgctctgaagattaatgtgaagttgacatcctttaatttggcaaaggttgggggcaggaacaccgtgctggtagatgccgtctcaaggggaattcctctggtaactgatcgacctacaatcatatttggtgctgatgtgactcatcctcatcccggtgaggacagtagtccctcaattgctgctgttgtggcctcccaagattggccagaggtgacaaagtatgctggactagtttgtgctcaagctcatcggcaagagttgatagaggatttgtataaggtctggcaagatccacagagagggacagtcagcggtggaatgataagggagctacttgtatccttcaaaaaatcaactggtgagaagccccagcgaataatattttacagggatggtgtcagtgaaggacaattttatcaagttctgttgtatgagctcaatgctatccgaaaggcctgtgcctccctggaagcggagtaccaaccaaaggtgacttttgttgtggttcagaagcgccatcatactagattatttgctcacaaccacaatgatcagaattcaattgacaggagtggaaacatactcccaggtactgttgtagattcgaagatctgtcatcctactgaatttgacttctacttgtgtagccatgctggcattaagggcactagccgtccagctcattatcatgtcttgtgggatgaaaacaacttctctgctgacgagttgcagactcttacaaacaacctctgttacacggctcgtttttacatggaaccagagacttctgacagtggatcggtggcaagtggtcctgcaggccgtggacctcagtcagcatcccatagcactcgggcccctggtggtgcagctgttaggccacttccagctctgaaggataacgtaaagagggtcatgttctactgctga

SEQ ID NO: 17833 - protein, 1013 aa, Sorghum bicolor
  misc_feature: The sequence is a functional homolog of SEQ ID NO 2086 in the 10/374,780 US patent application
  misc_feature: The sequence is a functional homolog of SEQ ID NO 152 in the 10/225,066 US patent application
  misc_feature: The sequence is a functional homolog of SEQ ID NO 238 in the 10/374,780 US patent application
  misc_feature: Ceres ANNOT ID no. 8682395
  misc_feature: Down-regulated in root tissues in response to methyl jasmonate treatment
  misc_feature (656)..(985): Pfam ID: Piwi Pfam Description: Piwi domain
  misc_feature (366)..(503): Pfam ID: PAZ Pfam Description: PAZ domain
MGSRRGRQHPGAGHAAQPPQPGGRGAARAQQPPPQPAAGRGGGGGRGGIQQQGRGGGRTSRGGSGAWRPRGAGATPLQGAASSSSPFAPELRQAMEEAPRELAPQAPPVQAAGPSQPSPEAPPPVQPRETVPTGPTAGQEIIVPTAPPQSSKSFRFPLRPGKGSIGTRCLVKANHFFAELPDKDLHHYDVSITPEVTSRVVGRAIIKELVNLYKQSYLGGRLPAYDGRKSLYTAGPLPFTSQEFHITLFDDDGGPGSERRRRNFKVVIKFAARADLHRLELFLAGRHAEAPQEALQVLDIVLRELPSSRPRYAPFGRSFFSPDLGRRQPLGDGLESWRGFYQSIRPTQMGLSLNIDMSATAFIEPLPVIEFVAQLLNCEIHSRPLSDAERVKIKKALRGVKVEVTHRGNMRRKYRISGLTTQATRELTFPVDEGGTIKSVVQYFQETYGFSIQHTYLPCLQVGNQQRPNYLPMEVCKIVEGQRYSKRLNQNQIRALLEETCQHPRDRERDIIRMVKQNAYDKDDYAQEFGIKISDRLASVEARILPAPRLKYNETGREKDCLPRVGQWNMMNKKMVDGGKVRSWICVNFARNVQDSVVRGFCHELALMCQASGMDFAREPVLPPLYARPDQVERALKARYHDAMNVLGPKHKELDLLIGILPDNNGSLYGDLKRVCEIDLGIVSQCCCTKQVFKMNNKQILANLALKINVKLTSFNLAKVGGRNTVLVDAVSRGIPLVTDRPTIIFGADVTHPHPGEDSSPSIAAVVASQDWPEVTKYAGLVCAQAHRQELIEDLYKVWQDPQRGTVSGGMIRELLVSFKKSTGEKPQRIIFYRDGVSEGQFYQVLLYELNAIRKACASLEAEYQPKVTFVVVQKRHHTRLFAHNHNDQNSIDRSGNILPGTVVDSKICHPTEFDFYLCSHAGIKGTSRPAHYHVLWDENNFSADELQTLTNNLCYTARFYMEPETSDSGSVASGPAGRGPQSASHSTRAPGGAAVRPLPALKDNVKRVMFYC

SEQ ID NO: 17834 - DNA, 993 bp, Sorghum bicolor
  misc_feature: Ceres ANNOT ID no. 8682424
  misc_feature: Down-regulated in root tissues in response to methyl jasmonate treatment
  misc_feature: Encodes the peptide sequence at SEQ ID NO 17835
atggcggcggcgcttgctgcatcatcagcagaggcggctcttcttctcctagtattattggtacgactcgccgcggtggcgctgagatgcggcgaggggctgagcctggctttgtatgacgagagctgcccggaggcggaggcggcggtgacggcggccgtgcggcaggccatggcaaacgaccgcaccgtggcggctgggctcctccgaatgcatttccacgactgcttcgtcaggggctgcgacggctccgttctgctggactcgacgggcaccgtgacggcagagaaggacggcccgcccaacgtctcgctgcacgctttctacgtcatcgacaacgccaagcgggccgtggaggcccagtgccccggggtcgtctcgtgcgccgacatcctcgcgctcgccgcaagagacgccgtcgcgctgtccggtggtccgtcgtgggtggtggccttggggcggcgggacgggcgcgtgtcgcgggccaacgagacgacgacgctgccggggccgacggctagctttgagcagctgaagcaggcgttccacggccgcgggctgtccaccaaggacctggtggtgctgtcgggcgcccacacgctgggcttcgcgcactgctcctccttccagaaccgcatccggctccaggaccagggcaccgacgccgacgacccttccctgagcccctccttcgccgccgccctccgccgtgcgtgccccgccaacaacaccgtccgcgccgccgggtccggcctggacgccacctccgcggccttcgacaacacctactaccggatgctgcaggccggccagggcctgctctcctccgacgaggcgctgctcacgcaccccaagacgcgcgccttcgtcgcgctctacgccgcgtcgcaggaggccttcttcagggccttcgccaagtccatgctgcggatggccgcgctcaacggaggcgacgaggtgcgagccaactgcaggcgcgtcaactcatcatga

SEQ ID NO: 17835 - protein, 330 aa, Sorghum bicolor
  misc_feature: Useful for making plants with altered cell wall content and/or composition
  misc_feature: Functional homolog of the protein sequence given in SEQ ID NO 13715
  misc_feature: Useful for making plants with altered carbohydrate content
  misc_feature: Functional homolog of the protein sequence given in SEQ ID NO 13714
  misc_feature: Ceres ANNOT ID no. 8682424
  misc_feature: Down-regulated in shoot tissues in response to aminocyclopropane carboxylic treatment
  misc_feature: Down-regulated in shoot tissues in response to salicylic acid treatment
  misc_feature (32)..(327): SWISSPROT Homolog: EC 1.11.1.7 Peroxidase
  misc_feature (50)..(296): Pfam ID: peroxidase Pfam Description: Peroxidase
MAAALAASSAEAALLLLVLLVRLAAVALRCGEGLSLALYDESCPEAEAAVTAAVRQAMANDRTVAAGLLRMHFHDCFVRGCDGSVLLDSTGTVTAEKDGPPNVSLHAFYVIDNAKRAVEAQCPGVVSCADILALAARDAVALSGGPSWVVALGRRDGRVSRANETTTLPGPTASFEQLKQAFHGRGLSTKDLVVLSGAHTLGFAHCSSFQNRIRLQDQGTDADDPSLSPSFAAALRRACPANNTVRAAGSGLDATSAAFDNTYYRMLQAGQGLLSSDEALLTHPKTRAFVALYAASQEAFFRAFAKSMLRMAALNGGDEVRANCRRVNSS

SEQ ID NO: 17836 - DNA, 1515 bp, Sorghum bicolor
  misc_feature: Ceres ANNOT ID no. 8682398
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 17837
atgcgcggcggtgggcaccagcagcacctctcgtccccgaccgcggtgctggggcacgtcacccctgcgcttcgcgacctctacgccgtggggcgcaagctcgggcagggtcagttcggcacgacgtacctgtgcacggaggtctcgacgggcgcggccttcgcgtgcaagtcgatcgcgaagcgcaagctgctgacgcccgaggacgtggacgacgtgcggcgcgagatccagatcatgcaccaccttgcgggtcacggcagcgtggtgaccatcaagggcgcgtacgaggacccgctgtacgtgcacatcgtgatggagctgtgcgagggcggcgagctcttcgaccgcatcgtggaccgtggctacttctcggagcgcaaggccgccgagatcgcgcgcgtcatcgtgggcgtggtggaggcgtgccactcgctgggcgtgatgcaccgggacctcaagcccgagaatttcttgctcaaggacagcagggacaggcggggtcgacacgacgacgacgacgacgacgacgaggcgccgccggcgtctctcaaggccatcgacttcggcctctccgtcttcttcaagcccggccaggtgttcaccgacgtggtggggtccccctactacgtggcgccggaggttctgtgcaagcactacggtcccgaggcggacgtgtggacggcgggggtcatcatctacatcctcctcagcggggtgccgcccttctgggccgagacgcagcagggcatcttcgacgccgtgctcaagggcgccatcgacttcgactccgagccctggcccaccatctccgacagcgccaaggacctcatccgccggatgctgcgctcgccgccggccgacaggatgaccgcgcaccaggtgctgtgccacccctggatctgcgagaacggcgtggccccggacagggcgctcgaccccgccgtgctcacgcgcctcaagcagttctccgccatgaacaggctcaagaagatggcgctgcgggtcatcgcgcagaacctgtcggaggaggagctggcggggctcaaggagatgttcaaggccatggacacggacggcagcggcgccatcaccttcgacgagctcaaggaagggctcaccaggtacggctccaacctcagggagagcgagatcagggacctcatggacgccgccgacgtcgacaacagcggcaccatcgactacgacgagttcatcgcagccaccgtgcacatgagtaagctggagcgcgaggagcacctgctcgcagctttcgcctacttcgacaaggacggcagcggctacatcaccgtcgacgagctggagcaggcgtgcagggaccacaacatggtcgacgtcggtctcgacgacatcatcacagaggtggaccaggacaatgatggccgcatcgactatggcgagttcgtggctatgatgaagaagggcatcatcggccacggcaggctcaccatgaggcacaactccgacggcagcgtcctccatggcgccggctag

SEQ ID NO: 17837 - protein, 504 aa, Sorghum bicolor
  misc_feature: The sequence is a functional homolog of SEQ ID NO 2 in US patent 7084323
  misc_feature: Ceres ANNOT ID no. 8682398
  misc_feature (16)..(504): SWISSPROT Homolog: EC 2.7.11.1 Non-specific serine/threonine protein kinase
  misc_feature (28)..(301): Pfam ID: Pkinase Pfam Description: Protein kinase domain
  misc_feature (348)..(376): Pfam ID: efhand Pfam Description: EF hand
  misc_feature (454)..(482): Pfam ID: efhand Pfam Description: EF hand
  misc_feature (384)..(412): Pfam ID: efhand Pfam Description: EF hand
  misc_feature (420)..(448): Pfam ID: efhand Pfam Description: EF hand
MRGGGHQQHLSSPTAVLGHVTPALRDLYAVGRKLGQGQFGTTYLCTEVSTGAAFACKSIAKRKLLTPEDVDDVRREIQIMHHLAGHGSVVTIKGAYEDPLYVHIVMELCEGGELFDRIVDRGYFSERKAAEIARVIVGVVEACHSLGVMHRDLKPENFLLKDSRDRRGRHDDDDDDDEAPPASLKAIDFGLSVFFKPGQVFTDVVGSPYYVAPEVLCKHYGPEADVWTAGVIIYILLSGVPPFWAETQQGIFDAVLKGAIDFDSEPWPTISDSAKDLIRRMLRSPPADRMTAHQVLCHPWICENGVAPDRALDPAVLTRLKQFSAMNRLKKMALRVIAQNLSEEELAGLKEMFKAMDTDGSGAITFDELKEGLTRYGSNLRESEIRDLMDAADVDNSGTIDYDEFIAATVHMSKLEREEHLLAAFAYFDKDGSGYITVDELEQACRDHNMVDVGLDDIITEVDQDNDGRIDYGEFVAMMKKGIIGHGRLTMRHNSDGSVLHGAG

SEQ ID NO: 17838 - DNA, 330 bp, Sorghum bicolor
  misc_feature: Ceres ANNOT ID no. 8682431
  misc_feature: Encodes the peptide sequence at SEQ ID NO 17839
atgacctgtgtgtgtcgtttttttttccagtggattcctgaattaaggcactatgctcctggcgtgcccataatccttgttgggacaaaacttgatttgcgagatgataagcagttttttgctgatcaccctggtggcgaagagctgaggaagctaattggtgcagctgcctacatcgaatgcagttcaaaaacccaacaaaacataaaagcagtgtttgatgcggccattaaggtgcttctccagcctccaaagcagaagaagcagaagaatctctggctgcgctgcgctgctgccaaggataaccatcgcgggcctcttgctgtataa

SEQ ID NO: 17839 - protein, 109 aa, Sorghum bicolor
  misc_feature: Useful for making plants with modulated nitrogen use efficiency
  misc_feature: Functional homolog of the protein sequence given in SEQ ID NO 13110
  misc_feature: Ceres ANNOT ID no. 8682431
  misc_feature (1)..(82): Pfam ID: Ras Pfam Description: Ras family
MTCVCRFFFQWIPELRHYAPGVPIILVGTKLDLRDDKQFFADHPGGEELRKLIGAAAYIECSSKTQQNIKAVFDAAIKVLLQPPKQKKQKNLWLRCAAAKDNHRGPLAV

SEQ ID NO: 17840 - DNA, 1242 bp, Sorghum bicolor
  misc_feature: Ceres ANNOT ID no. 8682411
  misc_feature: Encodes the peptide sequence at SEQ ID NO 17841
atgatgaactgcttgcgcctgcgtctctgctaccaccgcgacgtggatccgtcgtccccctgcggcagcccctccagctacgcggcccagacccagagctccgtccacgtacgcggcggcggcggcggcggcaccacgaccacccgcaagttcacgctggcgcagctgtccgtggccacgggcgggttccctgagtcgaacctggtgggcgagggcgggttcggcagggtgtacaggggccggctggatgcggccggtggcggtggcctcgaggtggccgtgaagcagctttgccgcggcggcgcgcagggcagccgcgagttcctggtggagtgcagcatgctgatgatgctgcggcacccgaacctggtgtccctggtgggctactgcgccgaggcccaggagcggctcctcgtctacgagttgctcccgcggggcagcctggacgcgcacctcttcgtctccaagtccctgcttggctgggacgcccgcgtgaaggtcgcccttggcgccgcccgcggcctccgctacctccacgaggtggtgaccccgccggtgatctaccgcgacctcaagtcgtccaacatcctgctgggcgacgacctgagccccaagctgtcggactttgggctcgccaggctgggccccgaccccgagggcgacgacacccacgtgtccacccgcgtcatgggcacctacggctactgtgccccggagtacgccgtcactgggaagctcagcgtcaagtccgacgtctacagcttcggcgtcgtgctgctggagctgctcacggggcgaagggccttcgacttggacgcccacagcagcagcagcagtagtagtagtagtagggatgatcaggaggctcatcaggaccaggagcggcggctgctggtgtgggcacggccccacctgcagcagctgcaggggcggggcaggggcaggggcctggaggcgctggcggacccggcgttgcaggggcggtaccctcgccgcggactctaccaggtggccgtcatcgcctcgctctgcctgcacgacaagcccaacctccgccccactatgaccgacgtcacgcaggcgctggagcacgtggcggcgcagccctggagggttgttgttagtagggatagagacggcgatatgatcaggaggaggccggctgccggcggcggatcatcaagacggggacggggacggggaagcactccgcgcgcctcctccgctgacagtgacagctag

SEQ ID NO: 17841 - protein, 413 aa, Sorghum bicolor
  misc_feature: Useful for making plants with modulated drought sensitivity
  misc_feature: Functional homolog of the protein sequence given in SEQ ID NO 14078
  misc_feature: Useful for making plants with altered carbohydrate content
  misc_feature: Functional homolog of the protein sequence given in SEQ ID NO 14218
  misc_feature: Ceres ANNOT ID no. 8682411
  misc_feature (51)..(270): SWISSPROT Homolog: EC 2.7.11.1 Non-specific serine/threonine protein kinase
  misc_feature (63)..(365): Pfam ID: Pkinase Pfam Description: Protein kinase domain
MMNCLRLRLCYHRDVDPSSPCGSPSSYAAQTQSSVHVRGGGGGGTTTTRKFTLAQLSVATGGFPESNLVGEGGFGRVYRGRLDAAGGGGLEVAVKQLCRGGAQGSREFLVECSMLMMLRHPNLVSLVGYCAEAQERLLVYELLPRGSLDAHLFVSKSLLGWDARVKVALGAARGLRYLHEVVTPPVIYRDLKSSNILLGDDLSPKLSDFGLARLGPDPEGDDTHVSTRVMGTYGYCAPEYAVTGKLSVKSDVYSFGVVLLELLTGRRAFDLDAHSSSSSSSSSRDDQEAHQDQERRLLVWARPHLQQLQGRGRGRGLEALADPALQGRYPRRGLYQVAVIASLCLHDKPNLRPTMTDVTQALEHVAAQPWRVVVSRDRDGDMIRRRPAAGGGSSRRGRGRGSTPRASSADSDS

SEQ ID NO: 17842 - DNA, 5640 bp, Sorghum bicolor
  misc_feature: Ceres ANNOT ID no. 8682405
  misc_feature: Encodes the peptide sequence at SEQ ID NO 17843
atggcgtcctcctcggggggcggcgggggccgcaggttggcccccgggggagacgcctcccccgcctccgccggcgccaggaggatctaccgcacccagaccgccggtaacctcggcgactccatattcgacagcgaggtcgtcccgtcgtcgcttgtcgagatcgcgcccatcctgcgtgtggccaacgaggtggaggccagcaacccgcgagtagcctacctctgccgcttctacgccttcgagaaggcgcatcgcctcgaccccacctccagcggccgtggcgtccgccagttcaaaaccgccctgctgcagaggctcgagagggagaacgatcccacgctcaagggcagggtcaagcagagtgacgccagagaaatgcagagcttctaccagcactactacaagaagtacattcaggcgcttcaaaacgctgccgataaagccgaccgggctcagctcaccaaagcttatcaaactgccgccgtgctctttgaggtcctcaaagccgtcaatgtttcccagaaaatcgaagtcgatcagtcgattctcgagacgcacaaccaggtcgaggaaaagaagaagctataccttccttacaatatcctcccgcttgatcctgacagcgccaaccaggctatcatgcgctatcctgagatccaagctgctttccatgctcttcgcaacaccagaggtctgccatggcccaaggaacacgacaagaagcccgatgcagatcttcttgcctggcttcaggccatgtttggattccagaaagataacgtatccaaccaaagggagcatctcatacttttgcttgccaacgtgcacataagacagattcccaaacctgaacaacaaccaaagttggatgaccgagcgctggatacagtaatgaagaagctatttaagaattataagagatggtgcaaatatcttggccgcaaaagcagcttatggttgccgactatccaacaggaggtgcaacaacgcaagcttctctatatgggtctttatctgctcatatggggcgaggcagctaacctgagattcatgccagagtgtctttgctacatctatcatcatatggcctttgaactctatggtatgttggctggaaatgtgagcccgacgactggtgaaaatgttaaaccagcttatggtggagaagaagaagccttcttgaagagagttgtgactccaatctataaagttatagaaaaggaagtcgagaggagcaagaccatgaaatcaaagcactcacactggagaaactacgatgatcttaatgagtacttttggtcaagagattgcttccgattgggatggcctatgcgatctgatgaggacaggcctgtgggtaatggcaattggatgggaaaagtcaactttgttgaaatacggtcattttggcacatcttccgcagctttgataggatgtggagcttcttaattttatctttacaggctatgattataattgcttggaatggtggcacaccaagtgatatctttgatagaggagtgttcaaacaggttttgagcatatttataactgcggctatactgaaactgggtcaagcaatcttggatattatcttgagctggaaagcaagaagaaacatgtctcttgttgttaagctacgatatatcttgaagttactatcagctgctgcttgggttgtgattttgcctgtaacttatgcatacacttgggagaatccaactggccttgcaagaacaattaaaagttggcttggtgatggtcagaatcagccatcattatacattttggcagttgtgatttatttggcaccaaacttgctgtccgctacactatttcttttccctgtaattaggagagctcttgagagatcaaatcttagagtcgtaacattcataatgtggtggtcgcagcctcgcttatttgttggaagagggatgcatgagggcgcattctcccttttcaagtatacaatgttctgggtattgcttttggccactaaattggttgtgagcttctatgtggagatcaaaccacttgtgcagccaacaaaagatataatgaaggagccaatacgaacatttaagtggcacgagtttttcccccatgcaaataacaacattggtgtcgtcattgcgctttgggctcctattattcttgtctatttcatggatactcaaatttggtatgcaattttctcaacgctaattggtggtgtatatggggcttgtcgccgtcttggtgagataaggacattgggaatgttgagatctcggtttgaatctctgcctaaggctttcaatcaatgcttgattccatctgacacaagcaagaggagaggattccggacacctgaggacaccaaagaagaagaaaaaatagccgcaagatttgctcagatttggaatttaattattacaagcttccgcgaggaagatttgatagacgacagagagaaggacttgttacttgttccatactgtaaagatcgtgatatggatataatccaatggccaccattcctgcttgccagcaagattccaatagcattggatatggccgcagatagtggtggaaaagatcgtgatctaaagaagagaatgaagtcggacccatattttacttatgctatcaaggaatgctacgcttctttcaaaaacatcatatatgcactagtgatcagttcacgagagagaggtttcatacaaaagattttcgatatggtggatgagcatataacagaagagactttgataaaggagctgaacatgagtaaccttcctaccctaagcaagaagtttattgagctgcttgacttactggaaagtaacaacaaagaagaacagggtcaggtcatcatattgttccaagacatgcttgaagtggttacaagggacataatgataaaaaggcttcgacttctgctcacggtgaaggaatcagctatggatgtccctacaaacctggatgctagaaggaggatatctttctttgctaattctctttttatgtcgatgccagatgccccaaaagtgcggcaaatgttgcccttctctgtcttgactccttattataaagaagacgttcttttctcttcacaagcactaggggaacagaatgaggatggggtttctatccttttctatttgcaaaaaatctacccagatgaatggaaaaattttcttgaaagggtgcattgtgagagtgaagatcaactccacgagaccgagcaatctgaagagcagcttcgcctttgggcatcataccggggacaaactttgacaagaactgtaagggggatgatgtactacagacaagctttagtccttcaggctttccttgatatggccagagatgacgatcttatggagggttttagagcagctgacctgttatctgaatctgatgaatcgcaacttttgactcaatgcaaagctatagctgacatgaaattcacatatgttgtgtcatgccagcaatatggtatccagaaacgttctggtgatccacatgcacaggatattctgagattgatgaccacttatccgtcacttagggttgcctacatcgacgaagtcgaagagcctagcaaagacagaaataagaaaatagagaaggtttactactccgcattggtgaaggcagcagtaactaagcctgatgatcctggccagaaacttgatcaggatatatataggataaagcttccagggaatgcaatgctaggtgaaggaaaaccagaaaaccagaaccatgccataattttcacacgaggtgaaggtctccaaaccatcgacatgaatcaggaacattatatggaggagactttgaaaatgaggaatttgttgcaagagtttctgaagaaacatgatggtgtgagatatccatcaatacttggtgtaagggaacatatcttcaccggcagtgtttcttctcttgcatggttcatgtcaaaccaagaaacaagttttgtgaccattggacaacgtgtacttgccaatcctttgagagttcggtttcattatgggcatcctgatatctttgatcgacttttccacctgacaaggggaggtgtaagcaaagcttctaagattatcaatcttagtgaagacatatttgctggatttaactcaacattgcgtgaaggaaatgttacacatcatgaatacatgcaagttggcaagggcagagatgttggtctcaatcagatctcactatttgaagcaaaaatagcaaatggtaatggtgaacagacgctgagccgtgacgtctaccgacttggacatcgttttgactttttcagaatgttgtcctgctactacactactattggtttttacttcagcacaatgataacagtttggacagtgtatgtattcctctacgggcgtctgtatcttgtcctcagtggccttgatgaagcactagccactggaaagaggtttatacacaatgagcctctccaggttgctctagcttcgcagtcttttgtgcagcttggcttcttgatggcgctgcctatgatgatggaaattggtctagagagaggattcagaactgcattgagtgactttgtacttatgcagctccagttagcatctgtgttcttcacattctctcttgggaccaaaactcactactacggaaccacactgttacatggaggagctgaatatagagctacagggcgtggatttgtggtcttccatgccaaatttgctgagaactatcgattgtattcacgaagtcattttgtgaagggcatcgaactgatgattttgctcattgtgtatgaaatatttgggcagtcataccgaggagctattgcgtacattttcatcacaatttccatgtggtttatggttgtcacctggctctttgccccattcctgtttaatccttctgggttcgagtggcagaaaattgtggatgactggactgactggaataagtggatcagtaaccgtggaggtattggggtgccaccagagaaaagttgggagtcatggtgggaaaaagagcaggagcctcttaggcattctggaaagcgtggcactgttcttgaaatagtgcttgcattgcgcttctttatctaccagtatggtcttgtttatcatttgaacatcaccactcacacaaagagcgttctggtttattgcatctcatgggtcataatctttgtcattttgcttgtgatgaagactgtatcagttggcaggaggaaattcagtgcagagttccagcttgtgttccggttgatcaagggtctgatattcataacgtttatctctattatcataatattgatagcaatcccacacatgacagttcaggacatctttgtttgcatccttgcgttcatgccgactgggtggggtttgcttctgatagcacaaactatgaggtcagctatttcacatatggggctatggggatcggtcaaagcgcttgcccgaggctatgagatcatcatgggcttgctgctgttcaccccgatcgcattcctagcttggttcccgtttgtttcggagttccagacaaggatgctattcaaccaggccttcagtagaggtctgcagatttctcgtatcctaggtggacacaaaaaagacagggctgcacggaacaaggagtga

SEQ ID NO: 17843 - protein, 1879 aa, Sorghum bicolor
  misc_feature: Useful for making plants with altered cell wall content and/or composition
  misc_feature: Functional homolog of the protein sequence given in SEQ ID NO 14254
  misc_feature: Useful for making plants with altered carbohydrate content
  misc_feature: Functional homolog of the protein sequence given in SEQ ID NO 14257
  misc_feature: Ceres ANNOT ID no. 8682405
  misc_feature (1085)..(1658): SWISSPROT Homolog: EC 2.4.1.34 1,3-beta-glucan synthase
  misc_feature (986)..(1751): Pfam ID: Glucan_synthase Pfam Description: 1,3-beta-glucan synthase component
MASSSGGGGGRRLAPGGDASPASAGARRIYRTQTAGNLGDSIFDSEVVPSSLVEIAPILRVANEVEASNPRVAYLCRFYAFEKAHRLDPTSSGRGVRQFKTALLQRLERENDPTLKGRVKQSDAREMQSFYQHYYKKYIQALQNAADKADRAQLTKAYQTAAVLFEVLKAVNVSQKIEVDQSILETHNQVEEKKKLYLPYNILPLDPDSANQAIMRYPEIQAAFHALRNTRGLPWPKEHDKKPDADLLAWLQAMFGFQKDNVSNQREHLILLLANVHIRQIPKPEQQPKLDDRALDTVMKKLFKNYKRWCKYLGRKSSLWLPTIQQEVQQRKLLYMGLYLLIWGEAANLRFMPECLCYIYHHMAFELYGMLAGNVSPTTGENVKPAYGGEEEAFLKRVVTPIYKVIEKEVERSKTMKSKHSHWRNYDDLNEYFWSRDCFRLGWPMRSDEDRPVGNGNWMGKVNFVEIRSFWHIFRSFDRMWSFLILSLQAMIIIAWNGGTPSDIFDRGVFKQVLSIFITAAILKLGQAILDIILSWKARRNMSLVVKLRYILKLLSAAAWVVILPVTYAYTWENPTGLARTIKSWLGDGQNQPSLYILAVVIYLAPNLLSATLFLFPVIRRALERSNLRVVTFIMWWSQPRLFVGRGMHEGAFSLFKYTMFWVLLLATKLVVSFYVEIKPLVQPTKDIMKEPIRTFKWHEFFPHANNNIGVVIALWAPIILVYFMDTQIWYAIFSTLIGGVYGACRRLGEIRTLGMLRSRFESLPKAFNQCLIPSDTSKRRGFRTPEDTKEEEKIAARFAQIWNLIITSFREEDLIDDREKDLLLVPYCKDRDMDIIQWPPFLLASKIPIALDMAADSGGKDRDLKKRMKSDPYFTYAIKECYASFKNIIYALVISSRERGFIQKIFDMVDEHITEETLIKELNMSNLPTLSKKFIELLDLLESNNKEEQGQVIILFQDMLEVVTRDIMIKRLRLLLTVKESAMDVPTNLDARRRISFFANSLFMSMPDAPKVRQMLPFSVLTPYYKEDVLFSSQALGEQNEDGVSILFYLQKIYPDEWKNFLERVHCESEDQLHETEQSEEQLRLWASYRGQTLTRTVRGMMYYRQALVLQAFLDMARDDDLMEGFRAADLLSESDESQLLTQCKAIADMKFTYVVSCQQYGIQKRSGDPHAQDILRLMTTYPSLRVAYIDEVEEPSKDRNKKIEKVYYSALVKAAVTKPDDPGQKLDQDIYRIKLPGNAMLGEGKPENQNHAIIFTRGEGLQTIDMNQEHYMEETLKMRNLLQEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQISLFEAKIANGNGEQTLSRDVYRLGHRFDFFRMLSCYYTTIGFYFSTMITVWTVYVFLYGRLYLVLSGLDEALATGKRFIHNEPLQVALASQSFVQLGFLMALPMMMEIGLERGFRTALSDFVLMQLQLASVFFTFSLGTKTHYYGTTLLHGGAEYRATGRGFVVFHAKFAENYRLYSRSHFVKGIELMILLIVYEIFGQSYRGAIAYIFITISMWFMVVTWLFAPFLFNPSGFEWQKIVDDWTDWNKWISNRGGIGVPPEKSWESWWEKEQEPLRHSGKRGTVLEIVLALRFFIYQYGLVYHLNITTHTKSVLVYCISWVIIFVILLVMKTVSVGRRKFSAEFQLVFRLIKGLIFITFISIIIILIAIPHMTVQDIFVCILAFMPTGWGLLLIAQTMRSAISHMGLWGSVKALARGYEIIMGLLLFTPIAFLAWFPFVSEFQTRMLFNQAFSRGLQISRILGGHKKDRAARNKE

SEQ ID NO: 17844 - DNA, 756 bp, Sorghum bicolor
  misc_feature: Ceres ANNOT ID no. 8682459
  misc_feature: Encodes the peptide sequence at SEQ ID NO 17845
atggacgagtgggttcaccaagccgaggtgtgggtgcgccaagccgagagctggatccgccagcagcctacggagcagatctatatcgccgccgcggtggttgccctcacaatcctgctgcttatcgtagcatcttgtctgaaatcctcgaagccaaatactatagtgctatccggccttagtggcagtggcaaaactactattttctaccagcttcgggatggatcatcacatcaaggaactgtgacttcaatggaagaaaacaatgacacatttgtactgcattcagagcaagaaaggaaaggcaaagtaaaacctgtgcatgttgttgatgtccctggccattcaaggctcaagcccaagcttgatgaagtcctgcctaaagcagctggggttgttttcattgttgacgctcaagatttcttgtctagcatgcaagctgctgcagagtacctgtatgacattctgacaaaggcaattgtagtgaagaaaaaggttcctgtgcttatattctgcaacaagacagataaagttacagcccactcaaaggagttcataaagaaacaaaacaagcttcgggaatcaaggaatgccatatcatcagctgacatctctgatgaagtccagctcggggtccctggagaggtattcaacttcagccagtgccagaacaaggtggctgttgctgagggtgccggttcgaccggtaatgtttcagctgtcgagcaattcatccgtgaacatgtgaaggcgtag

SEQ ID NO: 17845 - protein, 251 aa, Sorghum bicolor
  misc_feature: Useful for making plants with modulated cold sensitivity
  misc_feature: Functional homolog of the protein sequence given in SEQ ID NO 12929
  misc_feature: Ceres ANNOT ID no. 8682459
  misc_feature (39)..(204): Pfam ID: Arf Pfam Description: ADP-ribosylation factor family
MDEWVHQAEVWVRQAESWIRQQPTEQIYIAAAVVALTILLLIVASCLKSSKPNTIVLSGLSGSGKTTIFYQLRDGSSHQGTVTSMEENNDTFVLHSEQERKGKVKPVHVVDVPGHSRLKPKLDEVLPKAAGVVFIVDAQDFLSSMQAAAEYLYDILTKAIVVKKKVPVLIFCNKTDKVTAHSKEFIKKQNKLRESRNAISSADISDEVQLGVPGEVFNFSQCQNKVAVAEGAGSTGNVSAVEQFIREHVKA

SEQ ID NO: 17846 - DNA, 1170 bp, Sorghum bicolor
  misc_feature: Ceres ANNOT ID no. 8682471
  misc_feature: Encodes the peptide sequence at SEQ ID NO 17847
atggcggcgacggatcatgaggttgaggaggcggtggcgaaggcgagagaggacgacaagagccggcggcaggtggacggcttcgacgctgggaaggcgccgccgttccgcattggcgacgtgcgggcggcggtgccggagcactgctggcgcaagagcccctggcggtcgctgtggtacgtggtgcgggacgtggcggtggtggtggcgctgggagcggcggcggcggccatggatagctgggcggtgtggccgctctactgggcggtgcaggggaccatgttctgggcgttcttcgtcttgggacacgactgtggtcatgggagcttctcggacaacgcgacgcttaacagcgtggttggtcatctcctccactccttcatcctcatcccctaccatggatggaggatcagccacagaacacatcatcagaaccacggccacgtcgacagggacgagtcatggcacccgctgacggagcggcggtaccggcgattgcctcctcgcgcaaagaagctaagattcacgccccccttcccgctgctcttattccccctctacctgttctacaggagccctggcaagaggggctctcactttcttcccagcagcccactgttcagccccaaggacaagggcgacgtcatactctcgaccacctgctggtgcatcatgctcgccttcctcctcgccatgtcgtgcgcgttcggcccactccaggtgctcaagatgtacggcgttccatacctggtgtctgtgatgtggcttgacttggtgacttacctgcaccaccatgggcaccaggagcgcctcccctggtaccgcggcgaggaatggagctacctccgcggcgggctgacgacggtggacagagactacggctggatcaacagcatccaccacgacatcggcacccatgtcatccaccacctcttcccgcagatcccgcactaccatctcgtcgaagctaccaaggcagccaagccggtgctggggcgatactaccgggagccacacaagtcagggccgctgccacttcacctccttggcgtgctcctcaggagcctcagagtcgaccacttcgtcagcgaccatggcgatgttgtctactaccaaactgaccatcacctcaacgacactactactgatgatgctcataagcaaaaatga

SEQ ID NO: 17847 - protein, 389 aa, Sorghum bicolor
  misc_feature: Useful for making plants with modulated heat sensitivity
  misc_feature: Functional homolog of the protein sequence given in SEQ ID NO 13709
  misc_feature: Ceres ANNOT ID no. 8682471
  misc_feature (34)..(336): SWISSPROT Homolog: EC 1.14.99.33 Delta(12)-fatty acid dehydrogenase
  misc_feature (87)..(331): Pfam ID: FA_desaturase Pfam Description: Fatty acid desaturase
MAATDHEVEEAVAKAREDDKSRRQVDGFDAGKAPPFRIGDVRAAVPEHCWRKSPWRSLWYVVRDVAVVVALGAAAAAMDSWAVWPLYWAVQGTMFWAFFVLGHDCGHGSFSDNATLNSVVGHLLHSFILIPYHGWRISHRTHHQNHGHVDRDESWHPLTERRYRRLPPRAKKLRFTPPFPLLLFPLYLFYRSPGKRGSHFLPSSPLFSPKDKGDVILSTTCWCIMLAFLLAMSCAFGPLQVLKMYGVPYLVSVMWLDLVTYLHHHGHQERLPWYRGEEWSYLRGGLTTVDRDYGWINSIHHDIGTHVIHHLFPQIPHYHLVEATKAAKPVLGRYYREPHKSGPLPLHLLGVLLRSLRVDHFVSDHGDVVYYQTDHHLNDTTTDDAHKQK

SEQ ID NO: 17848 - DNA, 657 bp, Sorghum bicolor
  misc_feature: Ceres ANNOT ID no. 8682492
  misc_feature: Encodes the peptide sequence at SEQ ID NO 17849
atgccgaaatccaagcgcaaccgcccagtgaccttatcaaagaccaaaaagaagcctggtttagagcgcaagggcaaagtagtcgccgagatcaaagatgctatcgacaaatacagcagtgcctatgttttcacctatgataacatgaggaatcagaagctcaaggacctcagggagcagctcaaatcttctagcaggatatttcttgctggaaagaaggttatgcagatagcgttggggcgttcacctgctgatgaagctaaaacaggcctccacaaactttccaagttccttcaaggcgactctggtctgttcttcaccaatcttccaagggatgatgttgagaggatgtttcgagaatttgaggagcatgattttgcaaggacaggaagtactgccgcagagacggtggagcttaaagaaggtcctctggaacagttcacacatgagatggagccatttctacggaagcaaggacttccagttcgcttgaacaaagaccatgtagtttgtgaggaaggaaagcccctttcaccagaagcagcacagactctgatggcaacattccgtctataccttgtgtgccgctggtcgtgtgatgactttgaagtttacaaagaaggcttgatgcacctaggagctgatgattcctcttaa

SEQ ID NO: 17849 - protein, 218 aa, Sorghum bicolor
  misc_feature: Useful for making plants with modulated nitrogen use efficiency
  misc_feature: Functional homolog of the protein sequence given in SEQ ID NO 14581
  misc_feature: Ceres ANNOT ID no. 8682492
  misc_feature (19)..(123): Pfam ID: Ribosomal_L10 Pfam Description: Ribosomal protein L10
MPKSKRNRPVTLSKTKKKPGLERKGKVVAEIKDAIDKYSSAYVFTYDNMRNQKLKDLREQLKSSSRIFLAGKKVMQIALGRSPADEAKTGLHKLSKFLQGDSGLFFTNLPRDDVERMFREFEEHDFARTGSTAAETVELKEGPLEQFTHEMEPFLRKQGLPVRLNKDHVVCEEGKPLSPEAAQTLMATFRLYLVCRWSCDDFEVYKEGLMHLGADDSS

SEQ ID NO: 17850 - DNA, 1203 bp, Sorghum bicolor
  misc_feature: Ceres ANNOT ID no. 8682474
  misc_feature: Encodes the peptide sequence at SEQ ID NO 17851
atgacgaggcggccggcggcggatcaggtggtcgttcagcaggaggcggcggccaaggcgacggaggacatgaagagccggcagcaggtggtggacgccggcttcgacgccgggaagccgccgccgttccgcatcggcgacgtgcgcgcggcggtgccggagcactgctggcgcaagagcccctggcggtcgctgtggtacgtggcgcgcgacgtcgcggtggtggcggcgctgggcgcggcggcggcggccatggacagctgggcggtgtggccgctctactgggcggcgcaggggaccatgttctgggcgctattcgtcctgggacacgactgtgggcatgggagtttctcggacaacgcgacactgaacagcgtggtggggcatctcctacactccttcatcctcgtcccctaccatggatggaggatcagccacagaacacaccatcagaaccacggccacatccacagggacgagtcatggcatccgatcacggaggggctgtaccggcaactggagacgcgcaccaagaagctcagattcaccgtgcccttcccgctgctcgcattccctgtctacctcctgtaccggagccccggcaagacgggctcccactttcttcccagcagcgagctgttcagccccaaggagaagggcgacgtcatgctgtcaaccacctgctggtgcatcatgctcgcctccctcttcgccatggcgtgcgcgttcggtccagcccaggtgctcaagatgtacggcctcccataccttgtgtttgtgatgtggcttgacttggtgacgtacctgcaccaccatggccaccatgagcgcctcccctggtaccgcggcgaggagtggagctacctgcgcggcggcctgacgacggtggacagagactacggctggatcaacaagatccaccacgacatcggcacccatgtcatccatcacctcttcccgcagatcccgcactaccatctcgtcgaagctaccaaggcagccaagccggtgctggggcgatactaccgggagccacagaagtcagggccgctgccgcttcacctccttggcgtgcttctgagaagcctcagagtcgaccacttcgtcagcgaccatggcgatgttgtctactaccaaactgaccatgaattgaacactagtgctcccggctgggccgcccaaaaccatcataagcaaaaatga

SEQ ID NO: 17851 - protein, 400 aa, Sorghum bicolor
  misc_feature: Useful for making plants with modulated heat sensitivity
  misc_feature: Functional homolog of the protein sequence given in SEQ ID NO 13709
  misc_feature: Ceres ANNOT ID no. 8682474
  misc_feature (41)..(343): SWISSPROT Homolog: EC 1.14.99.33 Delta(12)-fatty acid dehydrogenase
  misc_feature (94)..(338): Pfam ID: FA_desaturase Pfam Description: Fatty acid desaturase
MTRRPAADQVVVQQEAAAKATEDMKSRQQVVDAGFDAGKPPPFRIGDVRAAVPEHCWRKSPWRSLWYVARDVAVVAALGAAAAAMDSWAVWPLYWAAQGTMFWALFVLGHDCGHGSFSDNATLNSVVGHLLHSFILVPYHGWRISHRTHHQNHGHIHRDESWHPITEGLYRQLETRTKKLRFTVPFPLLAFPVYLLYRSPGKTGSHFLPSSELFSPKEKGDVMLSTTCWCIMLASLFAMACAFGPAQVLKMYGLPYLVFVMWLDLVTYLHHHGHHERLPWYRGEEWSYLRGGLTTVDRDYGWINKIHHDIGTHVIHHLFPQIPHYHLVEATKAAKPVLGRYYREPQKSGPLPLHLLGVLLRSLRVDHFVSDHGDVVYYQTDHELNTSAPGWAAQNHHKQK

SEQ ID NO: 17852 - DNA, 1707 bp, Sorghum bicolor
  misc_feature: Ceres ANNOT ID no. 8682522
  misc_feature: Encodes the peptide sequence at SEQ ID NO 17853
atgtcaagctcaagcagcatcagttggtcatcgtactccccccttctcttgaccacccttgctctagttctcctctgctcccacctcaccattgccaaggagcagtaccatgagttcgaggtgaaggaggcgacagtgacgcggctatgcgggacgcagcggatcatgacggtgaacggggagttcccgggcccaacggtggaggtggccgagggcgacgcgctcatcgttcgcgtcgtgaaccggggcagctacaacgtgacggtgcactggcacggcgtgcggcagatgcgcacggggtggtccgacgggccggagttcgtgacgcagtgccccatccgccccggcaactcctacacctaccgcttcaccgtcgccgggcaggaaggcaccctgtggtggcacgcgcacagctcctggctccgcgccaccgtccacggcgcgctcctcatcaggccgcgcgccggcgtgccttacccgttcaacgacggggaatggtggaacatgaaccccatcgacgtcgtccgcaccgccacccgcaccggcgccgcccctaacatctccgacgccctcaccgtcaacggccagcccggcgacctctacaagtgctcctccaacggcacgacgacgttcgcggtgaagtccggcgagacgaacctgctgcgcttcatcaacgccgcactcaacacggagctcttcgtctccctggccggccacaccatgacggtggtgggcgccgacgcctcctacaccaaaccatacaccacgtcggtgctcatgatcgcgccggggcagaccaccgacgtgctcgtcaccttcgaccaggcccccggccgctactacctcgccgcgcgcgcctacgccagcgcgcagggcgtccccttcgacaacaccaccaccacggccatcttcgactacggcaccggtgccaccaccagcagccccgcgatgccgacgctcccggcctacaacgacacggcgacggcgacgacgttcacgacgagcctacgcggcctgcgcaaggcggagctgccgacgacgcgcgtcgacgagagcctcttcttcaccgtcggcgtcggcctcttcaactgctcgagcgggcagacctgcggcgggcccaacaacacgcggttcgcggcgagcatgaacaacgtctccttcgtgctcccgtccaccacctccatcctgcaggcgcactacgccagcggcggcgcgacgtcggcgcccgccggcgtgttcaccgccgacttcccggccaacccgccggtgacgttcgactacacggcgcagaacgtgagccgcgcgctgtggcagcccgtgccgggcaccaaggtgtacaggctcaagtacggcgccgccgtgcagctggtgctgcagggcaccaatgtgttcgccgccgagaaccaccccatccacctccatggctacgacttctacatcctcgccgaggggttcggcaacttcgatgcggcgacggacaccgcaaagttcaacatggatgatccgccgatgaggaacacggtgggcgtgccggtgaacgggtgggcggtcatccggttcgtggcggataatccgggggtgtggctgatgcactgccatttggatgtgcacatcacctggggcctcgccatggcgttcctggtggaggacggcgttggggagctggagtctctggaggcgccgccggcagacttgcctgtctgctga

SEQ ID NO: 17853 - protein, 568 aa, Sorghum bicolor
  misc_feature: Useful for making plants with altered carbohydrate content
  misc_feature: Functional homolog of the protein sequence given in SEQ ID NO 14465
  misc_feature: Useful for making plants with altered cell wall content and/or composition
  misc_feature: Functional homolog of the protein sequence given in SEQ ID NO 14582
  misc_feature: Ceres ANNOT ID no. 8682522
  misc_feature (32)..(568): SWISSPROT Homolog: EC 1.10.3.2 Laccase
  misc_feature (40)..(156): Pfam ID: Cu-oxidase_3 Pfam Description: Multicopper oxidase
  misc_feature (158)..(309): Pfam ID: Cu-oxidase Pfam Description: Multicopper oxidase
  misc_feature (416)..(552): Pfam ID: Cu-oxidase_2 Pfam Description: Multicopper oxidase
MSSSSSISWSSYSPLLLTTLALVLLCSHLTIAKEQYHEFEVKEATVTRLCGTQRIMTVNGEFPGPTVEVAEGDALIVRVVNRGSYNVTVHWHGVRQMRTGWSDGPEFVTQCPIRPGNSYTYRFTVAGQEGTLWWHAHSSWLRATVHGALLIRPRAGVPYPFNDGEWWNMNPIDVVRTATRTGAAPNISDALTVNGQPGDLYKCSSNGTTTFAVKSGETNLLRFINAALNTELFVSLAGHTMTVVGADASYTKPYTTSVLMIAPGQTTDVLVTFDQAPGRYYLAARAYASAQGVPFDNTTTTAIFDYGTGATTSSPAMPTLPAYNDTATATTFTTSLRGLRKAELPTTRVDESLFFTVGVGLFNCSSGQTCGGPNNTRFAASMNNVSFVLPSTTSILQAHYASGGATSAPAGVFTADFPANPPVTFDYTAQNVSRALWQPVPGTKVYRLKYGAAVQLVLQGTNVFAAENHPIHLHGYDFYILAEGFGNFDAATDTAKFNMDDPPMRNTVGVPVNGWAVIRFVADNPGVWLMHCHLDVHITWGLAMAFLVEDGVGELESLEAPPADLPVC

SEQ ID NO: 17854 - DNA, 642 bp, Sorghum bicolor
  misc_feature: Ceres ANNOT ID no. 8682503
  misc_feature: Encodes the peptide sequence at SEQ ID NO 17855
atggccgacagtggaaatgggagccgaagcagcagcagcagcagcagcagcccgccatgcgcatcgtgcaagctgctgcggcggcggtgcacacaggagtgcgtgttcgcgccatacttcccacccgaggaccctcacaagttcgccatcgtccacaaggtctttggcgccagcaatgtcagcaagatgctgcaggagctgcctgctcagcagagagcagacgcggtgagcagcctggtgtacgaggcgaacgcgcgcatgagggaccccgtgtacggctgcgtcggcgccatctcctacctccagcagcaggtctcccagctccaggtgcagctcgccctcgccaaggccgagatcctctgcgtccagatgcaccacgactacgagtcagcttcagctgctgctgctgccgcgccagctccggcaaagcaacaacaactccagcagcagcagcaggaggagatggaatgcgaggcttatggcaacctgctcgtgcagaatggcctgatgatgaacacgttgaacggtactggtgcagttcatcagcagcagaagcagatgctgggtggcttcggctctgcagggaacactgcaatgatgctccaggaggcgtgcctcaagaaagagtccctttgggcatga

SEQ ID NO: 17855 - protein, 213 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 14583
  misc_feature: Ceres ANNOT ID no. 8682503
MADSGNGSRSSSSSSSSPPCASCKLLRRRCTQECVFAPYFPPEDPHKFAIVHKVFGASNVSKMLQELPAQQRADAVSSLVYEANARMRDPVYGCVGAISYLQQQVSQLQVQLALAKAEILCVQMHHDYESASAAAAAAPAPAKQQQLQQQQQEEMECEAYGNLLVQNGLMMNTLNGTGAVHQQQKQMLGGFGSAGNTAMMLQEACLKKESLWA

SEQ ID NO: 17856 - DNA, 237 bp, Sorghum bicolor
  misc_feature: Ceres ANNOT ID no. 8682544
  misc_feature: Encodes the peptide sequence at SEQ ID NO 17857
atggacgcaagatatgttgctttaggcttctttctagtgcttgtcttacatgcaaatcctactttggcagaaacttgcaggcaatttgttaaaattcatccattttgcttcaagcctatgtgcaaagcaaattgttttattgaaggcaaatgctctgatggttcatatgtaaaggactacagatgtgaatcacatgcatttcactcggtgtgtgtttgctatttgtgcaaacattag

SEQ ID NO: 17857 - protein, 78 aa, Sorghum bicolor
  misc_feature: Useful for making plants with modulated salt sensitivity
  misc_feature: Functional homolog of the protein sequence given in SEQ ID NO 13500
  misc_feature: Ceres ANNOT ID no. 8682544
MDARYVALGFFLVLVLHANPTLAETCRQFVKIHPFCFKPMCKANCFIEGKCSDGSYVKDYRCESHAFHSVCVCYLCKH

SEQ ID NO: 17858 - DNA, 237 bp, Sorghum bicolor; identical to SEQ ID NO: 17856
  misc_feature: Ceres ANNOT ID no. 8682548
  misc_feature: Encodes the peptide sequence at SEQ ID NO 17859

SEQ ID NO: 17859 - protein, 78 aa, Sorghum bicolor; identical to SEQ ID NO: 17857
  misc_feature: Useful for making plants with modulated salt sensitivity
  misc_feature: Functional homolog of the protein sequence given in SEQ ID NO 13500
  misc_feature: Ceres ANNOT ID no. 8682548

SEQ ID NO: 17860 - DNA, 237 bp, Sorghum bicolor; identical to SEQ ID NO: 17856
  misc_feature: Ceres ANNOT ID no. 8682549
  misc_feature: Encodes the peptide sequence at SEQ ID NO 17861

SEQ ID NO: 17861 - protein, 78 aa, Sorghum bicolor; identical to SEQ ID NO: 17857
  misc_feature: Useful for making plants with modulated salt sensitivity
  misc_feature: Functional homolog of the protein sequence given in SEQ ID NO 13500
  misc_feature: Ceres ANNOT ID no. 8682549

SEQ ID NO: 17862 - DNA, 915 bp, Sorghum bicolor
  misc_feature: Ceres ANNOT ID no. 8682559
  misc_feature: Encodes the peptide sequence at SEQ ID NO 17863
atggacggcggaggcgcggcctcgctcgatgcggccttcgctggggccaccgtcgcggtcgcccctgccgggatcagggttgagaattgctacgtgttcaagagccgcctgcaggagtacgcgcagaaggttggcattacaaccctggagtaccataccctcaaagaaggcccgtctcatgaacccgtcttcaagtccacggtggttgttaacaacaccaggtatgagtcgctgcctgggttcttcagccggaaggctgcggaacagtcggccgcagaagttgcgctcatggagatacaagaaactggcctatgcaagaatcttcttcaggagtatgctcagaagatgaactacgccattccatcttatatttgcactaaacaagcttcaggtcctttcatatgcagtgttgagattggtggcatactatacattggtgctgcagctagaacaaagaagggggcagagataaaagctgcccgaactgctcttcttgcaatccagggtcaatcagaaattgttgcaaatggtgtcaaaaactacattgttgttcctggacaaaggccgattaaggagacagataaaaagccaattggaacccccaaaccacttaaagtcaagaaacgtggttccaagaggaaatggaacaagcggaaattcatggggatggctaaccaaattgctgaagaggatgtacaggaggggcatgaaatgcttctacagtatgactctgagaattctagaagaatagaatatgagttacctggagatactgcaatggttcaatttaacaaggaagctataatgatgcaacctggtgaaggggatatgatagtacaactggagccacccagcgatcctgcagaggtccaacataacaaggaagctacgcacccagcaacgctgaagtggtga

SEQ ID NO: 17863 - protein, 304 aa, Sorghum bicolor
  misc_feature: Useful for making plants with altered lignin content
  misc_feature: Functional homolog of the protein sequence given in SEQ ID NO 14584
  misc_feature: Ceres ANNOT ID no. 8682559
  misc_feature (33)..(101): SWISSPROT Homolog: EC 3.1.26.3 Ribonuclease III
  misc_feature (33)..(99): Pfam ID: dsrm Pfam Description: Double-stranded RNA binding motif
  misc_feature (105)..(167): Pfam ID: dsrm Pfam Description: Double-stranded RNA binding motif
MDGGGAASLDAAFAGATVAVAPAGIRVENCYVFKSRLQEYAQKVGITTLEYHTLKEGPSHEPVFKSTVVVNNTRYESLPGFFSRKAAEQSAAEVALMEIQETGLCKNLLQEYAQKMNYAIPSYICTKQASGPFICSVEIGGILYIGAAARTKKGAEIKAARTALLAIQGQSEIVANGVKNYIVVPGQRPIKETDKKPIGTPKPLKVKKRGSKRKWNKRKFMGMANQIAEEDVQEGHEMLLQYDSENSRRIEYELPGDTAMVQFNKEAIMMQPGEGDMIVQLEPPSDPAEVQHNKEATHPATLKW

SEQ ID NO: 17864 - DNA, 981 bp, Sorghum bicolor
  misc_feature: Ceres ANNOT ID no. 8682634
  misc_feature: Encodes the peptide sequence at SEQ ID NO 17865
atggccaccactgatcgtgcatcatcatcatcagctgctgctctcctcttgctgctcctggcgctcgccgtcgccggcacctcgtcggcgcagctgtccacgggcttctactcctactcctgccccggcgtctacggcgccgtcaagtcggtgatgaaatccgccatcgccaacgagaagcgcatgggcgcctccatcgtccgcctcttcttccacgactgcttcgtccagggctgcgacgcgtcgctgctgctggacgacacggccaccttccagggcgagaagatggcgacgcccaacaacggctccgtgcgaggcttcgaggtcatcgacgccgtcaagtcggccgtcgagaaggtctgccccggcgtcgtctcctgcgccgacatcctcgccatcgccgccagggacagcgtcgtcatcctgggcgggccgagctgggacgtcaaggtcgggcggcgggactcgacgacggcgagcttcagcggcgccaacaacaacatcccgccgccgacgtcggggctcgccaacctcacctcgctcttcgccgcgcagggactctctcaaaaggacatggtcgcgctctctggtgctcacaccattgggcaagcacgttgcaccaacttcagagcccacatatacaacgacaccgacatcaactctgcctttgcaaaaacaaggcaatcaggttgcccaagcacctcaggtgcaggtgacaacaatttggcaccattggaccttcaaacccctactgtctttgagaacaactactacaagaaccttcttagcaagaaggggcttctacactctgaccaagagctcttcaatggtggagccaccgacacgctggtccaatcctatgttggtagccagagcacatttttcacagattttgtgacgggtatgattaagatgggtgacatcacaccattgacgggctccaatggccagataagaaagaactgcagaagagttaattag

SEQ ID NO: 17865 - protein, 326 aa, Sorghum bicolor
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13662
  misc_feature: Ceres ANNOT ID no. 8682634
  misc_feature (31)..(326): SWISSPROT Homolog: EC 1.11.1.7 Peroxidase
  misc_feature (48)..(290): Pfam ID: peroxidase Pfam Description: Peroxidase
MATTDRASSSSAAALLLLLLALAVAGTSSAQLSTGFYSYSCPGVYGAVKSVMKSAIANEKRMGASIVRLFFHDCFVQGCDASLLLDDTATFQGEKMATPNNGSVRGFEVIDAVKSAVEKVCPGVVSCADILAIAARDSVVILGGPSWDVKVGRRDSTTASFSGANNNIPPPTSGLANLTSLFAAQGLSQKDMVALSGAHTIGQARCTNFRAHIYNDTDINSAFAKTRQSGCPSTSGAGDNNLAPLDLQTPTVFENNYYKNLLSKKGLLHSDQELFNGGATDTLVQSYVGSQSTFFTDFVTGMIKMGDITPLTGSNGQIRKNCRRVN

SEQ ID NO: 17866 - DNA, 723 bp, Sorghum bicolor
  misc_feature: Ceres ANNOT ID no. 8682694
  misc_feature: Encodes the peptide sequence at SEQ ID NO 17867
atggatcctctccacccgcgcgatctcgccatggacgacacgcgccagcaccagcacctccgcccgcgccacgccgcggggggccgcatggtccgcgtccgcttcgccgattccgaggccaccgattccgactcctccgacgaatgccaccgccagcgccaccgcctcctccaccagatcggccagccgctcccttcctcccccgcccctgccccgcaaaggaaccgcctttcccggaccggagaccggccgttccgcggcgtgcggcggcggccgtggggcaagtacgcggcggagatccgcgacccggggctcgcggggaagcgccgctggctagggaccttcgacaccgccgaggaggccgccgccgtctacgacgccgccgcgctccgtatccgcggccgccgcgccgtcaccaacttcccctcctcccccgccgccgtcgcgccggcgccggcgcctgcccttgccgcgcctcgttccaacccgtccccggcccctgaggctgagacctcctcggcctcgacggtggtcgacgccgggactggcggcgacgacgaggtcaccggggtgcctccgacgccgccgtggttcggggaaggcggaccgctggagctcttggacttcggcctgcctcccgcggcgacgaagcggggccagtgggaggaggaggagttcggcgatctgggtgacctcgaccacctcttcgacctgcctttctga

SEQ ID NO: 17867 - protein, 240 aa, Sorghum bicolor
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: Useful for making plants with altered lignin content
  misc_feature: Functional homolog of the protein sequence given in SEQ ID NO 13219
  misc_feature: Ceres ANNOT ID no. 8682694
  misc_feature (83)..(135): Pfam ID: AP2 Pfam Description: AP2 domain
MDPLHPRDLAMDDTRQHQHLRPRHAAGGRMVRVRFADSEATDSDSSDECHRQRHRLLHQIGQPLPSSPAPAPQRNRLSRTGDRPFRGVRRRPWGKYAAEIRDPGLAGKRRWLGTFDTAEEAAAVYDAAALRIRGRRAVTNFPSSPAAVAPAPAPALAAPRSNPSPAPEAETSSASTVVDAGTGGDDEVTGVPPTPPWFGEGGPLELLDFGLPPAATKRGQWEEEEFGDLGDLDHLFDLPF

SEQ ID NO: 17868 - DNA, 1233 bp, Sorghum bicolor
  misc_feature: Ceres ANNOT ID no. 8682724
  misc_feature: Encodes the peptide sequence at SEQ ID NO 17869
atgggcaactgcggcacgcgggaggagaatgccgtcgtcgcggcgcacgcgcaagttcagcagctccacttgttacaacatcctctcaagaacgccaatgcagataggaagcacacccgcacctcatcagatataagtgatccttccacacctaggaatgttgaagatgccaagaacatttccatatacaacgatgtgattgccttcacattgtttgagctagagacaatcacaaagagcttccgtgctgattatgttcttggcgaaggaggatttgggaccgtttacaagggttacatagatgaaaatgtcagggttgggctgaaatcactgcctgttgcagtcaaggtgctcaacaaagatggacatcaagggcacagagaatggcttaccgaagttaactgcctggggcagttgaggcatccaaatttggtgaagttgattggatattgctgtgaagatgaccatcggctgcttgtctacgagttcatgtttcgaggaagtctagaaaaccacttattccgaaagacagctacaccattaccctggggtactaggatgtcaatcgcactgggagctgctaaagggcttgcttgcctccacaatgctcaaaggcctgtaatctacagagatttcaagacatcaaatattctgctggactctgattatactgctaaactgtctgactttggcctggcaaaagctggccctgaaggtgatcagacgcatgtatcaacaagggtgatgggaacctacggttatgctgcccctgaatatgtgatgactggtcacttgactgctagaagtgatgtctacagctttggcgttgtccttctggagctcttgacagggcgcaagtcaattgacaaatcacggcccagcagggagcagagcctggttgactgggccctccccaaactcaatgacaagaggaggcttctccagatcattgacccaaaactggaggggcagtattcggtcagagctgctcacaaggcctgcagccttgcattctactgcttgagccagaaccccaaggctaggccgcttatgagtgacgtcgtcgaaaccctcgaaccattgcagggcagcagtgggagtgacggatccggtcagtcttctggccttcctgactatagaggccgccgcaggctaaccgggaacagtgttcacttcagggccatcccaaaccccaagtgctcccctgctgtcccggcttgcagagtgcggtga

SEQ ID NO: 17869 - protein, 410 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8682724
  misc_feature (42)..(359): SWISSPROT Homolog: EC 2.7.11.1 Non-specific serine/threonine protein kinase
  misc_feature (81)..(358): Pfam ID: Pkinase Pfam Description: Protein kinase domain
MGNCGTREENAVVAAHAQVQQLHLLQHPLKNANADRKHTRTSSDISDPSTPRNVEDAKNISIYNDVIAFTLFELETITKSFRADYVLGEGGFGTVYKGYIDENVRVGLKSLPVAVKVLNKDGHQGHREWLTEVNCLGQLRHPNLVKLIGYCCEDDHRLLVYEFMFRGSLENHLFRKTATPLPWGTRMSIALGAAKGLACLHNAQRPVIYRDFKTSNILLDSDYTAKLSDFGLAKAGPEGDQTHVSTRVMGTYGYAAPEYVMTGHLTARSDVYSFGVVLLELLTGRKSIDKSRPSREQSLVDWALPKLNDKRRLLQIIDPKLEGQYSVRAAHKACSLAFYCLSQNPKARPLMSDVVETLEPLQGSSGSDGSGQSSGLPDYRGRRRLTGNSVHFRAIPNPKCSPAVPACRVR

SEQ ID NO: 17870 - DNA, 1194 bp, Sorghum bicolor
  misc_feature: Ceres ANNOT ID no. 8682752
  misc_feature: Encodes the peptide sequence at SEQ ID NO 17871
atgcctagccccagccctagccgcagcagcagtagctgctgcagagtggccgccgttccaaacctaaacctcccagcggggttccgtttccaccccactgacgaggagctcatcgtccactacctcatgaaccaggccgcctccatcccttgccctgtccccatcatcgccgaggtcaacatctaccagtgcaacccctgggatctccccgccaaggcgctgttcggcgagagcgagtggtacttcttcagcccacgggacagaaaataccccaacggcgcgcgccccaaccgcgccgccgggtcggggtactggaaggccaccggcaccgacaaggccatcatgtccacgcccaccggccagaacatcggcgtcaagaaggcgctcgtcttctacggcggccggccgcccaggggcgtcaagaccgactggatcatgcacgagtaccgcctcgtcaccgccgacgccgacggcaagacaacggcggccaagcgcagaggaggatccatgaggctggacgactgggtgctgtgcaggatccacaagaagagcaacgacttccagttccagttgttgtcggagcaggagcaggatggctcttccaccgtagagcaggaatccccaaagtcagaatcacttgagcaggagcagttccagttccagttgcatcagacaacgacgctgacgatgaccaagtcgtgctcgctcaccgacctgctcaacagcatcgactactcggcgctgtcgcagatcctggccgatggccctgttgatggcaaccaagaacaactgccgcagccgcagcagaaccctcctcctctaatctacacaactacaacacatgaaacgcaccaagcactaataaacaactataacaacaacaacaacaacaacaagttgaacaacagccacttaaattatttgccacacacaaacgcggcatgttcagattatgtcgtcgttgctaataataactatgacaacggtgtgaacaagaggaaacggatgatgatgatgacagccgccggcgccatggacgagggtgcaggcagcaacggtttcagtaagaaactgaaggcggtgctgccaactgattcaaagaacagcagctactgcaaccagcaggttgtggacacgagtgggttgtttcagtacagcagcctgctcagctacccattcctggagatgcagtag

SEQ ID NO: 17871 - protein, 397 aa, Sorghum bicolor
  misc_feature: The sequence is a functional homolog of SEQ ID NO 2110 in the 10/374,780 US patent application
  misc_feature: The sequence is a functional homolog of SEQ ID NO 304 in the 10/225,066 US patent application
  misc_feature: The sequence is a functional homolog of SEQ ID NO 954 in the 11/435,388 US patent application
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated water use efficiency
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 890 in the 10/374,780 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Useful for making plants with altered terpenoid content
  misc_feature: Functional homolog of the protein sequence given in SEQ ID NO 13966
  misc_feature: The sequence is a functional homolog of SEQ ID NO 852 in the 10/374,780 US patent application
  misc_feature: Useful for making plants with modulated nitrogen use efficiency
  misc_feature: Functional homolog of the protein sequence given in SEQ ID NO 13624
  misc_feature: Ceres ANNOT ID no. 8682752
  misc_feature (24)..(152): Pfam ID: NAM Pfam Description: No apical meristem (NAM) protein
MPSPSPSRSSSSCCRVAAVPNLNLPAGFRFHPTDEELIVHYLMNQAASIPCPVPIIAEVNIYQCNPWDLPAKALFGESEWYFFSPRDRKYPNGARPNRAAGSGYWKATGTDKAIMSTPTGQNIGVKKALVFYGGRPPRGVKTDWIMHEYRLVTADADGKTTAAKRRGGSMRLDDWVLCRIHKKSNDFQFQLLSEQEQDGSSTVEQESPKSESLEQEQFQFQLHQTTTLTMTKSCSLTDLLNSIDYSALSQILADGPVDGNQEQLPQPQQNPPPLIYTTTTHETHQALINNYNNNNNNNKLNNSHLNYLPHTNAACSDYVVVANNNYDNGVNKRKRMMMMTAAGAMDEGAGSNGFSKKLKAVLPTDSKNSSYCNQQVVDTSGLFQYSSLLSYPFLEMQ

SEQ ID NO: 17872 - DNA, 441 bp, Sorghum bicolor
  misc_feature: Ceres ANNOT ID no. 8682739
  misc_feature: Encodes the peptide sequence at SEQ ID NO 17873
atggatcatcatctcgagcaacaagcagcagagagcgagaagaaggcggcagtgaagctgctgggcttctgggcaagcccctacgtgctccaggtgaaatgggcgctagcgatgaagggcgtcgagtacgagtacacggaggaggatctccggagcaagagcgccgagctgctggcgtacaaccccgtgcacaagaaagtccccgtgctggtctaccatggcaggcccatcgccgagtcgcaggtcatcctcgagttcatcgacgaggcctggaaccaccgcggcgaccccatcctccctcgcgacccctaccagcgcgccatggcccgtttccgggccaggttccagcaggaaaaggtctcaggactctcggtcatcttctgctatactaggacatttgaccagacattgaccatgcatgaatcgaagattttgagatga

SEQ ID NO: 17873 - protein, 146 aa, Sorghum bicolor
  misc_feature: Useful for making plants with modulated drought sensitivity
  misc_feature: Functional homolog of the protein sequence given in SEQ ID NO 13370
  misc_feature: Useful for making plants with modulated biomass
  misc_feature: Functional homolog of the protein sequence given in SEQ ID NO 12911
  misc_feature: Ceres ANNOT ID no. 8682739
  misc_feature (22)..(126): SWISSPROT Homolog: EC 2.5.1.18 Glutathione transferase
  misc_feature (16)..(89): Pfam ID: GST_N Pfam Description: Glutathione S-transferase, N-terminal domain
MDHHLEQQAAESEKKAAVKLLGFWASPYVLQVKWALAMKGVEYEYTEEDLRSKSAELLAYNPVHKKVPVLVYHGRPIAESQVILEFIDEAWNHRGDPILPRDPYQRAMARFRARFQQEKVSGLSVIFCYTRTFDQTLTMHESKILR

SEQ ID NO: 17874 - DNA, 1860 bp, Sorghum bicolor
  misc_feature: Ceres ANNOT ID no. 8682756
  misc_feature: Encodes the peptide sequence at SEQ ID NO 17875
atggggacgacgacgtcgtacaagtgctgctgctttcactgttgggacggcgcgtcgccgccgcccaaggccccgccaccgcccaaggacgttggcgccctcttctccctctacgccggcggaggccccggcggcgctcctcatcacatggatgaagatggcctccgccggtacctcagcgtctaccaaggcgaaggcaccaacgtcgaacacctgcttgagcagatccgccggcagcagctcttcaccctcgacgacttccaccgcatcgtcgtcttctccgacgagctcaacccgcccatccggcaccaacaccgtgtccaccacgacatgacgctgcctctctcccattacttcatctactcgggacacaacccctactatcacgcatggcggccggaccaacggcggcgccgcagcagcagcggccgcagtgacggatccatcatcagagagctcaagatgggggtacgagccatcgaggtcgccatgtggccctattcgaaaggggatgacatccaaatccaccacggctggaacaccccagttttactgactcagtgcttgaaatccatcaagaaatacgcctttttggcgtctccctatcctgttatcataaggcttgaagacaaccttcaatcgactaacctccaaaaaaaagctgccaagtggccttttatcgattattttgatttacatgtcaacactgacagtaacaagcccctcaaaaatttcccatcacctgaagagctcaagggtcgtgtactcctctcaacaaaaacccccacccctatcctcaaaaaggaaaaatccaagcccaacgaggttgatgaatcaatggttgatgacaccattgaaaagggcgatgctcaacttcaacgtggcaaaggagctgacgacgatgatgcagcatgggggccagaagtaccggattttcagactgaaatccagtctgctaaaaagcatgacagtgatgtctcgacacgccaaagacaacgccaacgtatcgacgacaatgctgatgacgatcagaaagaacagaaaatgcagccacaagaatatccactgtatcgccacctgattacaattcgagcagagaagcagaaaggttctcttagtgatccggacaaagttaggcgtctcagttggagtgaaaaacaaattcagaaagcagcagaggatcttggcaccacaatagtgaggttcacacagagaaatatactgtggataaacccaagtttctccaccaagggctaccgaaggcccactcacctttcatccaattacaacccatttcttggctggctgcatggtgctcaaatggtggccctgaatatggaggaatacggaagagccctttggctaatgcatggattttacagagccaatggtggttgtggctatgtgaggaaaccagacttcctaatggtaacagagcccgaagtttttgatccaagagcaagctatgatgtgtttacaaccttgaaggtaaaagtatacatgggcgatggttggcggatggactttaagcacacacaagctccagatttttggacatcgattgggataactggagtgccaaaagacactacgacgatgaagaatagcaaggccacagagaatacatggattcccgtgtgggggcatgaattcagcttccctttgacagtccccgagattgctttgcttcgggtggaggtgcaccagtacaacgtgtctgagaaagacgtctttggtgggcagaccgtgttgccggtatgggagctgcgaccgggcatccgagcagtagcgctcttcgaccggcaggggaacagattcacgaacaacgttaagctcctgatgcgtttcgagtttgtttga

SEQ ID NO: 17875 - protein, 619 aa, Sorghum bicolor
  misc_feature: Useful for making plants with modulated water use efficiency
  misc_feature: Functional homolog of the protein sequence given in SEQ ID NO 13598
  misc_feature: Ceres ANNOT ID no. 8682756
  misc_feature (382)..(603): SWISSPROT Homolog: EC 3.1.4.11 Phosphoinositide phospholipase C
  misc_feature (111)..(261): Pfam ID: PI-PLC-X Pfam Description: Phosphatidylinositol-specific phospholipase C, X domain
  misc_feature (495)..(583): Pfam ID: C2 Pfam Description: C2 domain
  misc_feature (358)..(476): Pfam ID: PI-PLC-Y Pfam Description: Phosphatidylinositol-specific phospholipase C, Y domain
MGTTTSYKCCCFHCWDGASPPPKAPPPPKDVGALFSLYAGGGPGGAPHHMDEDGLRRYLSVYQGEGTNVEHLLEQIRRQQLFTLDDFHRIVVFSDELNPPIRHQHRVHHDMTLPLSHYFIYSGHNPYYHAWRPDQRRRRSSSGRSDGSIIRELKMGVRAIEVAMWPYSKGDDIQIHHGWNTPVLLTQCLKSIKKYAFLASPYPVIIRLEDNLQSTNLQKKAAKWPFIDYFDLHVNTDSNKPLKNFPSPEELKGRVLLSTKTPTPILKKEKSKPNEVDESMVDDTIEKGDAQLQRGKGADDDDAAWGPEVPDFQTEIQSAKKHDSDVSTRQRQRQRIDDNADDDQKEQKMQPQEYPLYRHLITIRAEKQKGSLSDPDKVRRLSWSEKQIQKAAEDLGTTIVRFTQRNILWINPSFSTKGYRRPTHLSSNYNPFLGWLHGAQMVALNMEEYGRALWLMHGFYRANGGCGYVRKPDFLMVTEPEVFDPRASYDVFTTLKVKVYMGDGWRMDFKHTQAPDFWTSIGITGVPKDTTTMKNSKATENTWIPVWGHEFSFPLTVPEIALLRVEVHQYNVSEKDVFGGQTVLPVWELRPGIRAVALFDRQGNRFTNNVKLLMRFEFV

SEQ ID NO: 17876 - DNA, 267 bp, Sorghum bicolor
  misc_feature: Ceres ANNOT ID no. 8682778
  misc_feature: Encodes the peptide sequence at SEQ ID NO 17877
atggcgaacggcacggcggcggcgaggagcaaggaggcgaaggtggtgcactaccgggagtgccagcgcaaccacgcggcgtccatcggcgggcacgccgtggacgggtgccgggagttcatggcgtcgggcgcggagggcacggcggcggcgatggcgtgcgcggcctgcgggtgccaccgcagcttccacaggcgcgaggtggaggccggcggcgacgacgaccgcgactgctcctccacctccacctccaccacctccggttga

SEQ ID NO: 17877 - protein, 88 aa, Sorghum bicolor
  misc_feature: The sequence is a functional homolog of SEQ ID NO 14 in the 10/714,887 US patent application
  misc_feature: The sequence is a functional homolog of SEQ ID NO 14 in the 11/435,388 US patent application
  misc_feature: The sequence is a functional homolog of SEQ ID NO 626 in the 10/666,642 US patent application
  misc_feature: Ceres ANNOT ID no. 8682778
  misc_feature (13)..(72): Pfam ID: ZF-HD_dimer Pfam Description: ZF-HD protein dimerisation region
MANGTAAARSKEAKVVHYRECQRNHAASIGGHAVDGCREFMASGAEGTAAAMACAACGCHRSFHRREVEAGGDDDRDCSSTSTSTTSG

SEQ ID NO: 17878 - DNA, 1206 bp, Sorghum bicolor
  misc_feature: Ceres ANNOT ID no. 8682808
  misc_feature: Encodes the peptide sequence at SEQ ID NO 17879
atgcgtgggctcatttgggtttgcgcccagcggcccacttacagccttcttacattttttagagagagattcaagctttggattcccggatcctgtgccatcggtctttacggagagcgtaatccagcgagcgtagagttgaaagctgtgaaagtggagatgagtactctgaagaaatccgacaagaaagctgccctcgacttcgcagcgtggagtttcaatgtcaccacatcggttggaatcatcatggttaacaaggcgctgatggctacgtatgggttcagtttcgccacgacattaactgggcttcattttgtgactactaccttgatgactatcgtatttcgatggttaggcctgagccagccatcccacttacccctagcagatctagttaaatttgtgatattttcaaacttgtcaattgttgggatgaatgtgagcttgatgtggaactctgtgggcttttatcagatagcaaagctgtgcatgatacctgcatcatgtcttctggaggttgtctttgatcatgtacattattcccgggacacaaagctgagcataatggtcgtgcttataggagttgcagtctgcacggttactgatgtcagtgtgaatgcaagaggtctaatcgcagctgttatagctgtttggagcacagctttgcaacaatactatgtccattttctccaacgcaagtactctctgaactcattcaacctcctgggccacactgctccagcccaagctgggtcactcctgctagtgggaccatttgtagattacttgttgacaggcaaaagggtggatcacttcagtttctcatcacttgctctgtttttcctggcactctcatgcttcattgccattggcgttaatctgagccaattcatctgcattgggcggttctctgctgtatccttccaagtcctaggccacatgaagaccgtacttgttctgtcccttgggtttcttttctttggcaaggagggcctgaatcttcaggtagtccttgggatggttctggccgttcttggaatgatatggtatggcaacgcatctgctaaaccaggcggcaaagagcggcgcagcatcctgccggctgattttcaattgtttacgaagtggttagacattgtcgattgcaaaaacacagttaatattcctcaagaaattaaagtaattaacatactgttttctgcataa

SEQ ID NO: 17879 - protein, 401 aa, Sorghum bicolor
  misc_feature: Useful for making plants with altered cell wall content and/or composition
  misc_feature: Functional homolog of the protein sequence given in SEQ ID NO 13788
  misc_feature: Ceres ANNOT ID no. 8682808
  misc_feature (209)..(352): Pfam ID: TPT Pfam Description: Triose-phosphate Transporter family
MRGLIWVCAQRPTYSLLTFFRERFKLWIPGSCAIGLYGERNPASVELKAVKVEMSTLKKSDKKAALDFAAWSFNVTTSVGIIMVNKALMATYGFSFATTLTGLHFVTTTLMTIVFRWLGLSQPSHLPLADLVKFVIFSNLSIVGMNVSLMWNSVGFYQIAKLCMIPASCLLEVVFDHVHYSRDTKLSIMVVLIGVAVCTVTDVSVNARGLIAAVIAVWSTALQQYYVHFLQRKYSLNSFNLLGHTAPAQAGSLLLVGPFVDYLLTGKRVDHFSFSSLALFFLALSCFIAIGVNLSQFICIGRFSAVSFQVLGHMKTVLVLSLGFLFFGKEGLNLQVVLGMVLAVLGMIWYGNASAKPGGKERRSILPADFQLFTKWLDIVDCKNTVNIPQEIKVINILFSA

SEQ ID NO: 17880 - DNA, 1254 bp, Sorghum bicolor
  misc_feature: Ceres ANNOT ID no. 8682794
  misc_feature: Encodes the peptide sequence at SEQ ID NO 17881
atggacatggagagatctcagcagcagaagtctccgacggagtctccgccgccgccgtcgccgtcgtcctcctcgtcctctgtctccgcggacaccgtcctgccccctcccgggaagaggcggagggcggcaacgacggccaaggccaaggccggcgccaagcctaagagggcccgtaaggacgccgccgccgcggctgatcctcctcctcctcccgccgccgccgccgccgggaagaggagctccgtctacaggggagtcaccaggcacaggtggacggggaggttcgaggcgcatctctgggacaagcactgcctcgccgcgctccacaacaagaagaaaggcaggcaaggggcgtatgacagcgaggaggcagctgctcgtgcctatgaccttgcagctctcaagtactggggtcctgagaccctgctcaacttccctgtggaggattactccagcgagatgccggagatggagggcgtgtcccgggaggagtacctggcctccctccgccgcaggagcagcggcttctccaggggcgtctccaagtacagaggcgtcgccaggcatcaccacaacgggaggtgggaggcacggattgggcgagtctttgggaacaagtacctctacttgggaacatttgacactcaagaagaggcagccaaggcctatgatcttgcggccattgaataccgaggtgtcaatgctgtaaccaacttcgacattagctgctacctggaccacccactgttcctggcgcagctccaacaggaaccacaggtggtgccagcactcaaccaagaagctcaacctgatcagagcgaaacagaaactatagcccaagagtctgtgtcaagcgaagcgaagacaccagatgacaatgcagaacctgatgacaatgcagagcctgatgacatcgcggagcccctcatcacagtcgacgacagcatcgaagagagcttatggagcccttgcatggattatgagctagacaccatgtcaaggtctaactttggcagctcgattaatctgagcgagtggttcaatgatgcagacttcgacagcaacattggatgcctgttcgatgggtgttctgcggttgatgaaggcggcaaggatggtgtaggcctggcagatttcagtctgttggaagatttcagtctgtttgaagcaggtgatggtcagctgaaggatgttctttcagatatggaagagggaatccaacctccaacaatgatcagtgtgtgcaattga

SEQ ID NO: 17881 - protein, 417 aa, Sorghum bicolor
  misc_feature: The sequence is a functional homolog of SEQ ID NO 320 in US patent 7157621
  misc_feature: Useful for making plants with altered lignin content
  misc_feature: Useful for making plants with modulated drought sensitivity
  misc_feature: Functional homolog of the protein sequence given in SEQ ID NO 14199
  misc_feature: The sequence is a functional homolog of SEQ ID NO 1311 in the 10/374,780 US patent application
  misc_feature: The sequence is a functional homolog of SEQ ID NO 1456 in the 10/412,699 US patent application
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: Useful for biocontainment applications
  misc_feature: Functional homolog of the protein sequence given in SEQ ID NO 13650
  misc_feature: Ceres ANNOT ID no. 8682794
  misc_feature (182)..(234): Pfam ID: AP2 Pfam Description: AP2 domain
  misc_feature (82)..(140): Pfam ID: AP2 Pfam Description: AP2 domain
MDMERSQQQKSPTESPPPPSPSSSSSSVSADTVLPPPGKRRRAATTAKAKAGAKPKRARKDAAAAADPPPPPAAAAAGKRSSVYRGVTRHRWTGRFEAHLWDKHCLAALHNKKKGRQGAYDSEEAAARAYDLAALKYWGPETLLNFPVEDYSSEMPEMEGVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEAQPDQSETETIAQESVSSEAKTPDDNAEPDDNAEPDDIAEPLITVDDSIEESLWSPCMDYELDTMSRSNFGSSINLSEWFNDADFDSNIGCLFDGCSAVDEGGKDGVGLADFSLLEDFSLFEAGDGQLKDVLSDMEEGIQPPTMISVCN

SEQ ID NO: 17882 - DNA, 1950 bp, Sorghum bicolor
  misc_feature: Ceres ANNOT ID no. 8682811
  misc_feature: Encodes the peptide sequence at SEQ ID NO 17883
atgggtaccggcaaggacgcagcccctcgcgccatcctctgcttcttgtttctgttctgcttaggctgcaaatgcctggcatcagagttggaggccacccagacggcgaccctcacggtcgatgcctcgccgcagcttgctcggaagatccctgatacactatttgggatcttctttgaggagatcaaccatgcaggagctggtggcatatgggctgaacttgttagtaacagagggtttgaagctggaggcctccatactccatcaaacattgacccatggtccatcattggagatgactcttctatatatgtggagactgatcggacatcatgtttcagtcgaaacatcattgctctgaggatggaggtcctttgcgataactgtcctactggtggtgttggtatttacaacccagggttctggggcatgaacatagaagatggaaaggcctacaatcttgttatgtatgttaagtcaccagaaacaaccgacttgatagtttcactaacaagctctgatgggttgcaaaatctggcttcagctacaataacagtttccggcgaatcaaattggacaaaagtggagcaaaagttggttgctaaaggaaccaatagaacctcaaggcttcaaataacaactaacaagaaaggagttgtttggtttgatcaagtatcactcatgcctgaagacacatacaagggacatggctttcgcacagaacttatatccatgattttggatttaaaaccacgattcttgagatttcctggaggttgctttgtagaaggtgagtggttaagaaatgcctttaggtggagagaatctattggtccatgggaagagagacctggacacttcggggatgtttggcattactggactgatgatggccttggatactatgaatttcttcagaaagttccctcttgtaactcaggagtcagccacaatgatgaagttgatactgctgctattgctccttttgtaaaggatgtattggacagcatagaatttgcaagggggagtgcaaattcaacatggggctctgttagggctgcaatggggcaccctgaaccattcccagtgaaatatgttgcgattggaaatgaagattgtgggaaaaaattttaccgcggtaactacctgaagttctacaatgctataagacaggcctacccagacattcaaatgatttcaaactgcgatggttcatctacaccacttgatcatcctgctgatttgtacgacttccatgtctatactgattctaagactttgttcaacatgaagagtacatttgacagaacatctcgcagtggacccaaggcttttgtgagtgagtacgctgtttggagaggtgatgcaggtagaggaagtcttcttgcttcattggcagaagctgctttccttactggactggagaagaatagtgacattgtttacatggcgagttatgcaccactgttcgtaaataacaatgaccaaacgtggaacccagacgctatcgtcttcaactcctggcagcattacggcactcctagttactggatgcagacgcttttccgtgagtctagtggtgctatgttacatccaactacaatcagctccagctactctggttcgctcgcagcgtctgcgattacctggcaggactcagagaacagcttccttagagtaaaggtcataaactttgggtcagatgctgtgaccctgacaatctccacgactggactccaggccagtatcaacgctctgggatcaaccgccactgttctcacatcagcaaacgtgatggatgaaaattccttcagtaacccaaccaaggttgtgccggtgaagagcgatatgagcaatgctgcagagcagatgcaggtcacgttggctcctcactccttcagctcgttcgatctcgccctggctcagtccaaacttgtcgccgagatgtga

SEQ ID NO: 17883 - protein, 649 aa, Sorghum bicolor
  misc_feature: Useful for making plants with altered carbohydrate content
  misc_feature: Functional homolog of the protein sequence given in SEQ ID NO 13917
  misc_feature: Useful for making plants with altered cell wall content and/or composition
  misc_feature: Functional homolog of the protein sequence given in SEQ ID NO 13604
  misc_feature: Ceres ANNOT ID no. 8682811
  misc_feature (37)..(533): SWISSPROT Homolog: EC 3.2.1.55 Alpha-N-arabinofuranosidase
  misc_feature (447)..(632): Pfam ID: Alpha-L-AF_C Pfam Description: Alpha-L-arabinofuranosidase C-terminus
  misc_feature (72)..(230): Pfam ID: CBM_4_9 Pfam Description: Carbohydrate binding domain
MGTGKDAAPRAILCFLFLFCLGCKCLASELEATQTATLTVDASPQLARKIPDTLFGIFFEEINHAGAGGIWAELVSNRGFEAGGLHTPSNIDPWSIIGDDSSIYVETDRTSCFSRNIIALRMEVLCDNCPTGGVGIYNPGFWGMNIEDGKAYNLVMYVKSPETTDLIVSLTSSDGLQNLASATITVSGESNWTKVEQKLVAKGTNRTSRLQITTNKKGVVWFDQVSLMPEDTYKGHGFRTELISMILDLKPRFLRFPGGCFVEGEWLRNAFRWRESIGPWEERPGHFGDVWHYWTDDGLGYYEFLQKVPSCNSGVSHNDEVDTAAIAPFVKDVLDSIEFARGSANSTWGSVRAAMGHPEPFPVKYVAIGNEDCGKKFYRGNYLKFYNAIRQAYPDIQMISNCDGSSTPLDHPADLYDFHVYTDSKTLFNMKSTFDRTSRSGPKAFVSEYAVWRGDAGRGSLLASLAEAAFLTGLEKNSDIVYMASYAPLFVNNNDQTWNPDAIVFNSWQHYGTPSYWMQTLFRESSGAMLHPTTISSSYSGSLAASAITWQDSENSFLRVKVINFGSDAVTLTISTTGLQASINALGSTATVLTSANVMDENSFSNPTKVVPVKSDMSNAAEQMQVTLAPHSFSSFDLALAQSKLVAEM

SEQ ID NO: 17884 - DNA, 1566 bp, Sorghum bicolor
  misc_feature: Ceres ANNOT ID no. 8682839
  misc_feature: Encodes the peptide sequence at SEQ ID NO 17885
atgggtcggggcgactcggcggcggcggagcagcaggcgtcgtcgacggcgccgttgctggagaagacgtcgtcggccgcggcggaggagtcggaggcggcgtcggcgccggcggaggctggcggcgggtactactactactactacgtggacgggtgccccgggtgcgccgtggagcggcacaaggcggcgaacccggggatcccctacgccaacttcatctacgtctggatcgtcaccctctgcacagctttaccgatatcatcgctgtttcccttcttgtattttatgataagagatctggggattgctaaaagaacagaagatatcgggttctacgctggtttcgtaggtgcctcatttatgtttggtagatgcttgacttcgacagcctggggaatagcggcagaccgtattgggaggaaacctgttgtcatgtttggcatttcctctgtggttgtgttcaatacattgtttggtctgagtgtcaactattggatggcaataactacgcgatttctgcttggtgctttaaatggtttacttggaccaataaaggcttatgccattgaagtttgccgacctgaacatgaagcgttagcactatcacttgtcagcacagcatggggaataggtctcattattggtcctgctcttggaggttatcttgcactgcctgcagaaaattttccaactgtcttttcaactgactcaatctttggaaggttcccatatttcttaccatgcttatgcacgtcaatctttgctgctgttgttctcataagctgcatatggatgccggagactttgcacaagcacaaagttcatgaaaatagaagtcagaacattgaagctttggaggcccatctgattgattcaaaagaaaaggttgaagaaagtggtagtttagatactaagaagagcctattcaggaattggccattgatgtcatcaataattgtctattgcatcttctccttccatgacatggcttacacagaggtgttctctctatgggctgaaagtgacaagaagtatggtggactgagtttatcatctgaggatgttggtcaagttcttgcaatcacaggtgccagtcttcttgtatatcaactctttctatatcctagtatcaataaggttcttgggcctatcaaatcttctcgaattgcagctatcctgtgcatacctatcctctttgcctacccctacatgacatacctgtcagaccctggattatcaatcattttgaatattgcgtcagtgataaagaataatcttgctgttaccatcattacaggcactttcatccttcaaaataatgctgtgcctcaggaccaaagaggagctgcaaatggactgtccatgacagggatgtcctttttcaaggcacttgctccagcaggagctggcattgtgttctcatgggcacagaaacgccagcatgccttcttcttcccaggtgatcagatggtattcttcctcctgaacgttgtcgagctggttgggcttctcctcacattcaaaccctttctggaagtaccagagcaatttgagagcagataa

SEQ ID NO: 17885 - protein, 521 aa, Sorghum bicolor
  misc_feature: Useful for making plants with modulated flowering time
  misc_feature: Functional homolog of the protein sequence given in SEQ ID NO 12969
  misc_feature: Ceres ANNOT ID no. 8682839
  misc_feature (76)..(467): Pfam ID: MFS_1 Pfam Description: Major Facilitator Superfamily
MGRGDSAAAEQQASSTAPLLEKTSSAAAEESEAASAPAEAGGGYYYYYYVDGCPGCAVERHKAANPGIPYANFIYVWIVTLCTALPISSLFPFLYFMIRDLGIAKRTEDIGFYAGFVGASFMFGRCLTSTAWGIAADRIGRKPVVMFGISSVVVFNTLFGLSVNYWMAITTRFLLGALNGLLGPIKAYAIEVCRPEHEALALSLVSTAWGIGLIIGPALGGYLALPAENFPTVFSTDSIFGRFPYFLPCLCTSIFAAVVLISCIWMPETLHKHKVHENRSQNIEALEAHLIDSKEKVEESGSLDTKKSLFRNWPLMSSIIVYCIFSFHDMAYTEVFSLWAESDKKYGGLSLSSEDVGQVLAITGASLLVYQLFLYPSINKVLGPIKSSRIAAILCIPILFAYPYMTYLSDPGLSIILNIASVIKNNLAVTIITGTFILQNNAVPQDQRGAANGLSMTGMSFFKALAPAGAGIVFSWAQKRQHAFFFPGDQMVFFLLNVVELVGLLLTFKPFLEVPEQFESR

SEQ ID NO: 17886 - DNA, 1323 bp, Sorghum bicolor
  misc_feature: Ceres ANNOT ID no. 8682832
  misc_feature: Encodes the peptide sequence at SEQ ID NO 17887
atgagtacaaccaaggtgaagagacgtgtgggcaagtatgagctcggccgcaccataggtgagggcacattcgcaaaggtcaggttcgcgagggacacggtgaccggcgaggccgtagccatcaagatcctagataaggataaggtactcaagcacaagatggtcgagcagattaagcgggaaatctcgacgatgaagttaatcaagcaccctaatgttgtccgcatatacgaggtgatgggaagtaaaacaaagatctacatagtgttagaatttgctactggtggcgagctctttgacacaattgttaaccacggtcggatgagggaagatgaggcaaggaggtacttccaacaattaatcaatgcagttgattattgtcatagcaggggtgtgtaccaccgggatttaaaacctgaaaatttactgcttgattcatatggaaacctgaaagtctctgactttgggctcagtgcgctatctcagcagatgaaggatgatggactgctgcacacaacttgtgggactccaaactatgttgcaccagaggtccttgaagatcaaggctatgacggtgcaatggctgatctgtggtcatgtggagttatcctgtttgttctgctagcagggtatttgccatttgaggactctaatctcatgactttgtataagaaaatatcaaatgcagaatttacatttccaccatggacatcttttcctgccaagaggttgttaacaagaatccttgatccaaatccaatgacgagaataacaatcccagaaatattagaggatgaatggttcaaaaagggctacaagcgcccagagtttgatgaaaaatatgacaccacgttggatgatgtggatgctgtcttcaatgattcagaagagcaccatgtgacagaaaagaaagaagaagaaccagtagctctgaacgcatttgaactgatctcaatgtcagcaggcctaaaccttggaaacttattcgactcagagcaggagttcaaaagagaaacaaggtttacatcaaaatgtccacccaaagaaattgtccgcaagattgaggaagctgcaaaacctctaggatttgatgttcagaagaaaaattacaagttgaggctcgaaaaggttaaggcagggaggaaggggaacctcaatgttgctactgagatactgcaagttgcaccctcccttcatatggtagaagtccgaaaagcaaaaggtgacactctggaatttcataagttctacaagaacctttccaagaccttaaaggacgtcgtctggaaatccgacgatactcaaatgctacatgctgcttag

SEQ ID NO: 17887 - protein, 440 aa, Sorghum bicolor
  misc_feature: Useful for making plants with modulated salt sensitivity
  misc_feature: Functional homolog of the protein sequence given in SEQ ID NO 14255
  misc_feature: Ceres ANNOT ID no. 8682832
  misc_feature: Up-regulated in shoot tissues in response to salicylic acid treatment
  misc_feature (5)..(432): SWISSPROT Homolog: EC 2.7.11.1 Non-specific serine/threonine protein kinase
  misc_feature (13)..(268): Pfam ID: Pkinase Pfam Description: Protein kinase domain
  misc_feature (307)..(367): Pfam ID: NAF Pfam Description: NAF domain
MSTTKVKRRVGKYELGRTIGEGTFAKVRFARDTVTGEAVAIKILDKDKVLKHKMVEQIKREISTMKLIKHPNVVRIYEVMGSKTKIYIVLEFATGGELFDTIVNHGRMREDEARRYFQQLINAVDYCHSRGVYHRDLKPENLLLDSYGNLKVSDFGLSALSQQMKDDGLLHTTCGTPNYVAPEVLEDQGYDGAMADLWSCGVILFVLLAGYLPFEDSNLMTLYKKISNAEFTFPPWTSFPAKRLLTRILDPNPMTRITIPEILEDEWFKKGYKRPEFDEKYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKAKGDTLEFHKFYKNLSKTLKDVVWKSDDTQMLHAA

SEQ ID NO: 17888 - DNA, 1413 bp, Sorghum bicolor
  misc_feature: Ceres ANNOT ID no. 8682840
  misc_feature: Up-regulated in shoot tissues in response to salicylic acid treatment
  misc_feature: Encodes the peptide sequence at SEQ ID NO 17889
atggagagcggcgtcacgtcgccattgctgccgcaggaggagaaggtgtaccaccggggctgccctggctgtgcaaacgaccggaggaaggagctccaggagggcttgccgtacaaggagttcttgtacgtctggatcatctgcctcgccacttctctaccggtgtcatcattattccccttcttgtatttcatgataagagacttgcatgttgcaaaaagaacagaagacattggattctatgccggatttgtgggtgcttcatttatgcttggtagatgcttgacttcaactgtgtggggaatagcagcagatcggtttgggaggaagccaattgccatacttagtgttttctctgtggtcatattcaatactttatttggtcttagtactaattattggatggcaatagctacaagatttctccttggtgctttaaatggtttgcttgggccaattaaggtcggcacagcttggggaataggtctgatcattgggcctgctttaggaggctaccttgcactgcctgcagaaaaatttccaaaagtattttcgcctgactcattcttcgggaggttcccgtactttttgccatgcttatgcacctcactctttgctactgttgttcttgtgagctgcatatggatgccggagacattacacaagcacaaagttcaccagaatgaaagtaaaaatgatgaagctttggaggcccaccagagtgactacaaagagaaggatgaacaaatttcaagtttggatggcaagaagagtttattcaagaattggccctttatgtcatccttaattacttattgtatattttcctttcatgatatggcttattcagaggtgttctctttatggactgaaagtgataagaagtatggtgggctcagtttatcgtctgaggctgtaggtcaagtgctctcaattacaggtgtcagtcttcttatatatcaactcactgtatatcctcgtactaataaaattcttggacctatcaagacgtctcgagttgcagctactctgtgcatacttattctctttgggtatccctacatgacatatctgtcaggaactggactatccatcattttgaatattgcatcgatcttgaaaatcaatcttgctgctaccatcatttcgagcagtttcatccttcagaataatgctgtgcctcaagaccaaagaggagctgcaaatggactgtcagtcacagtaatgtccctattcaaggcaattgctcctgcaattgcaggcactgtgttttcttgggcacaagcacggcagcatactttcttctttccaggtgatcagatggtgttttttcttctgaatgtcatcgagtttcttggaattatgctcacattcaagcccttcatggccgcaccagagtccagagcagcataa

SEQ ID NO: 17889 - protein, 470 aa, Sorghum bicolor
  misc_feature: Useful for making plants with modulated flowering time
  misc_feature: Functional homolog of the protein sequence given in SEQ ID NO 12969
  misc_feature: Ceres ANNOT ID no. 8682840
  misc_feature (44)..(417): Pfam ID: MFS_1 Pfam Description: Major Facilitator Superfamily
MESGVTSPLLPQEEKVYHRGCPGCANDRRKELQEGLPYKEFLYVWIICLATSLPVSSLFPFLYFMIRDLHVAKRTEDIGFYAGFVGASFMLGRCLTSTVWGIAADRFGRKPIAILSVFSVVIFNTLFGLSTNYWMAIATRFLLGALNGLLGPIKVGTAWGIGLIIGPALGGYLALPAEKFPKVFSPDSFFGRFPYFLPCLCTSLFATVVLVSCIWMPETLHKHKVHQNESKNDEALEAHQSDYKEKDEQISSLDGKKSLFKNWPFMSSLITYCIFSFHDMAYSEVFSLWTESDKKYGGLSLSSEAVGQVLSITGVSLLIYQLTVYPRTNKILGPIKTSRVAATLCILILFGYPYMTYLSGTGLSIILNIASILKINLAATIISSSFILQNNAVPQDQRGAANGLSVTVMSLFKAIAPAIAGTVFSWAQARQHTFFFPGDQMVFFLLNVIEFLGIMLTFKPFMAAPESRAA

SEQ ID NO: 17890 - DNA, 1206 bp, Sorghum bicolor
  misc_feature: Ceres ANNOT ID no. 8682838
  misc_feature: Encodes the peptide sequence at SEQ ID NO 17891
atgaaacagataaaggacctgcatgtcgctccaagggaggaagacattggattctacgctggtttcctcggcgcggcgtatatgatcggcagaggtgtcgcatcggttttctggggtgtggcggcggatcgtgttggccgaaagcctgtcctcgccttctctgtcttttcggtcattgtgttcaacactctgtttggactgagtgtcaagtactggatggcgatctctacaaggttccttcttggtgctctcaacggcttccttgcaccagtaaaggcttactccattgaagtttgccgacctgaacaacaggctttgggtatatcagttgtcagcacagcatggggaatgggtgttataattggcccggcacttgggggctatctagcacagcctgtcaaacaatatccacatctgtttcatgagaaatcagtgtttgcgaggttcccatatttattgccatgtctatgtatatcatttttcgctaccttggttctcataagctgtgtatggcttccggagaccctacataagcacaaaggccttgagagagcagttgaaatggtagaaggtaccacaactcaagaaagtgcagagccacctaagaagagcttactcagaaactggccactgatgtcctccattatatcatactgtgtcttctcccttcacgacaccgcatattctgagatattttctctatggaccgtgagtgacagaaaatatggcgggcttagctttgcatctaaagatgtgggccaagttcttacggtcgcaggtgccagtcttctagtatatcaaatctttgcttaccgttggatcgataaagtccttggtccaatcaattcaacccgagtttcatcggcactatctataccaataattgctgcttatcccttcatgacacacttgtcaggaataagacttgttgtgcctctatacatcgcagcaatgctcaaaagcgtttttgcaccacaagaacaaaggggcgctgcaaacgggatagctacaacggcaatgtctctgtccaaggcgtttgctccagccggagcaggcatcttgttctcatgggcacaaaagcgtcagcatgccgcgttctttccaggcgaccagatgatatttctgctcttgaatctgacagaggtcatcgggctggtgctcaccttcaagcctttccttgcagttccccagcagtacaaacaatga

SEQ ID NO: 17891 - protein, 401 aa, Sorghum bicolor
  misc_feature: Useful for making plants with modulated flowering time
  misc_feature: Functional homolog of the protein sequence given in SEQ ID NO 12969
  misc_feature: Ceres ANNOT ID no. 8682838
  misc_feature (9)..(348): Pfam ID: MFS_1 Pfam Description: Major Facilitator Superfamily
MKQIKDLHVAPREEDIGFYAGFLGAAYMIGRGVASVFWGVAADRVGRKPVLAFSVFSVIVFNTLFGLSVKYWMAISTRFLLGALNGFLAPVKAYSIEVCRPEQQALGISVVSTAWGMGVIIGPALGGYLAQPVKQYPHLFHEKSVFARFPYLLPCLCISFFATLVLISCVWLPETLHKHKGLERAVEMVEGTTTQESAEPPKKSLLRNWPLMSSIISYCVFSLHDTAYSEIFSLWTVSDRKYGGLSFASKDVGQVLTVAGASLLVYQIFAYRWIDKVLGPINSTRVSSALSIPIIAAYPFMTHLSGIRLVVPLYIAAMLKSVFAPQEQRGAANGIATTAMSLSKAFAPAGAGILFSWAQKRQHAAFFPGDQMIFLLLNLTEVIGLVLTFKPFLAVPQQYKQ

SEQ ID NO: 17892 - DNA, 1617 bp, Sorghum bicolor
  misc_feature: Ceres ANNOT ID no. 8682846
  misc_feature: Encodes the peptide sequence at SEQ ID NO 17893
atgggccagtgctgctccaagggcaccggagaggccgccgccgccgccgccgagtcggcaccaaaggcgcaggcggcaagccgcagcgcgtcgtccgcgaacaacgaacgtccgtcctcgtcgtccgcggcggctggcggcggcacgacgaagccggcctcgcccaccggcggcggcaaaccggcgacggcggcggccgttggccctgtgcttggtcgtcccatggaggacgttcgcgacacccactcgatggggaaggagctgggtcgcgggcagttcggcgtgacgcacctgtgcacgcacagggcgagcggcgagaagctggcgtgcaagacgatcgcgaagcggaagctggcgaccaaggaggacgtggacgacgtgcgtcgggaggtgcagatcatgcaccacctctccgggcagccgaacgtggtggcgctgcggggcgcgtacgaggacaagcagagcgtgcacctggtgatggagctctgcgccggcggcgagctcttcgaccgcatcatcgccagagggcagtacacggagcggggcgcggcggcgctgctgcggaccatcgtgcggatcgtgcacacctgccacgccatgggggtgatgcacagggacatcaagcccgagaacttcctgctgctcagcaaggacgaggacgcgccgctcaaggccaccgacttcggcctctccgtcttcttcaaggaaggcgagatgctcagggacatcgtcggcagcgcctactacatcgcccccgaggtgctcaagaggaagtacggcccggaggccgacatctggagcgtcggcgtcatgctctacatcttcctcgccggcgtgcctcccttctgggcagagaacgagaacggcatcttcaccgccatcctgcgaggccagctcgacctctccagcgagccatggccgcacatctcgcagggagccaaggatctcgtcaagaagatgctcaacatcaaccctaaggagcgccttacggcgttccaggtcctcaatcacccatggatcaaagaagatggcgatgcacctgatacgccgcttgataatgttgttctcggcaggctcaagcagttcagggccatgaaccagttcaagaaagcggcattgaggatcatagctgggtgcctatctgaagaggagatcacagggctgaaggagatgttcaagaacattgacaaggataatagtgggaccattacgcttgacgaactcaagcacgggttggcaaagcatggacccaagctgtcagacagtgaaatggagaaactaatggaagcagctgatgctgatggcaacgggttaattgactacgacgagttcgtcaccgcaacagtgcacatgaacaaattggacagagaggagcacctttacacagcattccagtatttcgacaaggacaacagcgggtacatcactaaagaagagcttgagcacgccttgaaggagcaagggctgtatgacgccgacaaaatcaaagaggtcatctcagatgccgactctgacaatgatggaaggatagattattcggagtttgtggcaatgatgaggaaagggacagcaggtgctgacccaatgaacaagaagaggcgagacgtagtcctatag

SEQ ID NO: 17893 - protein, 538 aa, Sorghum bicolor
  misc_feature: The sequence is a functional homolog of SEQ ID NO 2 in US patent 7084323
  misc_feature: Ceres ANNOT ID no. 8682846
  misc_feature (71)..(532): SWISSPROT Homolog: EC 2.7.11.1 Non-specific serine/threonine protein kinase
  misc_feature (82)..(340): Pfam ID: Pkinase Pfam Description: Protein kinase domain
  misc_feature (494)..(522): Pfam ID: efhand Pfam Description: EF hand
  misc_feature (387)..(415): Pfam ID: efhand Pfam Description: EF hand
  misc_feature (459)..(487): Pfam ID: efhand Pfam Description: EF hand
  misc_feature (423)..(451): Pfam ID: efhand Pfam Description: EF hand
MGQCCSKGTGEAAAAAAESAPKAQAASRSASSANNERPSSSSAAAGGGTTKPASPTGGGKPATAAAVGPVLGRPMEDVRDTHSMGKELGRGQFGVTHLCTHRASGEKLACKTIAKRKLATKEDVDDVRREVQIMHHLSGQPNVVALRGAYEDKQSVHLVMELCAGGELFDRIIARGQYTERGAAALLRTIVRIVHTCHAMGVMHRDIKPENFLLLSKDEDAPLKATDFGLSVFFKEGEMLRDIVGSAYYIAPEVLKRKYGPEADIWSVGVMLYIFLAGVPPFWAENENGIFTAILRGQLDLSSEPWPHISQGAKDLVKKMLNINPKERLTAFQVLNHPWIKEDGDAPDTPLDNVVLGRLKQFRAMNQFKKAALRIIAGCLSEEEITGLKEMFKNIDKDNSGTITLDELKHGLAKHGPKLSDSEMEKLMEAADADGNGLIDYDEFVTATVHMNKLDREEHLYTAFQYFDKDNSGYITKEELEHALKEQGLYDADKIKEVISDADSDNDGRIDYSEFVAMMRKGTAGADPMNKKRRDVVL

SEQ ID NO: 17894 - DNA, 1254 bp, Sorghum bicolor
  misc_feature: Ceres ANNOT ID no. 8682906
  misc_feature: Encodes the peptide sequence at SEQ ID NO 17895
atggtggatgtggaggaggtcgggaacaagatgcaatcgcagatgcgcctgcacgccgagccggaggacgacgccgccgccgacctccccctgccggccctcttcgacagggcgtcgcggatccacgccctcgcctccagctccgccctcgaccaggatgggatccgcacgggggttgatctgctgcggcgctgcgacgagatggtcagcaagctcggccttttctcccccaacgagaccaaggaagacgtctccaccgcaaacctcaagtacctactcgttccatattaccttgcggaaatgactgagaagatagcacaagaggatcggatcccggttcttaaggcgtcacaggaccacttgaaggaattcattgctctatgtgaagtactagagcttattccagaggatgagctagaattgtctaggcagaagcagcctgatactatggcaaacaggagagcacagaaggttgcccggttcaaacgtcaaaaggctgcagaaacgaagctccaagagatcagagagagaaaagaaaggcgtggacgctcattgagagcagctgctttatctgccccaattgaagctggagaggaagatgacctggaggatgatggagaggaagaaagagaggcttggttagctaccatctcattggctctctgcaaggcgtttgatcttctcgacatgctaaagaaggaagaagaaatgcttctagctgtaaaggaaaggaaggcaaaggacgggaatgcatttgctcgtgaaatgctcgatgaacgaacaaagaaggctgaagcatggcaccacaatgctgccaaccgtgtggtatattccaaaccagctgatccaatcacttgcgcaacatttgctcaagatgtcattgaaggtagagcaagcgtttcacaagctcacgagcacaaacaccagcccctgatatttggacctgcaagtcttgttggtggtggtctaaccagtgaaagggaaagaatggcagcacaagtttttcagcctagttacaggatgccaacaatgagcatagaagaagctggtttgcgcgagatgaaaataatggagaaatggcaggaaaggaccgccgagataatgaaagaagcaaactccgcgtggcacaaggatggcaccagctcggcccaagaggacgaggacgccgaggaggcgaaagcaagagcgtgggacgactggaaggatgacaacccccgtggcgcaggcaacaagaagctcacgccctgtggctaa

SEQ ID NO: 17895 - protein, 417 aa, Sorghum bicolor
  misc_feature: Useful for making plants with modulated biomass
  misc_feature: Functional homolog of the protein sequence given in SEQ ID NO 14585
  misc_feature: Ceres ANNOT ID no. 8682906
  misc_feature (29)..(405): Pfam ID: TAP42 Pfam Description: TAP42-like family
MVDVEEVGNKMQSQMRLHAEPEDDAAADLPLPALFDRASRIHALASSSALDQDGIRTGVDLLRRCDEMVSKLGLFSPNETKEDVSTANLKYLLVPYYLAEMTEKIAQEDRIPVLKASQDHLKEFIALCEVLELIPEDELELSRQKQPDTMANRRAQKVARFKRQKAAETKLQEIRERKERRGRSLRAAALSAPIEAGEEDDLEDDGEEEREAWLATISLALCKAFDLLDMLKKEEEMLLAVKERKAKDGNAFAREMLDERTKKAEAWHHNAANRVVYSKPADPITCATFAQDVIEGRASVSQAHEHKHQPLIFGPASLVGGGLTSERERMAAQVFQPSYRMPTMSIEEAGLREMKIMEKWQERTAEIMKEANSAWHKDGTSSAQEDEDAEEAKARAWDDWKDDNPRGAGNKKLTPCG

SEQ ID NO: 17896 - DNA, 609 bp, Sorghum bicolor
  misc_feature: Ceres ANNOT ID no. 8682927
  misc_feature: Encodes the peptide sequence at SEQ ID NO 17897
atggcggtggtggccaccgagacgccgttccatgtcctggccgtggacgacagcctcccggacaggaagctcatcgagaggctcctcaagacctcttccttccaagtaaccactgtcgattccgggagcaaagccctgcagttcttggggatccacgacgacgacgccagcacggtctctgttcacgcgcaccagctggatgtggcggtgaacctgatcatcacggactactgcatgcccggcatgacagggtatgatctgctaaagaagatcaaggaatcgtcgtctcttagagatatcccggtcgtgatcatgtcgtctgagaacatcccttcaaggatcaatagatgcctggaggaaggagcggacgagtttttcctaaaaccagtgcggctatcagacatgagcaagctcaagccccacatactgaaaagcagatgcagggagcactcccagcaggaccaggaacaacagcaccagcagagtgacagcaacagcaacgattgcagtaaccccacgaacaagagccacagcgatagcagccgaaagcgaaaggcagaggacaacgaggaaattttgccccagaaaaacagaccaaggcacagttag

SEQ ID NO: 17897 - protein, 202 aa, Sorghum bicolor
  misc_feature: Useful for making plants with modulated low light sensitivity
  misc_feature: Functional homolog of the protein sequence given in SEQ ID NO 13290
  misc_feature: Useful for making plants with modulated nitrogen use efficiency
  misc_feature: Functional homolog of the protein sequence given in SEQ ID NO 13599
  misc_feature: Useful for making plants with altered carotene content
  misc_feature: Useful for making plants with altered lignin content
  misc_feature: Useful for making plants with altered terpenoid content
  misc_feature: Functional homolog of the protein sequence given in SEQ ID NO 13463
  misc_feature: The sequence is a functional homolog of SEQ ID NO 932 in the 10/666,642 US patent application
  misc_feature: Ceres ANNOT ID no. 8682927
  misc_feature (10)..(139): Pfam ID: Response_reg Pfam Description: Response regulator receiver domain
MAVVATETPFHVLAVDDSLPDRKLIERLLKTSSFQVTTVDSGSKALQFLGIHDDDASTVSVHAHQLDVAVNLIITDYCMPGMTGYDLLKKIKESSSLRDIPVVIMSSENIPSRINRCLEEGADEFFLKPVRLSDMSKLKPHILKSRCREHSQQDQEQQHQQSDSNSNDCSNPTNKSHSDSSRKRKAEDNEEILPQKNRPRHS

SEQ ID NO: 17898 - DNA, 1425 bp, Sorghum bicolor
  misc_feature: Ceres ANNOT ID no. 8683080
  misc_feature: Encodes the peptide sequence at SEQ ID NO 17899
atgggagaaactagtagttctagtcattcaaggcaggatccttcacttcttggctatggcttccatggcgccatcgccaactccactactacccctgcaaacttctttgaccaagaaggagcaacctattttggagagctggaagaagcgttcatgcatcaagttgcctccctcagaagaactcaacagcaggctgcaaccgtctctgcacctcatcatggagacaccaagcctacagctgcaacggctaccactgctgctaggccacctcctacactggacatcttcccagcttggcctatgaggtctcttcacacacccaaggagtgctcgaatgtgacagcagacagcacagacgactcagagagcagcagcaagaacaacagcaaccactcctcagatcaactcggagcagcagcaaacatggcgacccagttcgatcaagcttcacagcagcagcaacttcagcacaagaatatggctacaagttccactccaagaactgggaagccccttgatccaaaggtaatcagaaggctggctcagaatcgcgaagctgcacgcaaaagccggctgcgaaagaaggcttacatccagcagcttgagagctgtaagctgaagctttctcagatggaacaggacatgcagcgagcccgttcccagggcctatttcttggaggaggtacaggtgcaaacaccagttcaggcgccgccatgttcgacgtggagtacgcccggtggctggacgaccacagccggcgcctggccgagctgaacggagctctgcacgcacacctggcagatggtgacctcagagccatcgtcgacgacgccctgacccaccatgacgagctgttccagctcaaggccatggcggccaagtccgacgtgttccacctcatcactggggtgtggacgacccctgctgagcggtgcttcctctggatgggtggattcaggccctccgatctgctcaagctagatccactgacagagcagcaagtgatcggcatatgcaaccttcaacagtcatcacagcaggcagaggaagctctctcgcagggcttggaacagctgcatcagtcactagctgacaccatggctggtggatctctgattgacgacgccaacatgagcttcatgagtcaaatggctcttgccctcggaaagctggccaaccttgaaggctttgtgatacaggctgataacttgaggcaacagactcttcatcagatgcaccgtattctgacagttcggcaggcagctcgatgtttcctagcaattggcgagtaccacaaccgccttcgtgccttaagctccctctgggcttctcgacctcgagagatactggtgaacgatgaaggaaattgtgaggagataagcattgcagcacaaccatcccaaagccaattttcagccttctga

SEQ ID NO: 17899 - protein, 474 aa, Sorghum bicolor
  misc_feature: The sequence is a functional homolog of SEQ ID NO 1498 in the 10/374,780 US patent application
  misc_feature: The sequence is a functional homolog of SEQ ID NO 1568 in the 10/412,699 US patent application
  misc_feature: Useful for making plants with modulated biomass
  misc_feature: Functional homolog of the protein sequence given in SEQ ID NO 13416
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 114 in the 10/666,642 US patent application
  misc_feature: The sequence is a functional homolog of SEQ ID NO 2362 in the 10/374,780 US patent application
  misc_feature: The sequence is a functional homolog of SEQ ID NO 376 in the 10/412,699 US patent application
  misc_feature: The sequence is a functional homolog of SEQ ID NO 608 in the 10/225,066 US patent application
  misc_feature: The sequence is a functional homolog of SEQ ID NO 848 in the 11/435,388 US patent application
  misc_feature: The sequence is a functional homolog of SEQ ID NO 871 in the 11/479,226 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: Ceres ANNOT ID no. 8683080
  misc_feature (169)..(223): Pfam ID: bZIP_1 Pfam Description: bZIP transcription factor
MGETSSSSHSRQDPSLLGYGFHGAIANSTTTPANFFDQEGATYFGELEEAFMHQVASLRRTQQQAATVSAPHHGDTKPTAATATTAARPPPTLDIFPAWPMRSLHTPKECSNVTADSTDDSESSSKNNSNHSSDQLGAAANMATQFDQASQQQQLQHKNMATSSTPRTGKPLDPKVIRRLAQNREAARKSRLRKKAYIQQLESCKLKLSQMEQDMQRARSQGLFLGGGTGANTSSGAAMFDVEYARWLDDHSRRLAELNGALHAHLADGDLRAIVDDALTHHDELFQLKAMAAKSDVFHLITGVWTTPAERCFLWMGGFRPSDLLKLDPLTEQQVIGICNLQQSSQQAEEALSQGLEQLHQSLADTMAGGSLIDDANMSFMSQMALALGKLANLEGFVIQADNLRQQTLHQMHRILTVRQAARCFLAIGEYHNRLRALSSLWASRPREILVNDEGNCEEISIAAQPSQSQFSAF

SEQ ID NO: 17900 - DNA, 303 bp, Sorghum bicolor
  misc_feature: Ceres ANNOT ID no. 8683104
  misc_feature: Encodes the peptide sequence at SEQ ID NO 17901
atggagagccaggcagaggaagctggctcaatagactcacatcattatatacagaatattgataagcctgatagggcatatacaactaaaagggccaatcgagtaggaaaagcaaatgcttcaagcggcaagattcttgtgacaactgcatctgattattttggaccaatccttctcgaacaaaaccccataaggaaattgaatgttgataatcctgatagggcatatacaactgaacgggccaagcaagttggaaaagaaaatgcttggagcagcaagatttttgtgacaattgcactataa

SEQ ID NO: 17901 - protein, 100 aa, Sorghum bicolor
  misc_feature: The sequence is a functional homolog of SEQ ID NO 2314 in the 10/374,780 US patent application
  misc_feature: The sequence is a functional homolog of SEQ ID NO 522 in the 10/225,066 US patent application
  misc_feature: Ceres ANNOT ID no. 8683104
MESQAEEAGSIDSHHYIQNIDKPDRAYTTKRANRVGKANASSGKILVTTASDYFGPILLEQNPIRKLNVDNPDRAYTTERAKQVGKENAWSSKIFVTIAL

SEQ ID NO: 17902 - DNA, 942 bp, Sorghum bicolor
  misc_feature: Ceres ANNOT ID no. 8683121
  misc_feature: Encodes the peptide sequence at SEQ ID NO 17903
atgatgatggaaagccatggtggtagtggcggcggcggcggcggcggcggcggcggcagtgatccgttgctggcgccggggttccggttctacccgacggaggaggagctgctgacgttctacctccggcaccggctcgccggcaccaggcccgtcgtggagcacctgatccccgtcgtcgacatctacagctaccacccgtcagagctccgggcgatggccggcgcggcgagcgtctccgacccggagcagtggttcttcttctgcccgcgcgcagagcgggagctccacggcggccggcccgcgcgcaccacgccgtcgggatactggaaggccacggggtcgccgtcctacgtctactcctcctcctcctcgcccaccgccaacaaccgcgtcatcggcgagaagcgcaccatggtcttctaccagggccgcgcgcccaccggcaacaagaccccctggaagatgaacgagtacaagctgcgtaacgagttcagcgtctgccgggtgtacatcagcaccggcacgctgaggtccttcgaccgccggccgcacccgccgagcggcggtctcgccgccgtccactgcggctaccaacgacagcaacagctacagccactgctaccaccaccagcagcggcggcggcggcggcgaagacgacgagcctccacaaccagcagcagacgatgatgcttgctgcggtcgtcgtcgacgacgactccgcggccgacaacaacggacggcggcggcatgcggtggagcactctcacgacagctcgtcgtcggggtcgcgaggcgttggcggcggcgtggacggagcagaagacgccgccacggccatcgactgggactggaactcgctcatccctcccgtggatgacgatgatctcgccttcaccggcgtcgatgacttgacccgtgtcatttggccccataattga

SEQ ID NO: 17903 - protein, 313 aa, Sorghum bicolor
  misc_feature: The sequence is a functional homolog of SEQ ID NO 1170 in the 10/666,642 US patent application
  misc_feature: The sequence is a functional homolog of SEQ ID NO 1400 in the 10/666,642 US patent application
  misc_feature: The sequence is a functional homolog of SEQ ID NO 320 in the 10/412,699 US patent application
  misc_feature: The sequence is a functional homolog of SEQ ID NO 752 in the 11/479,226 US patent application
  misc_feature: The sequence is a functional homolog of SEQ ID NO 432 in the 10/666,642 US patent application
  misc_feature: Ceres ANNOT ID no. 8683121
  misc_feature (24)..(162): Pfam ID: NAM Pfam Description: No apical meristem (NAM) protein
MMMESHGGSGGGGGGGGGGSDPLLAPGFRFYPTEEELLTFYLRHRLAGTRPVVEHLIPVVDIYSYHPSELRAMAGAASVSDPEQWFFFCPRAERELHGGRPARTTPSGYWKATGSPSYVYSSSSSPTANNRVIGEKRTMVFYQGRAPTGNKTPWKMNEYKLRNEFSVCRVYISTGTLRSFDRRPHPPSGGLAAVHCGYQRQQQLQPLLPPPAAAAAAAKTTSLHNQQQTMMLAAVVVDDDSAADNNGRRRHAVEHSHDSSSSGSRGVGGGVDGAEDAATAIDWDWNSLIPPVDDDDLAFTGVDDLTRVIWPHN

SEQ ID NO: 17904 - DNA, 1134 bp, Sorghum bicolor
  misc_feature: Ceres ANNOT ID no. 8683237
  misc_feature: Encodes the peptide sequence at SEQ ID NO 17905
atggctgacggcgaggacatccagccccttgtttgtgacaatggaactggcatggtcaaggctggttttgctggtgacgatgcgccaagggctgttttcccaagcattgttggacgtccccgacacactggtgtgatggttggcatggggcagaaggatgcgtatgttggtgatgaggcccagtccaagaggggtatcctgactctgaagtacccaatcgagcatggtattgttagcaactgggatgacatggagaagatctggcaccacaccttctataatgaactccgtgttgcgcctgaagagcaccctgtgttgctgaccgaagccccactcaaccccaaggctaacagggagaagatgacccagatcatgtttgagaccttcaatgttcctgccatgtatgtcgccatccaggctgtgctttccctgtacgccagtggacgtacaactggtattgtgttggactctggtgatggtgtgagccacacggtgccaatctatgaaggttatgcccttcctcatgccatcctgcgtctcgaccttgctgggcgtgacctgactgacagcctgatgaagatcctcactgagagaggttactccttcaccaccactgccgaacgggaaattgtaagagacatcaaggaaaagctcgcgtacgtggctcttgactacgagcaggagctggaaagcgccaagagcagctcatctgtggagaagagctacgagctgcctgatggtcaggtgatcaccattggggcagagaggttcagatgccctgaggtcctcttccagccttccttcattggtatggaagctcctggcatccatgagaccacctacaactccatcatgaagtgtgatgtggatatcaggaaggacttgtatggtaacattgtgctcagtggtggcacgaccatgttccctggtatcgcggaccgtatgagcaaggagatcactgcccttgccccgagcagcatgaaaatcaaggtggtggcaccgcctgagaggaaatacagtgtctggataggaggatccatcctcgcctccctgagcaccttccaacagatgtggatctcaaaggctgagtacgatgagtcaggacccgcgattgttcaccggaagtgcttctaa

SEQ ID NO: 17905 - protein, 377 aa, Sorghum bicolor
  misc_feature: Useful for making plants with modulated biomass
  misc_feature: Functional homolog of the protein sequence given in SEQ ID NO 13060
  misc_feature: Useful for making plants with modulated flowering time
  misc_feature: Functional homolog of the protein sequence given in SEQ ID NO 13142
  misc_feature: Ceres ANNOT ID no. 8683237
  misc_feature (5)..(137): SWISSPROT Homolog: EC 2.7.10.2 Non-specific protein-tyrosine kinase
  misc_feature (4)..(377): Pfam ID: Actin Pfam Description: Actin
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELESAKSSSSVEKSYELPDGQVITIGAERFRCPEVLFQPSFIGMEAPGIHETTYNSIMKCDVDIRKDLYGNIVLSGGTTMFPGIADRMSKEITALAPSSMKIKVVAPPERKYSVWIGGSILASLSTFQQMWISKAEYDESGPAIVHRKCF

SEQ ID NO: 17906 - DNA, 2088 bp, Sorghum bicolor
  misc_feature: Ceres ANNOT ID no. 8683309
  misc_feature: Encodes the peptide sequence at SEQ ID NO 17907
atggacgcggacaccttcccagcagggctgcgtgtgctcgccgtcgacgatgaccgtgtctgcctcaagatcctagaaaggcagctaaagtattgcaactacaacgcaacggtggtgacggatgctaggacggcgttggacatgctcagggagaggaaggatgggaaccagttcgacctggtgatcagtgacgtcgtcatgcctaacatggatggctttaagctcctcgagctcatcggcctagagatggatctcccagtcattatgctatccgcaaacaatgagacacagactataatgaaagggataaagcatggggcctgtgattatatagtaaagccagtgcgcctcgagcagcttaggggcatatggacacatgtggtgaagaatggtaagactgatccacggaacaccatcagtagtggcaatgatgatgatgttcagaagttgccatctggggatgagttgccatctggggatgctgataaagatgagaatattgcagcaaaccgtagaaagaagtattcaaagaaaaacaaaagaattgtggaggttgctgatgaggacaacgagaacacatcagcccaaaagaagcaaagggtccgatggtgtggtcaactacaccggaagtttgtagaagctgttagtcagattggcatcgacagcgctgttccaaagaagatattaaaaattatgaatgtggaaggccttacaagagagaatgtcgctagtcatctgcagaagtaccgaatctacctcaaaaagctcggcgacggcacacttacgaattctaattcgtttgctgatgaaactgaagcactatggagaaacatgaatgtcccatccttcattggctctccgagctcaagcaaccattttgcaaagatgaattcctcatctacaattggagcacaaactttgttgcccacacagtcaattcatgccacgagctcacacaaaaacttgggcattcctcggttagacatggaaacagttggccacggtgtcaacctgcccaaagatgttatgcctatgccagtgcaggatatcagcagattcgtctcttctggcaagtcctatggacctgtatcgagtgatgggctgccaggtgtaagccattgcttcccttctggtccttctggcaactcctttggaaatgtttcaaatgatgtgccgttgaaagcaagaaaacctttctctattgatatttctgggagttcatttgcaaacagctcaaaagacagtccaccattgacctcaaacatgtgcttttctttgtctcgttcttgcagctcctatgcgagcatattgcgtggcaagattttgggatcaagcagaggtattccttttgaagacatagcaaatggtgagatgctggctcctgggcatttaccattgcagtctcctgagttggtgaaccagcatttggttcagcctcaatcatgttctgctagcttagttaacaaggttgctagggaagttccccaatttgcaggacctagcaactcctggaaagttgacgtgccatcaaggtttactaatcccggtcataatgttggaacatctgaagatccttcacagggtaacattctcaagatcaaccagttgtcaagacatgcacactcctctggacaggttccaactttcggaaatgagtatcaaaagaaaatcacaggagacatggggaaagctataccagtggtaggtttcagagagcaagtggcaccattcaactatggaaatttcagcgatggaaatgacacacactctacattgacgccgattggtaattctgctttggctagttcttcaagcatgagacttaaccaaatagacaattcagccatgctgacccaggtgttgaatggcggtggtgcaagtgacagcctccatgaaggtagcactattaatcagcaagcagttaatgaccaagtgaataacatcaatgaattcctcatgggaacaagtgaggaacagaatgtggagactgatgacttggatgatttccttgctaacttagttaatcagctatctagaggtatgattttcatgaactatttgacctgttgtgtttcaagtgttctttag

SEQ ID NO: 17907 - protein, 695 aa, Sorghum bicolor
  misc_feature: The sequence is a functional homolog of SEQ ID NO 936 in the 10/666,642 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
  misc_feature: Ceres ANNOT ID no. 8683309
  misc_feature (7)..(121): SWISSPROT Homolog: EC 3.1.4.17 3',5'-cyclic-nucleotide phosphodiesterase
  misc_feature (10)..(125): Pfam ID: Response_reg Pfam Description: Response regulator receiver domain
  misc_feature (200)..(250): Pfam ID: Myb_DNA-binding Pfam Description: Myb-like DNA-binding domain
MDADTFPAGLRVLAVDDDRVCLKILERQLKYCNYNATVVTDARTALDMLRERKDGNQFDLVISDVVMPNMDGFKLLELIGLEMDLPVIMLSANNETQTIMKGIKHGACDYIVKPVRLEQLRGIWTHVVKNGKTDPRNTISSGNDDDVQKLPSGDELPSGDADKDENIAANRRKKYSKKNKRIVEVADEDNENTSAQKKQRVRWCGQLHRKFVEAVSQIGIDSAVPKKILKIMNVEGLTRENVASHLQKYRIYLKKLGDGTLTNSNSFADETEALWRNMNVPSFIGSPSSSNHFAKMNSSSTIGAQTLLPTQSIHATSSHKNLGIPRLDMETVGHGVNLPKDVMPMPVQDISRFVSSGKSYGPVSSDGLPGVSHCFPSGPSGNSFGNVSNDVPLKARKPFSIDISGSSFANSSKDSPPLTSNMCFSLSRSCSSYASILRGKILGSSRGIPFEDIANGEMLAPGHLPLQSPELVNQHLVQPQSCSASLVNKVAREVPQFAGPSNSWKVDVPSRFTNPGHNVGTSEDPSQGNILKINQLSRHAHSSGQVPTFGNEYQKKITGDMGKAIPVVGFREQVAPFNYGNFSDGNDTHSTLTPIGNSALASSSSMRLNQIDNSAMLTQVLNGGGASDSLHEGSTINQQAVNDQVNNINEFLMGTSEEQNVETDDLDDFLANLVNQLSRGMIFMNYLTCCVSSVL

SEQ ID NO: 17908 - DNA, 1023 bp, Sorghum bicolor
  misc_feature: Ceres ANNOT ID no. 8683343
  misc_feature: Encodes the peptide sequence at SEQ ID NO 17909
atgaggttgacgtggttagcaattgcctttgccttggcggcgctcgtcgtcgtctcctcatcggcggcacgcgcacaggcctcaccggcggaactggaggtcggtttctacaagcactcatgcccaaaggccgagtccatcgtgcgcaacgccgtccgccgcggtatcgcccgtgacgccggcgtcggcgccggactcatccggatgcacttccacgactgcttcgtccggggctgcgacgcctccatcctcatcaactccacgccgcgcaacaaggccgagaaggactccgtcgccaacaaccccagcatgcgcggcttcgacgtcgtcgacgacgccaaggccgtcctcgaggcgcactgcccgcgcaccgtctcctgcgccgacatcatcgcgttcgccgcccgcgacggcgcctacctcgccggcggcctcgactacaaggtcccctcgggccgccgtgacggccgcgtgtccaaagaggacgaggtgctcgacaacaatgtccccgccccatttgacgacgtagccgagctcatcaagagcttcaagcgcaagggcctcaacgccgacgacatggtcacgctctccggcgcgcacaccattggccgctctcactgctcctccttcacgcagcgcctttacaacttcagcggccagctcgggcggactgacccgtcgcttgaccccacctacgctgagcacctcaagatgcgctgcccatggccgtccagcaacggccagatggaccccacggtggtgccgctcgacccggtcacgccggcgaccttcgacaaccagtactacaagaacgtgctggcgcacaagggcctgttcgtctccgacaacacgctgctcgacaacccctggacggccggaatggtccacttcaacgccgcagtcgagaaggcatggcaggtcaagttcgccaaggccatggtgaagatgggcaaggtccaggtgctcaccggcgacgagggagagataagggagaagtgcttcgtcgtcaacccacactactag

SEQ ID NO: 17909 - protein, 340 aa, Sorghum bicolor
  misc_feature: Useful for making plants with altered carbohydrate content
  misc_feature: Functional homolog of the protein sequence given in SEQ ID NO 13714
  misc_feature: Useful for making plants with altered cell wall content and/or composition
  misc_feature: Functional homolog of the protein sequence given in SEQ ID NO 13958
  misc_feature: Ceres ANNOT ID no. 8683343
  misc_feature (33)..(337): SWISSPROT Homolog: EC 1.11.1.7 Peroxidase
  misc_feature (48)..(301): Pfam ID: peroxidase Pfam Description: Peroxidase
MRLTWLAIAFALAALVVVSSSAARAQASPAELEVGFYKHSCPKAESIVRNAVRRGIARDAGVGAGLIRMHFHDCFVRGCDASILINSTPRNKAEKDSVANNPSMRGFDVVDDAKAVLEAHCPRTVSCADIIAFAARDGAYLAGGLDYKVPSGRRDGRVSKEDEVLDNNVPAPFDDVAELIKSFKRKGLNADDMVTLSGAHTIGRSHCSSFTQRLYNFSGQLGRTDPSLDPTYAEHLKMRCPWPSSNGQMDPTVVPLDPVTPATFDNQYYKNVLAHKGLFVSDNTLLDNPWTAGMVHFNAAVEKAWQVKFAKAMVKMGKVQVLTGDEGEIREKCFVVNPHY

SEQ ID NO: 17910 - DNA, 1548 bp, Sorghum bicolor
  misc_feature: Ceres ANNOT ID no. 8683467
  misc_feature: Encodes the peptide sequence at SEQ ID NO 17911
atgcagccggacccgagcggcgacgccggcaatgcgaaggcgaagctgccgctgccgctgccgcagccggtgacggctccggcgccgtcgtcggggcggccggcgtccgtgctgccgtacaagacggccaacgtgcgggaccactaccgcatcggcaagaagctcgggcaggggcagttcggcaccacgtaccagtgcgtgggcaaggccgacggcgccgagtacgcgtgcaagtccatccccaagcgcaagctgctgtgccgggaggactacgaggacgtgtaccgcgagatccagatcatgcaccacctctccgagcacccaaacgtcgtccgcatccgcggcgcctacgaggacgcgctcttcgtgcacatcgtcatggagctctgcgcaggcggcgagctcttcgaccgcatcgtcgccaagggccactacagcgagcgcgcggccgcgaagctcatcaagaccattgttggggtcgtggagggatgccactcgctcggcgtcatgcaccgggacctcaagccggagaactttctctttgccagcaccgccgaggaagccccactcaaggccactgactttgggctctccatgttctacaagcctggtgataaattctctgatgtcgttggaagcccttactatgtcgcaccagaggtacttcagaaatgctatggtccagaagctgatgtgtggagcgcaggggtaattctgtacattttgctttgtggtgtccccccattttgggcagaaactgaggctggaatcttcaggcagattctgcgaggcaaacttgattttgaatctgaaccctggcctagtatttctgatagtgctaaggatttggtccgcaatatgcttactcgggatcctaaaaagagatttagtgctcatgaggttctctgccacccatggattgttgacgatgctgtggcacctgataagcctattgattctgctgttctgtcaaggctgaagcatttttcggcaatgaacaagctcaagaagatggcgttaagggttattgcagaaagcctgtctgaggaagagattggaggcctcaaggagttgttcaagatgattgatactgacaatagtgggactataacatttgatgagctcaaagatggcttgaaaagggtaggctctgaattaacggagaacgaaatccaggctctaatggaagcagctgatattgataacagcggaaccatcgactacggtgaattcattgcagctacgttgcacatgaataagctggagagggaggaaaacttggtttcagcattctcattttttgacaaagatggaagtggctttataaccattgatgagctgtcacaagcatgtcgtgaatttggtcttgatgacgtccacctcgaggatatgattaaagatattgaccagaacaatgatggtcaaattgactacagcgagttcacggcaatgatgaggaagggcaatgctggtgcaacaggaaggagaaccatgaggaacagcttgcacttgaatctcggcgaactcttaaaccccagcaaaacctag

SEQ ID NO: 17911 - protein, 515 aa, Sorghum bicolor
  misc_feature: The sequence is a functional homolog of SEQ ID NO 2 in US patent 7084323
  misc_feature: Ceres ANNOT ID no. 8683467
  misc_feature (33)..(513): SWISSPROT Homolog: EC 2.7.11.1 Non-specific serine/threonine protein kinase
  misc_feature (49)..(307): Pfam ID: Pkinase Pfam Description: Protein kinase domain
  misc_feature (354)..(382): Pfam ID: efhand Pfam Description: EF hand
  misc_feature (460)..(488): Pfam ID: efhand Pfam Description: EF hand
  misc_feature (426)..(454): Pfam ID: efhand Pfam Description: EF hand
  misc_feature (390)..(418): Pfam ID: efhand Pfam Description: EF hand
MQPDPSGDAGNAKAKLPLPLPQPVTAPAPSSGRPASVLPYKTANVRDHYRIGKKLGQGQFGTTYQCVGKADGAEYACKSIPKRKLLCREDYEDVYREIQIMHHLSEHPNVVRIRGAYEDALFVHIVMELCAGGELFDRIVAKGHYSERAAAKLIKTIVGVVEGCHSLGVMHRDLKPENFLFASTAEEAPLKATDFGLSMFYKPGDKFSDVVGSPYYVAPEVLQKCYGPEADVWSAGVILYILLCGVPPFWAETEAGIFRQILRGKLDFESEPWPSISDSAKDLVRNMLTRDPKKRFSAHEVLCHPWIVDDAVAPDKPIDSAVLSRLKHFSAMNKLKKMALRVIAESLSEEEIGGLKELFKMIDTDNSGTITFDELKDGLKRVGSELTENEIQALMEAADIDNSGTIDYGEFIAATLHMNKLEREENLVSAFSFFDKDGSGFITIDELSQACREFGLDDVHLEDMIKDIDQNNDGQIDYSEFTAMMRKGNAGATGRRTMRNSLHLNLGELLNPSKT

SEQ ID NO: 17912 - DNA, 1824 bp, Sorghum bicolor
  misc_feature: Ceres ANNOT ID no. 8683535
  misc_feature: Encodes the peptide sequence at SEQ ID NO 17913
atgacgcatataatgccttgtttagttgaggagttttgttcgtttgccattaccgcgagaaatccttggaatggaatccgaaatctctccaccgtaggtaggatcggggcggcgccggccaggccaggcggcggcggcggcggcggcggcgggcagcaggcagcaggcatgaagcgggtgtcgtcgcacgtctcgatggcctcggaggcggagatcaacctcgatctgtcgcgcctcatcatcgacaggccgcagcgcttcacgctggagcgcaagcgctccttcgacgagcagtcgtggagtgagctctcccactcccactcccaccgcaacaacgacgggttcgacagcgtgctgcagtcgcccgcattcccgtccgccggcgggttcgactcgcctttctccatcggcacgcatttcggcggcggcggcccgcacccgctcgtcaacgaggcctgggaggcgctcaggaaatcggtcgtctacttccgggaacagcccgttgggaccatcgcggccgtggatcatgcgtccgaggaagtgctcaactatgatcaggtttttgtgagggatttcgttccgagcgcattggcttttctgatgaacaatgagactgacatagtgaagaactttctcttgaaaactctccaccttcagagctctgagaaaatggtagaccggttcaagcttggggcaggagcgatgcctgcaagtttcaaggtggaccgtaacaaaaacagaaacactgaaaccttagttgctgattttggtgagagtgcgataggcagggtggcaccggtcgactctggattttggtggatcattctccttcgggcttatacaaagtacaccggagatgttagtttgtcggaatcacctgattgccagaagtgcatgaggttgatactgaatctctgcttatctgaaggatttgatacttttccaactctgctttgcacagatggctgctcaatgattgatcgtcgaatgggtatatatggttatcccatcgagatccaagccctattctatatggcattaagatgtgctctccaaatgctcaagccagagggcgaagggaaggatttcatagagaagatagggcaacggcttcatgcactaacctaccacatgaggaattacttctggctagattttcaccagctgaataacatatacagatacaaaacagaagagtattcccacacagccgtgaacaagtttaatgtcattccggattccattcctgattgggtgtttgatttcatgccatgccgaggaggctactttcttggcaacgtcagccctgctatgatggatttccggtggtttgcccttggcaattgcattgccattgtatcatctctagctaccccagaacagtcagttgcaataatggatctgattgaggaaaagtgggatgagctagttggtgagatgcctctgaagatttgctatcccgctcttgagaatcatgagtggagaattatcactggatgtgaccctaagaacacccgatggagttatcacaatggaggatcatggccagcagcctgcatcaagactggtcggccacagatggcaaaacgtgccattgagcttgctgagtcgaggctgctcaaggacggctggcctgagtactacgatggcaagctaggaagattcgttggtaagcaggccaggaagttccaaacctggtccattgccggttacctcgtcgcccgcatgatgctggaggacccatcgacactgatgatgatctccatggaggaggaccggcctgtgaagccgaccatgcggcggtcagcatcatggaatgcctga

SEQ ID NO: 17913 - protein, 607 aa, Sorghum bicolor
  misc_feature: Useful for making plants with modulated oxidative stress sensitivity
  misc_feature: Functional homolog of the protein sequence given in SEQ ID NO 13231
  misc_feature: Useful for making plants with altered carbohydrate content
  misc_feature: Functional homolog of the protein sequence given in SEQ ID NO 13652
  misc_feature: Ceres ANNOT ID no. 8683535
  misc_feature (144)..(600): Pfam ID: Invertase_neut Pfam Description: Plant neutral invertase
MTHIMPCLVEEFCSFAITARNPWNGIRNLSTVGRIGAAPARPGGGGGGGGGQQAAGMKRVSSHVSMASEAEINLDLSRLIIDRPQRFTLERKRSFDEQSWSELSHSHSHRNNDGFDSVLQSPAFPSAGGFDSPFSIGTHFGGGGPHPLVNEAWEALRKSVVYFREQPVGTIAAVDHASEEVLNYDQVFVRDFVPSALAFLMNNETDIVKNFLLKTLHLQSSEKMVDRFKLGAGAMPASFKVDRNKNRNTETLVADFGESAIGRVAPVDSGFWWIILLRAYTKYTGDVSLSESPDCQKCMRLILNLCLSEGFDTFPTLLCTDGCSMIDRRMGIYGYPIEIQALFYMALRCALQMLKPEGEGKDFIEKIGQRLHALTYHMRNYFWLDFHQLNNIYRYKTEEYSHTAVNKFNVIPDSIPDWVFDFMPCRGGYFLGNVSPAMMDFRWFALGNCIAIVSSLATPEQSVAIMDLIEEKWDELVGEMPLKICYPALENHEWRIITGCDPKNTRWSYHNGGSWPAACIKTGRPQMAKRAIELAESRLLKDGWPEYYDGKLGRFVGKQARKFQTWSIAGYLVARMMLEDPSTLMMISMEEDRPVKPTMRRSASWNA

SEQ ID NO: 17914 - DNA, 150 bp, Sorghum bicolor
  misc_feature: Ceres ANNOT ID no. 8683574
  misc_feature: Encodes the peptide sequence at SEQ ID NO 17915
atgacgccaacggatgtcactctcccagtgttaagaacaatcactaacaatttctctctggagcgaaaacttggtgaaggcacatttggacaagtctacctggtactccattttacacaacacgcaattgcattaatgaggatactataa

SEQ ID NO: 17915 - protein, 49 aa, Sorghum bicolor
  misc_feature: Useful for making plants with altered carbohydrate content
  misc_feature: Functional homolog of the protein sequence given in SEQ ID NO 14586
  misc_feature: Ceres ANNOT ID no. 8683574
MTPTDVTLPVLRTITNNFSLERKLGEGTFGQVYLVLHFTQHAIALMRIL

SEQ ID NO: 17916 - DNA, 2472 bp, Sorghum bicolor
  misc_feature: Ceres ANNOT ID no. 8683750
  misc_feature: Encodes the peptide sequence at SEQ ID NO 17917
atggccctgttcgatcggaaccagaggcagcggtcgtcgttctactccacggcgaccttcgtcgtgttcgtcgcgctctgcctcctcggcctgtggatcatgtcatctcccgagaccgtcccggcggccatttccatgtcctcggagaaggcggccgtgaaggccgacgtcgtcaaggaggaggacagctccatcgacgccaccaacaccgtcaagcaggacagcgccaacgtcgtcgcggaggcggccacggccggtgccgccgctgaggatgtcgacatccccggaaagaccggtggcggcgaagcggcagaaggcgacggcgggaaggcggcgtcctcgtcgtccaaggaccagtcgtttgacgacgagaacggccggaccgagggcggggacctcgtcaagccgggcggcggcggcgagacggacgccgccgcgggccaggacaagggcgccggcgatgacgcggcgcttgacaacgatgcgaaggtcgatgccgccaccaaggatgccggcggtctggatcagagcgccgccgagcagacggccacggacacgacgaaggcgagcgctgcagagcaggcggcggcgactggcgtcgtcaaggagagcagcgccgaggcaggcggcggcggctcggccaagaaactcacgttcgatgacgagaacggcaagatggacggcgtcgatcttgtcaaggacgacgcagcggaggcgcagccgaacgtccaggcagagctcctgacggagcgcgcggcgcagaacgggtcgttcacgacgcaggcggcggagtccaccgaggagaagaagaagcgcgccgagaagaaggggaagaaagagagaggaaagaagaaggcggccgtcgccgtcgccggcgccacggtggcgtggaagctgtgcaactcgagcgccggcgcggactacatcccgtgcctggacaacgtggcggccatcaagaagctcaagacggacaagcactacgagcaccgggagcggcactgccccgaggaggcgccgacgtgcctggtcccggcgccgccggagtaccgagagccgatccggtggccgcacagccgcgacaagatctggtactacaacgtgccgcacaccaagctggccgagtacaaggggcaccagaactgggtgaaggtctccggcgagtacctgacgttccccggcggcggcacgcagttcaagcacggcgcgctgcactacatcgagctgatccagaactcgttcccggacgtggcgtggggaaggcgaagccgcgtcgtgctcgacgtcggctgcggcgtggcgagcttcggcgggtacctgttcgaccgcgacacgctgaccatgtcgctggcgcccaaggacgagcacgaggcgcaggtgcagttcgcgctggagcgcggcatcccggccatctccgccgtgatgggcacgcagcgcctcccgttcccggccaacgtcttcgacgtcgtgcactgcgcgcggtgccgcgtgccgtggcacatcgacggcggcatgctcctcctggagctcaaccgcctgctccgccccggcggcttcttcgtctggtccgccacgccggtgtaccagaagctcccggaggacgtggagatctgggacgaaatggtgaagctgaccaaggcgatgtgctgggagatggtggcgaagaccagggacaccgtcgacctggtcgggctcgtcatcttccagaagccagtggacaacgtctgctatgacaagaggccggagaaggagccggcgttgtgcgagctctccgacgatcccaacgccgcatggaacataaagttccgggcgtgtatgcaccgtgttcccgaggaccagaaagtgcggggcgcccggtggccggagctgtggccggagagggtgcggaaggcgccgtactggctggaccggagccaggtgggagtgtacggcaagccggcgccggacgacttcgcggcggacctgcagcactggaggaaagtggtccggagctcgtacctcgccggcatgggcatcgactggaagaccatccggaacgtcatggacatgagggccgtctacggcgggttcgcggcggcgctgcgggagatgaaggtgtgggtcatgaacgtggtcaccatcgactcgccggacacgctgccggtgatctacgagcgcggcctgttcgggatctaccatgactggtgcgagtccttcagcacctacccgaggtcctacgacctcctccatgccgaccacctcttctccaagctcaagcccaggtgcaaggtgttgccggtgatcgtggaggtggaccggatcctgaggccgaacgggaagctgatcgtgcgggacgacaaggagacggtggacgagatccagggggtggtgaggtcgttgcagtgggaggtcaggatgaccgtctccaagaacaaggaggcgatgctgtgcgcgaggaagacgacgtggcggcccacggagatcgagagcagatga

SEQ ID NO: 17917 - protein, 823 aa, Sorghum bicolor
  misc_feature: The sequence is a functional homolog of SEQ ID NO 484 in the 11/435,388 US patent application
  misc_feature: The sequence is a functional homolog of SEQ ID NO 508 in the 11/435,388 US patent application
  misc_feature: The sequence is a functional homolog of SEQ ID NO 562 in the 10/412,699 US patent application
  misc_feature: The sequence is a functional homolog of SEQ ID NO 626 in the 11/435,388 US patent application
  misc_feature: The sequence is a functional homolog of SEQ ID NO 198 in the 10/666,642 US patent application
  misc_feature: Ceres ANNOT ID no. 8683750
  misc_feature (426)..(521): Pfam ID: Methyltransf_11 Pfam Description: Methyltransferase domain
MALFDRNQRQRSSFYSTATFVVFVALCLLGLWIMSSPETVPAAISMSSEKAAVKADVVKEEDSSIDATNTVKQDSANVVAEAATAGAAAEDVDIPGKTGGGEAAEGDGGKAASSSSKDQSFDDENGRTEGGDLVKPGGGGETDAAAGQDKGAGDDAALDNDAKVDAATKDAGGLDQSAAEQTATDTTKASAAEQAAATGVVKESSAEAGGGGSAKKLTFDDENGKMDGVDLVKDDAAEAQPNVQAELLTERAAQNGSFTTQAAESTEEKKKRAEKKGKKERGKKKAAVAVAGATVAWKLCNSSAGADYIPCLDNVAAIKKLKTDKHYEHRERHCPEEAPTCLVPAPPEYREPIRWPHSRDKIWYYNVPHTKLAEYKGHQNWVKVSGEYLTFPGGGTQFKHGALHYIELIQNSFPDVAWGRRSRVVLDVGCGVASFGGYLFDRDTLTMSLAPKDEHEAQVQFALERGIPAISAVMGTQRLPFPANVFDVVHCARCRVPWHIDGGMLLLELNRLLRPGGFFVWSATPVYQKLPEDVEIWDEMVKLTKAMCWEMVAKTRDTVDLVGLVIFQKPVDNVCYDKRPEKEPALCELSDDPNAAWNIKFRACMHRVPEDQKVRGARWPELWPERVRKAPYWLDRSQVGVYGKPAPDDFAADLQHWRKVVRSSYLAGMGIDWKTIRNVMDMRAVYGGFAAALREMKVWVMNVVTIDSPDTLPVIYERGLFGIYHDWCESFSTYPRSYDLLHADHLFSKLKPRCKVLPVIVEVDRILRPNGKLIVRDDKETVDEIQGVVRSLQWEVRMTVSKNKEAMLCARKTTWRPTEIESR

SEQ ID NO: 17918 - DNA, 576 bp, Sorghum bicolor
  misc_feature: Ceres ANNOT ID no. 8683769
  misc_feature: Encodes the peptide sequence at SEQ ID NO 17919
atgcccaatggcaagatcattacagttgaggtggagccgtccgatacagtcggcgatgtcgaggcaaagatacaggaccagcagaggatcatctttgacggcagccgacttgataagaagtgcaaacctggcttttacaagcgtggcggcatgccgattgccgtcaagacactccctataagcaaggccatcaggtacaaggcaaagattcaggaccaacagaggctcctctttaaaggacagcagcttgtggatggacagacgctcgccgattacaatgttcggatacaatccaccctgcgcattgactgtcccatcatgcagatctttgtgaagacgtgcactgggcagacgatcactctagaggtggagccgtctaacacgattgatgatgtcaaggaaacaagcttgacgatgcgaagacacttgctgagtgcaatgtacgtacggggtctaccctgcaccttgatgcttagctacaaaattttggtgtcttctgatgctctactacttaatttatttatcctccgcctctggacactagttgtccttgtctgtgtctactggttgaaataa

SEQ ID NO: 17919 - protein, 191 aa, Sorghum bicolor
  misc_feature: Useful for making plants with modulated cold sensitivity
  misc_feature: Functional homolog of the protein sequence given in SEQ ID NO 13521
  misc_feature: Ceres ANNOT ID no. 8683769
MPNGKIITVEVEPSDTVGDVEAKIQDQQRIIFDGSRLDKKCKPGFYKRGGMPIAVKTLPISKAIRYKAKIQDQQRLLFKGQQLVDGQTLADYNVRIQSTLRIDCPIMQIFVKTCTGQTITLEVEPSNTIDDVKETSLTMRRHLLSAMYVRGLPCTLMLSYKILVSSDALLLNLFILRLWTLVVLVCVYWLK

SEQ ID NO: 17920 - DNA, 714 bp, Sorghum bicolor
  misc_feature: Ceres ANNOT ID no. 8683776
  misc_feature: Encodes the peptide sequence at SEQ ID NO 17921
atggatgagaagcagcgacggctcacctggatcaggcatagcagggcttgctttcgcacgtgtgatcgatcggttcgatcagcccacgaaacattgggatactactgtcacttgatccaaaacgactctaccctgaacctcgacttgggcatgcagattttcgtgaagatgcccaatggcaagatcattacagttgaggtggagccgtccgatacagtcggcgatgtcgaggcaaagatagaggaccagcagaggatcatctttgacggcagccgacttgataagaagtgcaaacctggcttttacaagcgtggcagcatgccgattgacgtcaagacactccctataagcaaggccatcaggtacaaggtgcagtttactgacaaggttggcgatttgaaggcaaagattcaggaccaacagaggctcctctttaaaggacagcagcttgtggatggacagacgctcgccgattacaacgttcggagacaatccaccctgcgccttgactgtcccgtcatgcagatctttgtgaagacgtgcactgggcagacgatcactctagaggtggagccgtctaacacgattgatgatgtcaaggaaaagatccgtggtcaccagagtctcacctttgatggcaacaagcttgacgatgcgaagacacttgctgagtgcaatgtacgtacggggtctaacctgcaccttgatgcttag

SEQ ID NO: 17921 - protein, 237 aa, Sorghum bicolor
  misc_feature: Useful for making plants with modulated cold sensitivity
  misc_feature: Functional homolog of the protein sequence given in SEQ ID NO 13521
  misc_feature: Ceres ANNOT ID no. 8683776
  misc_feature (112)..(174): Pfam ID: ubiquitin Pfam Description: Ubiquitin family
  misc_feature (179)..(236): Pfam ID: ubiquitin Pfam Description: Ubiquitin family
MDEKQRRLTWIRHSRACFRTCDRSVRSAHETLGYYCHLIQNDSTLNLDLGMQIFVKMPNGKIITVEVEPSDTVGDVEAKIEDQQRIIFDGSRLDKKCKPGFYKRGSMPIDVKTLPISKAIRYKVQFTDKVGDLKAKIQDQQRLLFKGQQLVDGQTLADYNVRRQSTLRLDCPVMQIFVKTCTGQTITLEVEPSNTIDDVKEKIRGHQSLTFDGNKLDDAKTLAECNVRTGSNLHLDA

SEQ ID NO: 17922 - DNA, 243 bp, Sorghum bicolor
  misc_feature: Ceres ANNOT ID no. 8684020
  misc_feature: Encodes the peptide sequence at SEQ ID NO 17923
atggaggtgttggcacaggcaaaggagatgatctaccgtgcagccgcgatgcgcttcgtctccctcggctccgaaaacagcgacgagcaccagggacggctcaacgtgcgcatctcatctgacctgcaaacagtcacggcatggctgcgccagaagcggatcagcgagcacctccgcttggcattggcaccggcagtagtcttgctggagcagacggaagggaaggaaaaagctgttacatga

SEQ ID NO: 17923 - protein, 80 aa, Sorghum bicolor
  misc_feature: The sequence is a functional homolog of SEQ ID NO 1939 in the 10/374,780 US patent application
  misc_feature: The sequence is a functional homolog of SEQ ID NO 1937 in the 10/374,780 US patent application
  misc_feature: The sequence is a functional homolog of SEQ ID NO 134 in the 10/225,066 US patent application
  misc_feature: The sequence is a functional homolog of SEQ ID NO 448 in the 10/374,780 US patent application
  misc_feature: Ceres ANNOT ID no. 8684020
MEVLAQAKEMIYRAAAMRFVSLGSENSDEHQGRLNVRISSDLQTVTAWLRQKRISEHLRLALAPAVVLLEQTEGKEKAVT

SEQ ID NO: 17924 - DNA, 1365 bp, Sorghum bicolor
  misc_feature: Ceres ANNOT ID no. 8684162
  misc_feature: Encodes the peptide sequence at SEQ ID NO 17925
atgggtgcggagctgctgctgtggacggcatgggtgcagagctgctgcggcggcggggcgggcatgcgtgtggagctcggcggcgcagcgtgtgcgtgcgtgcgtgaggagccgagcggaggagtccgtgagcgtctgaatagtttagtttatttatttttacatgaactctactactacttattaggatgtttctctgctagcactcctggctttatgcgggaacagcagtcacagcgggccgatagcaatttagatgcattatttgcttctccaatgaaaccaaatttcttcaatttgcttaggcctcgccccagaggatttagtgataagatcatatttcctttagcccacacttttgacccagaagaactaagctcttatactactgtgaactgcaacagtgcaactaatctttccaatttatcaaatctcttttgcttaatgtgttcatttgttaatttcttatgtcagttccttgagggcgccttcacaggccgcgccgtcctctccccgtggtggcgcccggcccctcagccctcttgcatcatttgggatggacccgcccggcccctcaggatgctcactccggaaaaggtcctgcttcgtcaactaaaaggcggcggccggccagatccggtgggcggcggcccggatctgccaccctacggcgctcccctgccctttggcgtgccgaggtggccgtggacggagtggccgcgtgccagagcgctctcaggcttcgtcccagcgcccgccccccccttcgccggcgctcggcggtgctcctcccccgggccggccggcctcgtcggagcaccagaccgtgtgacgtcgccgccgaagcggccggcggggtggaccaagttccgcgagacgcggcaccccgtgttccgcggcgtccgtcgccggggcaacgccggccggtgggtgtgcgaggtgcgtgtgccggggaggcgtggctgcaggctctggctcggcacattcgacaccgccgaggccgcggcgcgcgcgcacgacaccgccatgctcgccatcgccggcgcgggcgcgtgcctcaacttcgccgattcggcttggctcctcgcggttccggcctccgaccggtcgctggcggtgcccaccccgcgcggcgcgagcgccgggctgcgcgtgccgtacaaggtgaccaccccgttgcggaaggtgaaggccgtgcggcccagcgagaacaagcaccggccggagcagaagtacgtgcacctcgcctccaacgacggcttcgtgttctggtggcttcggccttgtccgggacgggccggatctgagctcgctcgacccggcccgctttcgctgctccggcgtcccgtcccggtggccgtgtga

SEQ ID NO: 17925 - protein, 454 aa, Sorghum bicolor
  misc_feature: The sequence is a functional homolog of SEQ ID NO 1248 in the 10/374,780 US patent application
  misc_feature: The sequence is a functional homolog of SEQ ID NO 1236 in the 10/374,780 US patent application
  misc_feature: Ceres ANNOT ID no. 8684162
  misc_feature (296)..(349): Pfam ID: AP2 Pfam Description: AP2 domain
MGAELLLWTAWVQSCCGGGAGMRVELGGAACACVREEPSGGVRERLNSLVYLFLHELYYYLLGCFSASTPGFMREQQSQRADSNLDALFASPMKPNFFNLLRPRPRGFSDKIIFPLAHTFDPEELSSYTTVNCNSATNLSNLSNLFCLMCSFVNFLCQFLEGAFTGRAVLSPWWRPAPQPSCIIWDGPARPLRMLTPEKVLLRQLKGGGRPDPVGGGPDLPPYGAPLPFGVPRWPWTEWPRARALSGFVPAPAPPFAGARRCSSPGPAGLVGAPDRVTSPPKRPAGWTKFRETRHPVFRGVRRRGNAGRWVCEVRVPGRRGCRLWLGTFDTAEAAARAHDTAMLAIAGAGACLNFADSAWLLAVPASDRSLAVPTPRGASAGLRVPYKVTTPLRKVKAVRPSENKHRPEQKYVHLASNDGFVFWWLRPCPGRAGSELARPGPLSLLRRPVPVAV

SEQ ID NO: 17926 - DNA, 339 bp, Sorghum bicolor
  misc_feature: Ceres ANNOT ID no. 8684282
  misc_feature: Encodes the peptide sequence at SEQ ID NO 17927
atggcgcagcagctgtcgccgacgttctacgacgcgagctgccccaacctgcagagcatcgtgcgctccggcatggccgccgccgtgcagcaggagccccggatgggggcctccatcctccgcctcttcttccacgactgcttcgtccagttgtctgaaatggtagcagccataagcagagcacctgtgggatacaaatggccatcaagtgagaaggcaagaaccactcttctagatgcaggcaagagaaacgtggagcaggacttaacgccaattacaaatacatggttgcaatggctgtcagagagtagcacacaaaggcaaaagaaagagttgtga

SEQ ID NO: 17927 - protein, 112 aa, Sorghum bicolor
  misc_feature: Useful for making plants with altered carbohydrate content
  misc_feature: Functional homolog of the protein sequence given in SEQ ID NO 13713
  misc_feature: Ceres ANNOT ID no. 8684282
  misc_feature (4)..(50): SWISSPROT Homolog: EC 1.11.1.7 Peroxidase
MAQQLSPTFYDASCPNLQSIVRSGMAAAVQQEPRMGASILRLFFHDCFVQLSEMVAAISRAPVGYKWPSSEKARTTLLDAGKRNVEQDLTPITNTWLQWLSESSTQRQKKEL

SEQ ID NO: 17928 - DNA, 1722 bp, Sorghum bicolor
  misc_feature: Ceres ANNOT ID no. 8684383
  misc_feature: Encodes the peptide sequence at SEQ ID NO 17929
atggccacagtggtggtgctgctagctctcgcgacgggagtcgcgcctgcggccaccgaaccaaagcatgacgacggtgccgtcgtcgtcgtttcgtcgacgatcggcaccaccgcatcaccgtcgtcgaccgccatgaacgtcaccgcgatctgccagacgacgccgtacccgagcgcgtgcgagacggcgctctcgtcgtcgtcgtcgccggcgccgccaccaggcggctcatcatcatcatccagcagcagcgccgccgaccctttcgcggcgtccgtgcagtacgcgatggctcgggccttgtcggcgcgcgcggtggcgcggaacgtctcggcggcgcatcgtcgtcgtcctcctccccgcggcgccgcgcatcgtccgccgccgggcgtgcaggactgcgccgagctgctcgacatcagcctggaccagctgggcgacgcgctcgccgccgcgggcgcggggggcggcggcggcgacgcggacggggtcaccacgtggctcagcgccgcgctgacgaaccaggccacgtgcggcgacagcctcgcggccgacgcggacaccgcggggcgcgacgccgtgcgcgcgcgcgtctccgcgctctcccagttcatcgccaccgcgctggctctgcacgtcaacaagatcaagggtcacgagagcagcagcagcagcagaagctcaccgtccggctcctcgtcgccgtcgacgccagcagcgacgacgacggcgttcccgtcctgggtgacccaacaggaccggaacctcctggagttctccgcgggagcgagtggtggcgccatcgtggcggacgcagtggtggcgctggacggcagcgggacgcaccggagcatcaacgaggcgatcgcggccgtcaccggcggcggcggtggcagcagcgggaggaaggtgatacacgtgaaggccgggaggtacgaggagagcgtgagcatctcgagcaagcagaagaacgtgatgctgatgggcgacggaaaggggaagagcgtcatcgtcggccacaagagcgccggcgaaggctacaccacctatgcctccgccaccgtcgctgcgatggggtcgggcttcatcgccaaggggctcaccatcctcaacaccgccggagcagggaagggtcaggcggtggcgctgcgcgtcggcggcgacctctcggtggtgtaccagtgcggcatccaggcgtaccaggacacgctctacgtccactcgggccggcagttctacgccggcaccgacatcgccggcaccgtggacttcatcttcggcaacgccgccgtggtgctgcagagctgcgacatccaggcgcggaggccgagcccggggcaggaggacacggtgacggcgcagggccggacggacccgaaccagaacaccggcatctccatccaccggtgcagggtcaccgccgcgccggacctcgccgggacggcgacgccggtctacctcggccggccgtggcggaggtactcccggaccgtcgtcatggagagcttcctcgaccggtcggtctcgccggcggggtggctggagtggtccgggcagttcgctctcagcacgctgtactatggggagtacggcaacaccgggcctggcgccgggaccagccggcgtgtgacgtggcctggagtgcacacgtcactgtccaggtcggatgccgtgaggtttaccgtggcggagttcatcgttggaacgcgtggactgtga

SEQ ID NO: 17929 - protein, 573 aa, Sorghum bicolor
  misc_feature: Useful for making plants with altered cell wall content and/or composition
  misc_feature: Functional homolog of the protein sequence given in SEQ ID NO 14587
  misc_feature: Useful for making plants with altered carbohydrate content
  misc_feature: Functional homolog of the protein sequence given in SEQ ID NO 14381
  misc_feature: Ceres ANNOT ID no. 8684383
  misc_feature (249)..(573): SWISSPROT Homolog: EC 3.1.1.11 Pectinesterase
  misc_feature (272)..(570): Pfam ID: Pectinesterase Pfam Description: Pectinesterase
  misc_feature (40)..(212): Pfam ID: PMEI Pfam Description: Plant invertase/pectin methylesterase inhibitor
MATVVVLLALATGVAPAATEPKHDDGAVVVVSSTIGTTASPSSTAMNVTAICQTTPYPSACETALSSSSSPAPPPGGSSSSSSSSAADPFAASVQYAMARALSARAVARNVSAAHRRRPPPRGAAHRPPPGVQDCAELLDISLDQLGDALAAAGAGGGGGDADGVTTWLSAALTNQATCGDSLAADADTAGRDAVRARVSALSQFIATALALHVNKIKGHESSSSSRSSPSGSSSPSTPAATTTAFPSWVTQQDRNLLEFSAGASGGAIVADAVVALDGSGTHRSINEAIAAVTGGGGGSSGRKVIHVKAGRYEESVSISSKQKNVMLMGDGKGKSVIVGHKSAGEGYTTYASATVAAMGSGFIAKGLTILNTAGAGKGQAVALRVGGDLSVVYQCGIQAYQDTLYVHSGRQFYAGTDIAGTVDFIFGNAAVVLQSCDIQARRPSPGQEDTVTAQGRTDPNQNTGISIHRCRVTAAPDLAGTATPVYLGRPWRRYSRTVVMESFLDRSVSPAGWLEWSGQFALSTLYYGEYGNTGPGAGTSRRVTWPGVHTSLSRSDAVRFTVAEFIVGTRGL

SEQ ID NO: 17930 - DNA, 162 bp, Sorghum bicolor
  misc_feature: Ceres ANNOT ID no. 8684406
  misc_feature: Encodes the peptide sequence at SEQ ID NO 17931
atgtcccagattccagtagtgtatgcgaggttcgagaaggagatcgctgggtacatcaaggatggcaaagtcaccgtcataaaggacgtcgtcgaggccctgatcgggctgttctctggcaaaaatgtagggaagcagttggttgccatagcaaggccatga

SEQ ID NO: 17931 - protein, 53 aa, Sorghum bicolor
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: Ceres ANNOT ID no. 8684406
MSQIPVVYARFEKEIAGYIKDGKVTVIKDVVEALIGLFSGKNVGKQLVAIARP

SEQ ID NO: 17932 - DNA, 1059 bp, Sorghum bicolor
  misc_feature: Ceres ANNOT ID no. 8684422
  misc_feature: Encodes the peptide sequence at SEQ ID NO 17933
atggccagcagtggcgaggtgaaggcggcggcggcggcggtgcagaacaagaaggtggtgctgaggcggcacgtgaccgggttccccactgaagacgacatggagatcacggtgggcactgccggtctgcgtgtgccggcggggctcaccgccgtgctgatcaagaacctctacctgtcctgcgacccatggatgcgcggccgcatgaccaagcacgaggacggcggcatgccgccggacttcgtcatcggagaggctttggtcaattacactgtgggcaaagtgttggactcgacgcacccggagttcaacgccggcgacctcgtctggggtatgagtggatgggaggactacaccctcgtcacccagcctgagtacctgtacaagatcaaccactccgatctgccgctctcctactacaccggcgttcttggcatgccaggtctcactgcatacgccggctttttcgaggtcggcaagcccaagaaaggcgatttcgtgttcgtctcggcggcgtccggcgccgtcgggcaggtcgtcgggcagctggccaagatcgccggctgctacgtggtcggcagcgccggctccgatgagaaggtcagcctgctaaaaaccaagtttggctacgacgacgccttcaactacaagtccgagaccgacatcggcgcggcgctgaagcggtgcctccccgacggcatcgacatctacttcgacagtgtcggcggcgcgacgctcgacgccgcgctgctgcagatgcgccatggcggcagggtcgccgtctgcgggatgatctcgcagtacaacctggaggagcccgacggcctgcgcaacctgttctgcatcatccccaaggccatcagggtggaggggttcaacgtcggtggctggttccatgtgtacgagaggttcgaggaggagatggcccggtacatcaaggaggggaaggtcaccgtcgtggaggacgtcgttgaggggatcgagagcgcgccggcggctctaatcggcttgttctccgggagaaatgttgggaaacagttggtggcgatgggaccgtga

SEQ ID NO: 17933 - protein, 352 aa, Sorghum bicolor
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: Ceres ANNOT ID no. 8684422
  misc_feature (103)..(263): SWISSPROT Homolog: EC 1.6.5.5 NADPH:quinone reductase
  misc_feature (163)..(313): Pfam ID: ADH_zinc_N Pfam Description: Zinc-binding dehydrogenase
MASSGEVKAAAAAVQNKKVVLRRHVTGFPTEDDMEITVGTAGLRVPAGLTAVLIKNLYLSCDPWMRGRMTKHEDGGMPPDFVIGEALVNYTVGKVLDSTHPEFNAGDLVWGMSGWEDYTLVTQPEYLYKINHSDLPLSYYTGVLGMPGLTAYAGFFEVGKPKKGDFVFVSAASGAVGQVVGQLAKIAGCYVVGSAGSDEKVSLLKTKFGYDDAFNYKSETDIGAALKRCLPDGIDIYFDSVGGATLDAALLQMRHGGRVAVCGMISQYNLEEPDGLRNLFCIIPKAIRVEGFNVGGWFHVYERFEEEMARYIKEGKVTVVEDVVEGIESAPAALIGLFSGRNVGKQLVAMGP

SEQ ID NO: 17934 - DNA, 1068 bp, Sorghum bicolor
  misc_feature: Ceres ANNOT ID no. 8684420
  misc_feature: Encodes the peptide sequence at SEQ ID NO 17935
atggccggcagcagcagcgaggagaaagcggtggcggcggtgcagaacaagaaggtggtgctgaggaggcacgtcaccgggttccccaccgaagacgacatggagatcacggtggacactaccgagattcgtgtgccggcggggcagaccgccgtgctgctcaagaacctctacctgtcctgtgacccatggatgcgcggccgcatgaccaagcacgaagacggcgcctccgtgccggccaccgactttgcgatcggagaggccatggtcaactacggtgtcggcaaggtgatagactcgacgcacccagagttcaccggcggcgacctcgtctgggggatgagtggatgggaagagtacacactcatcacccagccggaatccctgcacaagatcaaccacgccgacctgccgctctcctactacaccggcgttcttggcatgccggggctgacggcgtacgcagggttcacccaggtcggcaggcccaaaaagggcgacttcgtgttcgtctcggcggcgtcaggcgccgtcgggcagctcgtcggtcagctggcgaagatcgccggctgctacgtggtcggcagcgccggctccgacgagaaggtgggtctgctcaagaccaagttcggctacgacgacgcgttcaactacaagtccgagaccgacctcggcgccgcgctgaagcggcgcctccccgacggcgtcgacatctacttcgacaacgtcggcggcgcgacgctggacgccgcgctgctgcacatgcgcgacggcggcagggtcgccgtctgcgggatgatctcgcagtacaacctggaggagcgagacggcctgcgcaacctgtactgcgtcatccccaaggccatcagggtggaggggttcaatgttggccgcttcttccatctgtacgagaggttcgaggaggagatggctgggtacatcaaggacgggaaggtcgccgtcgttgaggacgtcgtcgagggtattgaaagcgcaccggcagctctgatcgggctgttctcgggcaaaaatgtggggaagcaggtggttgcgattgcaagggcatga

SEQ ID NO: 17935 - protein, 355 aa, Sorghum bicolor
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: Ceres ANNOT ID no. 8684420
  misc_feature (93)..(276): SWISSPROT Homolog: EC 1.6.5.5 NADPH:quinone reductase
  misc_feature (165)..(315): Pfam ID: ADH_zinc_N Pfam Description: Zinc-binding dehydrogenase
MAGSSSEEKAVAAVQNKKVVLRRHVTGFPTEDDMEITVDTTEIRVPAGQTAVLLKNLYLSCDPWMRGRMTKHEDGASVPATDFAIGEAMVNYGVGKVIDSTHPEFTGGDLVWGMSGWEEYTLITQPESLHKINHADLPLSYYTGVLGMPGLTAYAGFTQVGRPKKGDFVFVSAASGAVGQLVGQLAKIAGCYVVGSAGSDEKVGLLKTKFGYDDAFNYKSETDLGAALKRRLPDGVDIYFDNVGGATLDAALLHMRDGGRVAVCGMISQYNLEERDGLRNLYCVIPKAIRVEGFNVGRFFHLYERFEEEMAGYIKDGKVAVVEDVVEGIESAPAALIGLFSGKNVGKQVVAIARA

SEQ ID NO: 17936 - DNA, 429 bp, Sorghum bicolor
  misc_feature: Ceres ANNOT ID no. 8684611
  misc_feature: Encodes the peptide sequence at SEQ ID NO 17937
atggacggcggcggcacgcaccgcacgccggaagacgtgttccgggacttccgcgcgcggcgggctggcatgatcaaagcgctcaccaccgacgtggagaagttctaccagcagtgtgacccagagaaagagaatctgtgtttgtatggtcttcccaatgaaacatgggaagtgaacttgcctgcagaggaggttcctcctgaacttccagagccagctctgggaattaattttgctcgtgacgggatggatgagaaagattggctgtcactagtagcggtgcacagtgatgcttggttgctggctgtggccttttactttggtgcaagatttggatttgacaaagaatccagttgttctgtaccattctttgtaaccaatttttcatcaaaatttaaaggtgaattgggcatcagtgcatacaaatga

SEQ ID NO: 17937 - protein, 142 aa, Sorghum bicolor
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: Useful for making plants with altered alkaloid content
  misc_feature: Functional homolog of the protein sequence given in SEQ ID NO 13176
  misc_feature: The sequence is a functional homolog of SEQ ID NO 1981 in the 11/479,226 US patent application
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Useful for making plants with altered lignin content
  misc_feature: Useful for making plants with modulated flowering time
  misc_feature: Functional homolog of the protein sequence given in SEQ ID NO 13473
  misc_feature: Ceres ANNOT ID no. 8684611
MDGGGTHRTPEDVFRDFRARRAGMIKALTTDVEKFYQQCDPEKENLCLYGLPNETWEVNLPAEEVPPELPEPALGINFARDGMDEKDWLSLVAVHSDAWLLAVAFYFGARFGFDKESSCSVPFFVTNFSSKFKGELGISAYK

SEQ ID NO: 17938 - DNA, 423 bp, Sorghum bicolor
  misc_feature: Ceres ANNOT ID no. 8684612
  misc_feature: Encodes the peptide sequence at SEQ ID NO 17939
atggcgactaggaagcggctttttgtcatgattaataacctccctaccatatatgaagttgtcacgggaactgccaagaagcaaaccaaggagaaaactcccaaaagcagcagcaagagcaataaatctggctcaaaaccaccacgccagccagaacccaactcaaggggttccaagatgccacctccaaaggatgaggatgatagcggaggcgaggaagaggaggaagaggaagatcatgaaaacacattgtgtggtgcttgtggtgacaactacggacaggatgagttctggatatgctgtgatgcctgtgagacttggttccatggcaagtgtgtcaagatcactcctgccaaggccgagcacatcaagcactacaagtgtccgaactgcagtggtagtagcaagagagcgcgggtgtga

SEQ ID NO: 17939 - protein, 140 aa, Sorghum bicolor
  misc_feature: Useful for making plants with altered alkaloid content
  misc_feature: Functional homolog of the protein sequence given in SEQ ID NO 13176
  misc_feature: The sequence is a functional homolog of SEQ ID NO 1981 in the 11/479,226 US patent application
  misc_feature: Ceres ANNOT ID no. 8684612
  misc_feature (82)..(131): SWISSPROT Homolog: EC 2.1.1.43 Histone-lysine N-methyltransferase
  misc_feature (84)..(134): Pfam ID: PHD Pfam Description: PHD-finger
MATRKRLFVMINNLPTIYEVVTGTAKKQTKEKTPKSSSKSNKSGSKPPRQPEPNSRGSKMPPPKDEDDSGGEEEEEEEDHENTLCGACGDNYGQDEFWICCDACETWFHGKCVKITPAKAEHIKHYKCPNCSGSSKRARV

SEQ ID NO: 17940 - DNA, 1185 bp, Sorghum bicolor
  misc_feature: Ceres ANNOT ID no. 8684648
  misc_feature: Encodes the peptide sequence at SEQ ID NO 17941
atggatctttctggcacgcagggcgagctcgcgatcccaatgcacgccaacgtcgcgtcgccctacggaggcggcggcggaggcggccatgtcctgcagcagctgcacggccgtggtgaccacggcagcaacaacaatggccagcagtctccggtgtcggcggcggcgctgacgccgtccccgcctgttgccgcggtggaggagacggagagctccgggaagaagcgcgggccggtggccggcgccagctccgcggtgaagtaccgggagtgcctcaagaaccacgcggcggccatcggcgggaacgccaccgacgggtgcggcgagttcatgcccagcggcgaggagggctcgctggaggcgctcaagtgctccgcctgcggctgccaccgcaatttccaccgcaaggaggtggacgacgacgacgacgacgtgtacgccgccgccgacggcttcagcggcctgggcctgggccacgggcaccgcgccgcccgccgtctcctggcgcccgccatggcgcacccgcaccacaagaccggcggcggcggcgggctcctgatctccggtgccgacccctacggcgcctacgcggcgtcgcgcgcgctccctccggcgcttccgccgccgccggggcacgggcacgcccaccaccaccagtacgtgatgccgctgaacatgatgcacacctcggagtccgacgagatggagggcggcggaggcggcgcggtcgcaggctgcgtcgacgcggcgcgcggcggcggcagcggcgggtcgtcgtcgtccaggaagcggttccgcaccaagttcaccccggagcagaaggcgcgcatgctggagttcgcggagcgcgtggggtggcgcctccagcggctggacgacggcatggtgcaggccttctgccaggagatcggcgtgaagcggcgcgtgctcaaggtgtggatgcacaacaacaagcacaacctcgccaccaagcgcctggaggcctcgccggcggccgcgcaggagcagcaggcgatggcgccgggcatggcgtcgccgccgccgccgccaccaccgcagcaccacatgcctcttcacatgcccgctgcagtcatgccgccgccgccgccgccgctgccaacgcagaccgggccgtcctgccaccgcggcggtcccggctccccgctgccgctcaagctcgagtga

SEQ ID NO: 17941 - protein, 394 aa, Sorghum bicolor
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13913
  misc_feature: Useful for making plants with modulated low light sensitivity
  misc_feature: Functional homolog of the protein sequence given in SEQ ID NO 13756
  misc_feature: Ceres ANNOT ID no. 8684648
  misc_feature (83)..(142): Pfam ID: ZF-HD_dimer Pfam Description: ZF-HD protein dimerisation region
MDLSGTQGELAIPMHANVASPYGGGGGGGHVLQQLHGRGDHGSNNNGQQSPVSAAALTPSPPVAAVEETESSGKKRGPVAGASSAVKYRECLKNHAAAIGGNATDGCGEFMPSGEEGSLEALKCSACGCHRNFHRKEVDDDDDDVYAAADGFSGLGLGHGHRAARRLLAPAMAHPHHKTGGGGGLLISGADPYGAYAASRALPPALPPPPGHGHAHHHQYVMPLNMMHTSESDEMEGGGGGAVAGCVDAARGGGSGGSSSSRKRFRTKFTPEQKARMLEFAERVGWRLQRLDDGMVQAFCQEIGVKRRVLKVWMHNNKHNLATKRLEASPAAAQEQQAMAPGMASPPPPPPPQHHMPLHMPAAVMPPPPPPLPTQTGPSCHRGGPGSPLPLKLE

SEQ ID NO: 17942 - DNA, 2412 bp, Sorghum bicolor
  misc_feature: Ceres ANNOT ID no. 8684676
  misc_feature: Encodes the peptide sequence at SEQ ID NO 17943
atggatcatcagaagcataaaagcagaaaagtgacagttgttgtgggccccaatctattgggggagatgcaactccctcttcatttgagaagagatggaatttctgggaaggttgagttaataccgaacccaatgttgagcaagttccagcaggcttgtgcaaaaggacattccgagaacgaccaaggtgcatctactgtggatctttttcaccaaggattgggtttcctcgtctcttgcaggtgctcttgccgccagccgtcgtgcgtcttcagctccacctctctagcaccgggctccgactgtgcaggtcgtcatcgatgcttgcttcaattcttcccaaatttattcaacagacgtactgacagaagtaggcttcgcaagtcaaagcgcatgggttccaattccatggaaggactcccccgtaccgccgtccacttcttgctcctaattttctgcatagccagcaaatgtctagcagcatcaggtctgaattcaacccagatggtaaccctcaaggttgatgcctcaccaaagcttgctcgaaagatccctgatatattccttggggtgttttttgaggagatgggcaacggaggagctggtggaatatgggcagaactggtcagtaacagaggtttcgaagcaggaggccccaatactccgtcaaacattgacccctggctcatcgttggcgacgactcctccatttttgtggagactgatcgttcgtcatgtttcagtcgaaacatagtcgctttgaggatggaggtcctctgcaatgactgcccagccggtggtgttggcatttacaacccaggattctggggcatgaacatagaagatgggaaggcatacaatctagttatgtatgttaagtcgccaaaaaatacatgcttgacagtttcactaacaagctcagatgggttgcaaaatctggcttccgttaacataatagttgcagggaagtcgaagtggataaaggtggagaagaagttggttgctaaaggaactaatagaacctcaaggcttcaaataacatctaagaagaaaggagttgtgtggtttgaccaagtatcactcatgcctgcagacacatacaagggacacggttttcgtaatggactcgtgtcaatgcttttggatttaaaaccacgattcttaagatttcctgggggttgctttgtggaaggtggttggctaagaaatgcattcaggtggagacaatccattggtccgtgggaagagaggccaggacacttcggagactgttggcagtactggaccgacgatggtcttggatattttgaatttcttcagctttctgaggacataggtgctgccccaatctgggtattcaacactggaatcagctacaatgatgaagttaatactgctattattgccccctttgtgaaggagatattggacagcctagaatttgctaggggcagtgtgaattcaacatggggctctgtaagagctaaaatggggcaccctaaaccatttccagtcaagtatgttgcaatcggaaatgaagattgcgagagaaagttttacaaaggtaattacctcaagttttacaatgcaataagagaggcctatccagacattcaattgatttcgaactgtgatggctcatctgtaccacttgatcatcctgctgatatatatgatttccatgtttatgcagatgctaagactctgttttccatgaagaacacatttgacaagtcaccccgcagtggacccaaggcttttgtcagcgagtatgcagtttggaaaactgacgcaggtagaggaactcttcttgcttcattggcagaagctgctttccttactggactggagaagaacagtgatgctgtggagatggcttgccatgctccactattcgtaaatgacgatattgagaaaaagtggaacccagacgtcattgtcttcaatacctggcagcattacgggactcctagttactggatgcagaagattttccgtgagtctagtggtgctaccgttcatccaacgacaatcagttcaggtggcggtggctctgcaaattctctagcagcgtctgcaattacctggaaggattcagagaataactcattcctaagagtaaaggcaacttttgtgcagattgtaaactttgaatctgatgctgctagagtcacaatctccacaactggacttgaatctagcattgatgtgctgcgatcgaccgccactgttctcacatcaaccaatgtgatggatgaaaattctttcagtaacccaaacaaggtcgtgcctgttaagagccagctattcgaagcaggagcgcagatgcaagtcacgctggctcctcactcattcacatccttcgatcttgctctggctccgtccaaatttgccacgttggctgatgtctga

SEQ ID NO: 17943 - protein, 803 aa, Sorghum bicolor
  misc_feature: Useful for making plants with altered carbohydrate content
  misc_feature: Functional homolog of the protein sequence given in SEQ ID NO 14588
  misc_feature: Useful for making plants with altered cell wall content and/or composition
  misc_feature: Functional homolog of the protein sequence given in SEQ ID NO 13604
  misc_feature: Ceres ANNOT ID no. 8684676
  misc_feature (171)..(676): SWISSPROT Homolog: EC 3.2.1.55 Alpha-N-arabinofuranosidase
  misc_feature (589)..(784): Pfam ID: Alpha-L-AF_C Pfam Description: Alpha-L-arabinofuranosidase C-terminus
  misc_feature (206)..(364): Pfam ID: CBM_4_9 Pfam Description: Carbohydrate binding domain
MDHQKHKSRKVTVVVGPNLLGEMQLPLHLRRDGISGKVELIPNPMLSKFQQACAKGHSENDQGASTVDLFHQGLGFLVSCRCSCRQPSCVFSSTSLAPGSDCAGRHRCLLQFFPNLFNRRTDRSRLRKSKRMGSNSMEGLPRTAVHFLLLIFCIASKCLAASGLNSTQMVTLKVDASPKLARKIPDIFLGVFFEEMGNGGAGGIWAELVSNRGFEAGGPNTPSNIDPWLIVGDDSSIFVETDRSSCFSRNIVALRMEVLCNDCPAGGVGIYNPGFWGMNIEDGKAYNLVMYVKSPKNTCLTVSLTSSDGLQNLASVNIIVAGKSKWIKVEKKLVAKGTNRTSRLQITSKKKGVVWFDQVSLMPADTYKGHGFRNGLVSMLLDLKPRFLRFPGGCFVEGGWLRNAFRWRQSIGPWEERPGHFGDCWQYWTDDGLGYFEFLQLSEDIGAAPIWVFNTGISYNDEVNTAIIAPFVKEILDSLEFARGSVNSTWGSVRAKMGHPKPFPVKYVAIGNEDCERKFYKGNYLKFYNAIREAYPDIQLISNCDGSSVPLDHPADIYDFHVYADAKTLFSMKNTFDKSPRSGPKAFVSEYAVWKTDAGRGTLLASLAEAAFLTGLEKNSDAVEMACHAPLFVNDDIEKKWNPDVIVFNTWQHYGTPSYWMQKIFRESSGATVHPTTISSGGGGSANSLAASAITWKDSENNSFLRVKATFVQIVNFESDAARVTISTTGLESSIDVLRSTATVLTSTNVMDENSFSNPNKVVPVKSQLFEAGAQMQVTLAPHSFTSFDLALAPSKFATLADV

SEQ ID NO: 17944 - DNA, 525 bp, Sorghum bicolor
  misc_feature: Ceres ANNOT ID no. 8684705
  misc_feature: Encodes the peptide sequence at SEQ ID NO 17945
atggccaggaaccaccatttcgtccttgctgtattcctcatggctgctgccggcaccaccaccaccaccaccacagccacctcaccatcaggcaactcgacgccgacgccgacggcgtacgagatgctggagcggtacgatttcccgcgaggcatcctcccggagggcgtgcagcggtacgagctccgccccgacgacggctccttcgaggtgttcctctcgggccgcagctgcgagttccgcgtcggcgaccggtacctgctccggtacgaccgccggatctccgggacggcgcgggaaggctccatccgcgcgctgcagggcgtgagcgtcaaggtgctgttcgtgtggctcgccatcaccgaggtggaccgcgccggcgaccagctcagcttcctcgtcggcccgctcgccgcgtcgttcccaacgaaaaacttcgccgagagcccgcgctgccagtgtggcttcgactgcgcctacgtcgccggcgacgccgccgccgccactgccgtcgcggcctcctga

SEQ ID NO: 17945 - protein, 174 aa, Sorghum bicolor
  misc_feature: Useful for making plants with altered terpenoid content
  misc_feature: Functional homolog of the protein sequence given in SEQ ID NO 13044
  misc_feature: Ceres ANNOT ID no. 8684705
MARNHHFVLAVFLMAAAGTTTTTTTATSPSGNSTPTPTAYEMLERYDFPRGILPEGVQRYELRPDDGSFEVFLSGRSCEFRVGDRYLLRYDRRISGTAREGSIRALQGVSVKVLFVWLAITEVDRAGDQLSFLVGPLAASFPTKNFAESPRCQCGFDCAYVAGDAAAATAVAAS

SEQ ID NO: 17946 - DNA, 3216 bp, Sorghum bicolor
  misc_feature: Ceres ANNOT ID no. 8684757
  misc_feature: Encodes the peptide sequence at SEQ ID NO 17947
atggcggcggcggggaacgagtggatcaacgggtacctggaggcgatcctggacgcgggctcgaggctgcgcgggcagcggcagggctatggcggcggcgccggcgcggcgccgccgccgctgacgacggccgcgctgccgaggctgctggcggaggccggcggccatcaggctgccgcggcgtacagccccacgcgctacttcgtggaggaggtggtgagccgcttcgacgaccgggacctccacaagacgtggaccaaggttgtggcgacgcgcaacagccaggagcggagcaaccggctggagaacctgtgctggaggatctggcacgtcgcaaggaagacgaagcaggtggagtgggagtactcgcggcagctggcgcggcggcgcctggagcaggagcaaggcagccgggaggtcgccgaggagctctcggagggcgagaccaccaaggccgacgccggccagcagcaaccgcaagcaggcctgtcggtggcgaggatcggctccgaggcccggatcgtgtcggacgacgaggacgacgacggcaaggacggcgacaggaacctctacatcgtgctcatcagcattcacgggctggtacgtggcgagaacatggagctcggccgtgactctgacaccgggggccaggtgaagtacgtggtggagctggcgcgggcgctggcggccaccgccggcgtgcaccgcgtggacctgctgacgcgccagatctcctgcccggacgtcgactggacctacggcgagcccgtcgagatgatcacccatcaccacgccgacgacggcgacctcggcagcggcgggggagcctacatcgtgcggctgccgtgcgggccccgcgacaagtacctccccaaggagtccctgtggccgcacatcccggagttcgtggaccgcgcgctggcgcacgtcaccaacgtcgcccgcgcgctcggcgaccagctgcaccccgacgccgtcgccggcgcgggctccccgccgccggtgtggccgtacgtgatccacgggcactacgcggacgcggcggaggtggcggcgcacctggcgagcgcgctgaacgtgcccatggtgatgacgggccactccctggggcggaacaagctggagcagctgctgaagctgggccgcatgccgcgcgccgagatccagggcacgtaccggatcgcgcgccgcgtcgaggccgaggagaccggcctcgacgccgccgaagtggtggtcaccagcaccaagcaggagatcgaggagcagtggggcctctacgacggcttcgacctcatggtggagcgcaagctccgggtgcgccggcgccgcggcgtcagctgcctcggacgctacatgccgcggatggtcgtcatcccgccaggcatggacttcagctacgtcgacacgcaggacctcgccgccgacggcggcggcgacgccgaccttcagatgatcatcagcagcagctccaagaagccattgcctcccatctggtcggaggtgctgaggttcttcgccaacccgcacaagcccatgatcctggcgctgtcgaggccggacccgaagaagaacgtcaccacgctgctcaaggcctacggcgagagccgccacctccgcgagcttgcaaaccttacgctgatactggggaacagggatgacatcgaggagatgtccggcggcgccgccactgttctgacggcagtgctcaagctcatcgaccgctacgacctctacggctgcgtcgcctaccctaagcaccacaagcagaccgacgtgccgcacatttaccgcctcgccgccaagaccaagggagtgttcattaatcctgcactcgtggagccattcggcctcaccctgatcgaggctgctgcgtatggtctgcccgtggtggccaccaagaacggcgggccggtggacatcatcaaggcgctgcacaacgggctgctggtggacccgcacgacgcggcggcgatcacggaggcgctgctgagcctgctggccgacaaggcgcggtggggcgagtgccggcggaacggcctccgcaacatccaccgcttctcgtggccgcaccactgccgcctctacctctcccacgtggcggccaactgcgaccacccggcgccgcaccagctgctccgcgtgcccgccagcccgcgcgccgccgcggcggcggccgagcggagcaccgacggctcgctctcggactcgctccgcggcctgtccatctccatcgatgcctcgcacgacctcaaggccgcctgggccgggaccggggccggccgggactcacgtcgcggccgccatcatggacgcgctcagtcgccgggcctgctccccacgtatacgactcggccgccgactacgagggcagcgatcgggaacgctccggggcggcggcagagcctcctcgtcctcgccgtcgactgctataacggagacggcacaccggacgccgaccggatgaagaaggccgtcgacctcgcgctgtcggcggcggcggcggcaggtgggcggctcgggtgcgtgctgtcgaccgggatgaccatcgcggaggccgcggaagcgctcggcgcgtgcggcgccgacccggccgccttcgacgcgctcatctgcagcagcggcgcggagctctgctacccgtggagggacgtcgccgccgcggacgaagagtacgcggggcacgtggcgttccggtggcccggcgaccacgtgcgcgccgccgtgccgaggctcgggaaggccgagggcgcgaaggaggccgacctcgccgtcgatgaggccgcctgctccgtgcactgccacgcctacgccgtcgcgggcgcgtccaaggtgaagaaggtggactcgatccggcagtcgctgcgcatgcgcgggttccggtgcaacctcgtgtacacgcgcgcgtgcacgcgcctcaacgtgatcccgctctcggcgtcgcggccgcgcgcgctcaggtacctgtcgatacagtggggcatcgacctggacaaggtggccgtgctggtgggcgacaagggcgacacggaccgggagcgggtgctcccgggcctgcacaggacgctggtcctgccggagctagttagccacggcagcgaggagctgcgccgcgacgaagacgggtttctggcggaggacgtcgtcgccatggactccccgaacatcctcaccctcgccgagtaccaggcggcggccgacatcctcaaggctatctga

SEQ ID NO: 17947 - protein, 1071 aa, Sorghum bicolor
  misc_feature: Useful for making plants with altered cell wall content and/or composition
  misc_feature: Functional homolog of the protein sequence given in SEQ ID NO 14479
  misc_feature: Useful for making plants with modulated biomass
  misc_feature: Useful for making plants with modulated carbohydrate content
  misc_feature: Functional homolog of the protein sequence given in SEQ ID NO 13827
  misc_feature: Useful for making plants with altered carbohydrate content
  misc_feature: Functional homolog of the protein sequence given in SEQ ID NO 13828
  misc_feature: Ceres ANNOT ID no. 8684757
  misc_feature (62)..(716): SWISSPROT Homolog: EC 2.4.1.14 Sucrose-phosphate synthase
  misc_feature (499)..(682): Pfam ID: Glycos_transf_1 Pfam Description: Glycosyl transferases group 1
  misc_feature (799)..(1058): Pfam ID: S6PP Pfam Description: Sucrose-6F-phosphate phosphohydrolase
MAAAGNEWINGYLEAILDAGSRLRGQRQGYGGGAGAAPPPLTTAALPRLLAEAGGHQAAAAYSPTRYFVEEVVSRFDDRDLHKTWTKVVATRNSQERSNRLENLCWRIWHVARKTKQVEWEYSRQLARRRLEQEQGSREVAEELSEGETTKADAGQQQPQAGLSVARIGSEARIVSDDEDDDGKDGDRNLYIVLISIHGLVRGENMELGRDSDTGGQVKYVVELARALAATAGVHRVDLLTRQISCPDVDWTYGEPVEMITHHHADDGDLGSGGGAYIVRLPCGPRDKYLPKESLWPHIPEFVDRALAHVTNVARALGDQLHPDAVAGAGSPPPVWPYVIHGHYADAAEVAAHLASALNVPMVMTGHSLGRNKLEQLLKLGRMPRAEIQGTYRIARRVEAEETGLDAAEVVVTSTKQEIEEQWGLYDGFDLMVERKLRVRRRRGVSCLGRYMPRMVVIPPGMDFSYVDTQDLAADGGGDADLQMIISSSSKKPLPPIWSEVLRFFANPHKPMILALSRPDPKKNVTTLLKAYGESRHLRELANLTLILGNRDDIEEMSGGAATVLTAVLKLIDRYDLYGCVAYPKHHKQTDVPHIYRLAAKTKGVFINPALVEPFGLTLIEAAAYGLPVVATKNGGPVDIIKALHNGLLVDPHDAAAITEALLSLLADKARWGECRRNGLRNIHRFSWPHHCRLYLSHVAANCDHPAPHQLLRVPASPRAAAAAAERSTDGSLSDSLRGLSISIDASHDLKAAWAGTGAGRDSRRGRHHGRAQSPGLLPTYTTRPPTTRAAIGNAPGRRQSLLVLAVDCYNGDGTPDADRMKKAVDLALSAAAAAGGRLGCVLSTGMTIAEAAEALGACGADPAAFDALICSSGAELCYPWRDVAAADEEYAGHVAFRWPGDHVRAAVPRLGKAEGAKEADLAVDEAACSVHCHAYAVAGASKVKKVDSIRQSLRMRGFRCNLVYTRACTRLNVIPLSASRPRALRYLSIQWGIDLDKVAVLVGDKGDTDRERVLPGLHRTLVLPELVSHGSEELRRDEDGFLAEDVVAMDSPNILTLAEYQAAADILKAI

SEQ ID NO: 17948 - DNA, 1539 bp, Sorghum bicolor
  misc_feature: Ceres ANNOT ID no. 8684715
  misc_feature: Encodes the peptide sequence at SEQ ID NO 17949
atggagtggcccaatgacctgctgagctgtgtgctcctagcttccctagcagtcgtgctcctgcagctgcggcaacggagcaagctcccactgccaccaggccccaagcctctcccaatcatcggcaacctgatgatgatgggtcagctgacacaccgaggcctggcggcgctggcagagcgctacggcgggctgctgcacctccgtctcggccggcggcacgtcttcgtggtgtccacggcggagtacgcgcgcgaggtgttgcaggcgcaggacgtcgccttcgcgaaccggccggccactgccgcgatcgcgtacctcagctacggccacgccgacatggcgttcgcgcactacgggccattctggcgccaggcgcgcaagctctcggtcacgaagctcttcagccggcgccgcgccgagacgtggctcgccctgcgcgacgagtccgcggcgctcgtgcgcgccgtcgcgcggcgcagcggcgacggcgaggtggtgaacctgggcgagctggtcttcacactgagcacgaacgtcatcttccgtgccgcgtttggcaccggcggatgcgaggccctgcagggcgagtacatcggcgtcctccaagagttctccaagaacattagcacgttcagcatcggcgacttcatgccggcgtggctcgcctggatcgacctgaaccgccgccgcctccggcagacacgcgacgggctagacaggttcatcgacaagatcatcgacgaccacattcagagaggcaggagttcctccgacgcccaagccgacattgtcgacgaaatgctcgcctgtatccctcgtgacgacgccgtcgatgaccgccatggcggctccctccgcctcacccgccgcaacatcaaggcattcatcctggacatcatgtttggtgggacggagacagtggcatcgtccatcgagtggaccatgaaagagctgctgcggaacgccgacgagctacggcgtctgcagcaggagctcgccgacgtggtgggcatggaccagaacgtctccgagtccgacctcggcagcctccccttcctgaggtgcgtcgtcaaggagacgctccgcatgcacccgccgatcccgatgctgtaccacgcgacggccaaggactgcgtcgtcggcggctactccgtgcccggtggatcccaggtgacggtcaacgtctgggccatcggccgcgaccgccggacgtggaaggaccccgacgtgttccgcccgtcacggttcgccgcggaggatgtcgacggcgacgccgccgccgggctcgacctcaacggcagctgcttcgagttcctgccgttcggctccggccggcggtcgtgccccgggatggcgctgggcctgcacgcgctggagctcgccgtcgcgcagctcgcgcacgggttccgctgggcactgcccggcggcatgaagccgtcggacatcgacgtcgctgatgtctttgggctgtcggcgccatgcgccacacggctatacgccgtgcctacaccccggctcacctgcccgttgtactga

SEQ ID NO: 17949 - protein, 512 aa, Sorghum bicolor
  misc_feature: Useful for making plants with altered lignin content
  misc_feature: Functional homolog of the protein sequence given in SEQ ID NO 14138
  misc_feature: Useful for making plants with altered cell wall content and/or composition
  misc_feature: Functional homolog of the protein sequence given in SEQ ID NO 14139
  misc_feature: Ceres ANNOT ID no. 8684715
  misc_feature (43)..(512): SWISSPROT Homolog: EC 1.14.13.21 Flavonoid 3'-monooxygenase
  misc_feature (32)..(502): Pfam ID: p450 Pfam Description: Cytochrome P450
MEWPNDLLSCVLLASLAVVLLQLRQRSKLPLPPGPKPLPIIGNLMMMGQLTHRGLAALAERYGGLLHLRLGRRHVFVVSTAEYAREVLQAQDVAFANRPATAAIAYLSYGHADMAFAHYGPFWRQARKLSVTKLFSRRRAETWLALRDESAALVRAVARRSGDGEVVNLGELVFTLSTNVIFRAAFGTGGCEALQGEYIGVLQEFSKNISTFSIGDFMPAWLAWIDLNRRRLRQTRDGLDRFIDKIIDDHIQRGRSSSDAQADIVDEMLACIPRDDAVDDRHGGSLRLTRRNIKAFILDIMFGGTETVASSIEWTMKELLRNADELRRLQQELADVVGMDQNVSESDLGSLPFLRCVVKETLRMHPPIPMLYHATAKDCVVGGYSVPGGSQVTVNVWAIGRDRRTWKDPDVFRPSRFAAEDVDGDAAAGLDLNGSCFEFLPFGSGRRSCPGMALGLHALELAVAQLAHGFRWALPGGMKPSDIDVADVFGLSAPCATRLYAVPTPRLTCPLY

SEQ ID NO: 17950 - DNA, 285 bp, Sorghum bicolor
  misc_feature: Ceres ANNOT ID no. 8684753
  misc_feature: Encodes the peptide sequence at SEQ ID NO 17951
atggcgcgacagtatgacaattgtccgttcaatgaagtttcacggtgtatccacataggactcttgtgttttcaaggcagtccggactgtaggccactcatgtcagaagttttgtccatgctggagaacaaaaccattcagctcccactaccaatgcaaactgtgtattttccacgtagggatgctgaacgtggaagagtatgcaacaataggctacagtcattgaatgtttttgggtgtcacattggatgtgtcggaaggatatcgagaggtttcggatgctaa

SEQ ID NO: 17951 - protein, 94 aa, Sorghum bicolor
  misc_feature: Useful for making plants with modulated biomass
  misc_feature: Functional homolog of the protein sequence given in SEQ ID NO 14141
  misc_feature: Ceres ANNOT ID no. 8684753
MARQYDNCPFNEVSRCIHIGLLCFQGSPDCRPLMSEVLSMLENKTIQLPLPMQTVYFPRRDAERGRVCNNRLQSLNVFGCHIGCVGRISRGFGC

SEQ ID NO: 17952 - DNA, 1653 bp, Sorghum bicolor
  misc_feature: Ceres ANNOT ID no. 8685011
  misc_feature: Encodes the peptide sequence at SEQ ID NO 17953
atgtggaggctcaaagtgtcggagcgcagcagcccatggcttgggtcagtgaacaacctcctcgggaggcaagagtgggtgttggatcccgacgacctcggcacgccggaggagcgcgcccaggttgacagggcacgccgggagttcgccgaccaccgattcgaacgcaagcattctagtgacctcctcatgcggatccagtacgctaaagaaaaccctcataatcatctgggcgaccttcccccggctgtgaagcttcaagagaatgacgacgacattattacggaggaagccgtgtggacctctgtgaagcgagcagtaaaccgtgtatgtaatttgcaggcacatgatggacactggcctgcggattacggaggacttctcttccttatgccaggcttgattataacattatatgtgagtggagttctcaacgctgttttatcatcggaacatcagatagagatacttcggtacatctacaatcatcagaatgaagatggagggtggggattgcacatcgagggccacagcaccatgctcagctcagccttgaactatgttgctttgagattgcttggggagtgcccaaatggcggagatggagccatggagaaaggccgaaactggatactggatcatggaggagccatatttatggcagcatggggaaagttttggctctcagtactcggagtatatgattggtccggaaataacccggtaccaccagaattgtggctactaccacattacctgccgtttcacccaggtcgagtggtttgctattgccgaatggtgtatatgcccatgtcttacatttatggaaggaggttcgttggccccataacaccactagtactggaattaagaaaagagctgtacacagacgcctacgatgagattgactggaacaaagctcgtactgaatgtgctaaggaagatatgtacaaaccacattcattggttctggatatctcaatgaccattctccacaagtttgaacaaattatgttccattggccttggagaaaactgaggaacaaggctctggcatttaccatgaggcacgttcactatgaggatgagagcactcactacatcaaccttggtggtgtacccaaggtattaaatatgcttgctcgctggattgaagatcctaactcagaagcattcaaatgccatattgcacgagtatatgatttcttgtggattgccgaagatggcatgaagatgcagatatatgacggaagccagttgtgggacgcaactttcacggttgaggtccttttggccaccggccttgtcaaagagcttggaccaactcttaaacgagcacattcctttattaagaattctcagttgcttgaaaattgcctgggagatttgaactactggcatcgccatattagcaaaggtggatggacgtttagtacagcagatgatggttggcaagtttcagattgctctgcaaatggactaaaggtgtgtctattgttgtcaacgatctctcctgaaattgttggtgaaccactggaaatcgagagacagtttgatgctgttaattgtttgatgtctttgatgaataatgatggtggcttttcagcatttgaacccacaaggtcttcaccatggctcgaggtgagaatttaa

SEQ ID NO: 17953 - protein, 550 aa, Sorghum bicolor
  misc_feature: The sequence is a functional homolog of SEQ ID NO 6 in US patent 7122717
  misc_feature: The sequence is a functional homolog of SEQ ID NO 4 in US patent 7135624
  misc_feature: The sequence is a functional homolog of SEQ ID NO 15 in US patent 7186884
  misc_feature: Ceres ANNOT ID no. 8685011
  misc_feature: Up-regulated in root tissues in response to salicylic acid treatment
  misc_feature (1)..(548): SWISSPROT Homolog: EC 5.4.99.8 Cycloartenol synthase
  misc_feature (151)..(194): Pfam ID: Prenyltrans Pfam Description: Prenyltransferase and squalene oxidase repeat
MWRLKVSERSSPWLGSVNNLLGRQEWVLDPDDLGTPEERAQVDRARREFADHRFERKHSSDLLMRIQYAKENPHNHLGDLPPAVKLQENDDDIITEEAVWTSVKRAVNRVCNLQAHDGHWPADYGGLLFLMPGLIITLYVSGVLNAVLSSEHQIEILRYIYNHQNEDGGWGLHIEGHSTMLSSALNYVALRLLGECPNGGDGAMEKGRNWILDHGGAIFMAAWGKFWLSVLGVYDWSGNNPVPPELWLLPHYLPFHPGRVVCYCRMVYMPMSYIYGRRFVGPITPLVLELRKELYTDAYDEIDWNKARTECAKEDMYKPHSLVLDISMTILHKFEQIMFHWPWRKLRNKALAFTMRHVHYEDESTHYINLGGVPKVLNMLARWIEDPNSEAFKCHIARVYDFLWIAEDGMKMQIYDGSQLWDATFTVEVLLATGLVKELGPTLKRAHSFIKNSQLLENCLGDLNYWHRHISKGGWTFSTADDGWQVSDCSANGLKVCLLLSTISPEIVGEPLEIERQFDAVNCLMSLMNNDGGFSAFEPTRSSPWLEVRI

SEQ ID NO: 17954 - DNA, 3936 bp, Sorghum bicolor
  misc_feature: Ceres ANNOT ID no. 8685091
  misc_feature: Up-regulated in root tissues in response to salicylic acid treatment
  misc_feature: Encodes the peptide sequence at SEQ ID NO 17955
atggtctcccttcttgccaagctccgttccttgctggtctctgcagaggatcacctgccagagccgttgaagtcacagaaggacaagctcgagatcatcagacaagatctcgaagcaataaacaccttcctcgtgaatctgtcatgggtggaagctcccaacatgatggtgaagcactggatgaacgaggtgcgtgatctgtcctacgatattgaggattatattgacaattgtagggaagagccttgttctgattcagaggtggaggagttaagcactctcgtgaagcaggccaaggacgcccacgaacgccacaacaggtatgatcttgggcgttgggcatcaaatcctagatttgtggtcgatggtggcgagcagggcttggtaccaaggctcaacggggacgccacagaccttgttggtatcagtgattctaaggctgaacttatcaagcggcttaacattgacgccgaacagaggctagtattgtccatacaaggacctccaggtgttggtaagactacgcttgccaaacaagtgtactgtgaaattgaaggacggttcgagtgtggagcttttgttcgggcctcaaagatgcctgatacaaggaggcttctcagtagcataatctcccaaatccagccacgggatgaaagaccccctcatggtctacccgtgcaagagctcattgacagcctaagaaaacatctccaacagaagaggtatctgattgtaattgatggtttgtgggaaacaacatcatgggatattgttagtagcgcattccctgatgacactcattgtagcagaatattaataactacaaatatcgaagaagtagctttggagtgctgtgattatgaatctgatgctatttttaagatggagacacttggtggaaatcactccacagaattgttcttcaatagagtgtttggatttaagcatgagtgctctaaacaattgaaggaatgctctgaggaaattataagaacatgcggtggtctgccactcgcgatcattagcatagctagcattttagcaatccaaccagataacttagagctgtggcgccatgtgaaagaagcattattttcgagattgagatataatcttacttctgaagtcaagctgagagaaatagtaagtctgagctacaatagtcttccttgccatttgaagacgtgcctactatatcttagtatgtatcctgagggttatacattcttcaaggctgacttggtgaaacaatggagtgccgaaggttttataattcctggtgaagagaaaaattgtgatgaagttgcagaatgctattttgatgagcttacctgcaggggcctgatacaacccaatcataccaatatctcagatgaggtgactttgtatacactgcactccactgtatttgaagttattaggagcatgtccatagaagagaacttcagcactgtgatagactactccaataccatctcagagctttctgtaaagattcgacgactatctctcagattcagtagtgccaaatatgcaacaaaaccagaaaccattaaactatcccctgtgcggtcacttatgttttatggacttgttgagtgcctcccttcaattatggagtttgaggtacttcgagttcttattcttgatgtttggggtgaccatgaccaagaattagacctcagtggcatcggcagactgtttcagctgaggtacatgcggattacatctaacatcattgtcaaactaccagcaagggtgattggactacaatttttgcagacaatggaaatttatgcaaaagtaacttctgttccatcagatattattcatctcccgagattggtgcacctctgtgtacgtggtgagataaatctgtccaaagatattggccacatgggatctctacgcacatttcaatcttttgacctcagcagtaactctgaagataatatacggcaacttggtgagatgacagaccttcgtgatcttcatgtcatcagtcctacagaagtgtctgaccctctgaagggaaagttgatagcattcgtttcttcccttgagaaacttggcaatctaaaatctataatttttgaacttgcacctgctacttcatgcacaagcattgacttggattgctcatggagcatatcttctctgtccgtcttccttcagagactagagctgttaccgcccatttgcatcttttcaaggctccctgtttggattggacagctccggaagctatgcattttgaaaattgttcttagggaattgacgacaggtgatgttgacagcatcgccaaattacaggaactcaccattctctctctgtggcataaaaaaagtgagctagacgaggtagctgcagttgttgaagaagtgtcaccgtcggcccagcatcaggaagctccagcaccgccagtgtcgaggtttccccaggcccagccgcagccactggcgcagcagcctctggtgccgtctccgttggggctcagccggtacgagtcacagaagtggcgtgactggaacacgtttctgcaatatctgcagaaccacaggccgccgctgaaactggcatgctgcaccggcgcgcacgtcatcgagttcctccgctacctcgaccagttcggcaagaccagggtgcaccttgagggctgtgactactttggccagcccaacccaccggtgccctgcgcgtgcccgctgcgccaggcctggggatcgctcgatgcactcatcggccgcctccgcgccggatacgaggagttcggcggccgccccgagtctaacccgttcatggccaaagatgtgcgcatctacctccgcgacgtgcgggaggcgcaggcaaaggcaagcggcatctcctacgtgaagaagaagcccaagcacgggagcacggcagcgtctccggtcgcgccgcctcctgttgtaactgcagagaccgcggggacgatgtcaggagccgccggtgaggtggacgacgacgacgaaccatcgtcgtctgtaggtgaattgaggcagcgccagcgcaaggtcgccacttccgctgggggcatccccgctcccgctgccgccgcgcgcgcggcacagcagccacccacgcacgcggagctggagcgtgtgcgctgcgtcggcagcggcgccggtgggacggtgtggatggtgcggcaccgtggcacggggcagctctacgcgctcaaggtgctcaaagggaaccacaactacgacgtgcggcgccaaatcgcgcgtgagatcgccatcctccgcaccgccgaccacccggccgtggtgcgctgccacggcatgtacgagcacggcggggagctgcagatccttctcgagtacatggacggcggctccctcaacggccaccacatcgccaccgagccgttactcgccgacgtcgcgcggcaggtcctgtctgggatcgcctacctccaccgccgccacatcgtgcactgcggcatcaagccctccaacctcctcatcgactcggcgcgccacgtcaagatcgccgagtttggcgtcgggcacatcctcaaacagaccatggagccctccaactcttccgttggcaccatcgcctacatgagccccgagcagatcaacacaaaccttagcgatggcagctacgccggcgacgtctggagcttcggcctcagcattctcgagttgtacctgggcaggttccccttcggggagaacgagaacctcagcaagcagggggacttggccaacctcatgtgcgccatctgcttctcctatccgcctgagccaccgcgcaccgcctcgcccgagttcaggggattcattagctgctgcctgaagaagaacccggccaagcggctgacggccgcgcagctactgcagcacccttttgtcgcaagcacgcagccgcagccgcagctccttgctgctcctcccctgccatga

SEQ ID NO: 17955 - protein, 1311 aa, Sorghum bicolor
  misc_feature: Useful for making plants with modulated low light sensitivity
  misc_feature: Useful for making plants with modulated nitrogen use efficiency
  misc_feature: Functional homolog of the protein sequence given in SEQ ID NO 13437
  misc_feature: Useful for making plants with modulated flowering time
  misc_feature: Functional homolog of the protein sequence given in SEQ ID NO 13982
  misc_feature: Useful for biocontainment applications
  misc_feature: Functional homolog of the protein sequence given in SEQ ID NO 13983
  misc_feature: Useful for making plants with modulated biomass
  misc_feature: Functional homolog of the protein sequence given in SEQ ID NO 13338
  misc_feature: Ceres ANNOT ID no. 8685091
  misc_feature (1038)..(1295): SWISSPROT Homolog: EC 2.7.12.2 Mitogen-activated protein kinase kinase
  misc_feature (1039)..(1295): Pfam ID: Pkinase Pfam Description: Protein kinase domain
  misc_feature (125)..(429): Pfam ID: NB-ARC Pfam Description: NB-ARC domain
MVSLLAKLRSLLVSAEDHLPEPLKSQKDKLEIIRQDLEAINTFLVNLSWVEAPNMMVKHWMNEVRDLSYDIEDYIDNCREEPCSDSEVEELSTLVKQAKDAHERHNRYDLGRWASNPRFVVDGGEQGLVPRLNGDATDLVGISDSKAELIKRLNIDAEQRLVLSIQGPPGVGKTTLAKQVYCEIEGRFECGAFVRASKMPDTRRLLSSIISQIQPRDERPPHGLPVQELIDSLRKHLQQKRYLIVIDGLWETTSWDIVSSAFPDDTHCSRILITTNIEEVALECCDYESDAIFKMETLGGNHSTELFFNRVFGFKHECSKQLKECSEEIIRTCGGLPLAIISIASILAIQPDNLELWRHVKEALFSRLRYNLTSEVKLREIVSLSYNSLPCHLKTCLLYLSMYPEGYTFFKADLVKQWSAEGFIIPGEEKNCDEVAECYFDELTCRGLIQPNHTNISDEVTLYTLHSTVFEVIRSMSIEENFSTVIDYSNTISELSVKIRRLSLRFSSAKYATKPETIKLSPVRSLMFYGLVECLPSIMEFEVLRVLILDVWGDHDQELDLSGIGRLFQLRYMRITSNIIVKLPARVIGLQFLQTMEIYAKVTSVPSDIIHLPRLVHLCVRGEINLSKDIGHMGSLRTFQSFDLSSNSEDNIRQLGEMTDLRDLHVISPTEVSDPLKGKLIAFVSSLEKLGNLKSIIFELAPATSCTSIDLDCSWSISSLSVFLQRLELLPPICIFSRLPVWIGQLRKLCILKIVLRELTTGDVDSIAKLQELTILSLWHKKSELDEVAAVVEEVSPSAQHQEAPAPPVSRFPQAQPQPLAQQPLVPSPLGLSRYESQKWRDWNTFLQYLQNHRPPLKLACCTGAHVIEFLRYLDQFGKTRVHLEGCDYFGQPNPPVPCACPLRQAWGSLDALIGRLRAGYEEFGGRPESNPFMAKDVRIYLRDVREAQAKASGISYVKKKPKHGSTAASPVAPPPVVTAETAGTMSGAAGEVDDDDEPSSSVGELRQRQRKVATSAGGIPAPAAAARAAQQPPTHAELERVRCVGSGAGGTVWMVRHRGTGQLYALKVLKGNHNYDVRRQIAREIAILRTADHPAVVRCHGMYEHGGELQILLEYMDGGSLNGHHIATEPLLADVARQVLSGIAYLHRRHIVHCGIKPSNLLIDSARHVKIAEFGVGHILKQTMEPSNSSVGTIAYMSPEQINTNLSDGSYAGDVWSFGLSILELYLGRFPFGENENLSKQGDLANLMCAICFSYPPEPPRTASPEFRGFISCCLKKNPAKRLTAAQLLQHPFVASTQPQPQLLAAPPLP

SEQ ID NO: 17956 - DNA, 273 bp, Sorghum bicolor
  misc_feature: Ceres ANNOT ID no. 8685241
  misc_feature: Encodes the peptide sequence at SEQ ID NO 17957
atggtggtgcttgaactgctattcaccccccctctagccatattaggacctttcaccttctcctcggtctccaccgttggcgcgaagctggccgcatccacgggcatgtcggccggcggcgacggcgtcgccctcggtcagggacgcgtctggttcgagttcctcgacgacgaggacccgagccctgacctagacgacctcatgcggcacctcgcaaggaaggacttccggtgttcgcgaagttgctggggccgcaggcggcgttcagggtag

SEQ ID NO: 17957 - protein, 90 aa, Sorghum bicolor
  misc_feature: Useful for making plants with altered carbohydrate content
  misc_feature: Functional homolog of the protein sequence given in SEQ ID NO 14401
  misc_feature: Ceres ANNOT ID no. 8685241
MVVLELLFTPPLAILGPFTFSSVSTVGAKLAASTGMSAGGDGVALGQGRVWFEFLDDEDPSPDLDDLMRHLARKDFRCSRSCWGRRRRSG

SEQ ID NO: 17958 - DNA, 1236 bp, Sorghum bicolor
  misc_feature: Ceres ANNOT ID no. 8685270
  misc_feature: Encodes the peptide sequence at SEQ ID NO 17959
atggccggcgggagtagcgaaggcgaggcggcggcggtgccattgctggaggaagaggatcaggaacagcccacggcggtctacttcgatggctgccctgggtgcatcatcgaccgggagaaggcggagaacacagggatcccgtactggcgcttcttccacatctggatcatcaacctcgtcgtttgtttgccaatatcatcaatatttccattcatatacttcatgataagagacctacatgttgccaaacgagtagaagatattggattctatgcaggtttcatagtttctcgacctgagcatcatgctattggattgtcacttattagcacttcatgggcaataggtcttattcttgggccatccattggtgggtatcttgcacagccaacagagaaatatccaaaattgttccctgccaactcattgtttggaaggtttccatatttcttaccttgtttatgtataacggtcttttgccttggtattctattcagctgtgtttggctccaggagacattgcatacacacaaacttgagaaagaggaagatcaagcaacaaagactattaatgggcatttggctggtgatgaagagaatgttgagcaacatatcactttgactatgaataagaatttgtttcaaaattggccattaatttcttctattgttctcttttgtatcgctgcctttgatgacatgacatatatggagttgtttcctctatgggctgaaagtgacagaagttatggtggactaagtctactatctgaggatgttggtcaagtatttgcaattacaggtggctgcattcttctgtatcaaacttttatttttcctcatattgtgaaaattttgggacctgtcagtacttcccgtgttgtggctttttcatctatggtgcttctgtttacttatccatccatgacacatctctcaggattttggttgcctatagtgctaaatgttgcatcagcactgaaggccaattttgtcactcaagatcaaagagcaacagcaaatggcttagcaactactttaatgtcattttcaaaagcacttgctccaattggagggggtattgtgttttcgtgggtgcagaaacgtcaacatgctttcttctttccaggtgaccaaatgttgttcttccttatggacctcataatgttcatggcactaatttggacattcaagccatttctttccttgccggagcaactctcttcaagttga

SEQ ID NO: 17959 - protein, 411 aa, Sorghum bicolor
  misc_feature: Useful for making plants with modulated flowering time
  misc_feature: Functional homolog of the protein sequence given in SEQ ID NO 12969
  misc_feature: Ceres ANNOT ID no. 8685270
MAGGSSEGEAAAVPLLEEEDQEQPTAVYFDGCPGCIIDREKAENTGIPYWRFFHIWIINLVVCLPISSIFPFIYFMIRDLHVAKRVEDIGFYAGFIVSRPEHHAIGLSLISTSWAIGLILGPSIGGYLAQPTEKYPKLFPANSLFGRFPYFLPCLCITVFCLGILFSCVWLQETLHTHKLEKEEDQATKTINGHLAGDEENVEQHITLTMNKNLFQNWPLISSIVLFCIAAFDDMTYMELFPLWAESDRSYGGLSLLSEDVGQVFAITGGCILLYQTFIFPHIVKILGPVSTSRVVAFSSMVLLFTYPSMTHLSGFWLPIVLNVASALKANFVTQDQRATANGLATTLMSFSKALAPIGGGIVFSWVQKRQHAFFFPGDQMLFFLMDLIMFMALIWTFKPFLSLPEQLSSS

SEQ ID NO: 17960 - DNA, 852 bp, Sorghum bicolor
  misc_feature: Ceres ANNOT ID no. 8685340
  misc_feature: Encodes the peptide sequence at SEQ ID NO 17961
atggctggctgggtggacacatggctgggcggggcagtggtggccaacctaggtcgcccatgtcactgtggccgctggggaccggggcacacagtttggtcgtggcatgccgatggcaagtatgcccatgggcttccccagttgactagatctagtggagccgctattgtctgcatgtggcacaggatgcagatctttgtgaagagccccaccggtcggacaatctgcctcagggtacaaccatcagataccttgcaaaccgtgaaggcaaagattcaggaacgggaataccttgtctatgatggagtgcggctcgaggacaataatcttacactagctgactatggcatccagcatagatctacgcttgacctcgaagagaagatgcaaatctatgtagtggaaacactagcaggcacaaccatcactcttgaggtggacagctcagaaactattgacagcatcaagggaaagattcagtatagtgagagatttcctaaggttcagcagtgcctcatatttggtgacaaacagctggaggacaacagcaccttggcggaccacaacatttcaaaggagtccacccttcttcttgtcctccacccgcttccaagaggcaccatgcgtatcaaggtatatattggcgatggaaggattgtccctctggaagttcagaagtcagatacgattgccagtgtcagtttaaagatctatgagaaggcctttgttcggcccgtacagcatgcaatctattttgactcaacgaggctggagggcagcaagaccctggcacactatggcattgagaatggggatactctcgatttgattatctgccagtgtggctgttga

SEQ ID NO: 17961 - protein, 283 aa, Sorghum bicolor
  misc_feature: Useful for making plants with modulated cold sensitivity
  misc_feature: Functional homolog of the protein sequence given in SEQ ID NO 13521
  misc_feature: Ceres ANNOT ID no. 8685340
  misc_feature (135)..(203): Pfam ID: ubiquitin Pfam Description: Ubiquitin family
  misc_feature (68)..(130): Pfam ID: ubiquitin Pfam Description: Ubiquitin family
  misc_feature (211)..(281): Pfam ID: ubiquitin Pfam Description: Ubiquitin family
MAGWVDTWLGGAVVANLGRPCHCGRWGPGHTVWSWHADGKYAHGLPQLTRSSGAAIVCMWHRMQIFVKSPTGRTICLRVQPSDTLQTVKAKIQEREYLVYDGVRLEDNNLTLADYGIQHRSTLDLEEKMQIYVVETLAGTTITLEVDSSETIDSIKGKIQYSERFPKVQQCLIFGDKQLEDNSTLADHNISKESTLLLVLHPLPRGTMRIKVYIGDGRIVPLEVQKSDTIASVSLKIYEKAFVRPVQHAIYFDSTRLEGSKTLAHYGIENGDTLDLIICQCGC

SEQ ID NO: 17962 - DNA, 708 bp, Sorghum bicolor
  misc_feature: Ceres ANNOT ID no. 8685345
  misc_feature: Encodes the peptide sequence at SEQ ID NO 17963
atggggaacgtggatgttgatgtctatctatccaaaataaaatacaaaccattttggaggatgtatatctttgtgaagagctccattagcaggacaatccgtctcagggtccagccaactgatacattgtccactgtcaaggcaaagatccaggaacaatactaccttgcctttgatggagagcagctagacgataaccttacgttggctgattatgacatccagaataggtccacacttgacctcgaagaaaagatggaaatttatgtacaggagacgctgttaggcacaaaaatcaccgttgaggtagatagcttagataccattggtaacgtcaaggacatgattgaatctatagagggctttcccaagcatcagcagtgcctcctctttgacaagaaacaactagaggacaacagcaccatagctgacaacaacatttgcaaggaggccacccttctccttgtcctccactcgtctccaagaggtacgatgcaaatctttgtggagacgatactcaggaccctggctctagaggtgaacagcacagacaccatcagcaatgtcaagatgatgatctataagaaggagggcactcggcctaacaagcaacgcctcctctttgctggccagcagctgcaaaatgaccgcactcttggagactatggcattaagaatgagacgaccctccatctggtgctctgctga

SEQ ID NO: 17963 - protein, 235 aa, Sorghum bicolor
  misc_feature: Useful for making plants with modulated cold sensitivity
  misc_feature: Functional homolog of the protein sequence given in SEQ ID NO 13521
  misc_feature: Ceres ANNOT ID no. 8685345
  misc_feature (170)..(235): Pfam ID: ubiquitin Pfam Description: Ubiquitin family
  misc_feature (92)..(160): Pfam ID: ubiquitin Pfam Description: Ubiquitin family
  misc_feature (26)..(87): Pfam ID: ubiquitin Pfam Description: Ubiquitin family
MGNVDVDVYLSKIKYKPFWRMYIFVKSSISRTIRLRVQPTDTLSTVKAKIQEQYYLAFDGEQLDDNLTLADYDIQNRSTLDLEEKMEIYVQETLLGTKITVEVDSLDTIGNVKDMIESIEGFPKHQQCLLFDKKQLEDNSTIADNNICKEATLLLVLHSSPRGTMQIFVETILRTLALEVNSTDTISNVKMMIYKKEGTRPNKQRLLFAGQQLQNDRTLGDYGIKNETTLHLVLC

SEQ ID NO: 17964 - DNA, 873 bp, Sorghum bicolor
  misc_feature: Ceres ANNOT ID no. 8685693
  misc_feature: Encodes the peptide sequence at SEQ ID NO 17965
atggaacagcagtcctactgttacgaccttcccactaccacactgtcatcggcgccgcccgccttcgacacgacaacgacagacgacagcgacatgctactgcagcttgaagccttcctcctcggcaccgacgacgctgaggctgaggctgagcccaccaccgaggtggtgtcctccgactggtcgtcttctagttcctcgtcctcatcctccgccccaactttcccagaggtgggactgggagcggtagcgagaaccaccgccaacactcgcggcaatggcaatcagcatcgggggacggaagacaagcggcggcggcaggccttgatcggggtacgcaagcggccgtggggcaagttcgcggccgagatccgcgactccacgcgcaagggtgcccgcgtgtggctcggcaccttcgacactcccgaggccgccgcgctggcctacgaccaggccgccttcgccgcgcgcggcgccgccgccgtcctcaacttccccgtggagcgcgtggtggagtcgctgggggcgctccagctcccgctccccggcacaggaggtggttcgcctgtcctcgcgctcaagcggcgccactccaagcggacgcggaggcgcaaggtcgtcgtctcacctggaactgtcatcgatgtcagcaataatactaccaaggcagcagcacggttgcagcagccggtgcagcaatgctccgacgcgtccagctccattatggctgtggctagtagtagtagtagtatgccggagcagaggttggtgcctagccagtgccaccgaggcggcgttgtcgagctagaggaccttggcgacgattacatgcaggagctcctccggatatcatccgagttgaattattgttag

SEQ ID NO: 17965 - protein, 290 aa, Sorghum bicolor
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: Ceres ANNOT ID no. 8685693
  misc_feature (107)..(159): Pfam ID: AP2 Pfam Description: AP2 domain
MEQQSYCYDLPTTTLSSAPPAFDTTTTDDSDMLLQLEAFLLGTDDAEAEAEPTTEVVSSDWSSSSSSSSSSAPTFPEVGLGAVARTTANTRGNGNQHRGTEDKRRRQALIGVRKRPWGKFAAEIRDSTRKGARVWLGTFDTPEAAALAYDQAAFAARGAAAVLNFPVERVVESLGALQLPLPGTGGGSPVLALKRRHSKRTRRRKVVVSPGTVIDVSNNTTKAAARLQQPVQQCSDASSSIMAVASSSSSMPEQRLVPSQCHRGGVVELEDLGDDYMQELLRISSELNYC

SEQ ID NO: 17966 - DNA, 849 bp, Sorghum bicolor
  misc_feature: Ceres ANNOT ID no. 8685704
  misc_feature: Encodes the peptide sequence at SEQ ID NO 17967
atggaacaaggcgatcctactcacacctcctctgcctccaactgcgacgaccctgccgccgcagcaccagccaccgcgtggctatgccacgacacgacccacggcgacgacatgctactacagcagctcgccgccattcttgccccggccgacgacgagtgctgctccgacgactggctctcttcgtcgtcctccgaggcggtacaccaccaccagcggagttggccgctgcacgcggcgaacaacggcgtcgtcgcctgggcggcgggaggcgagaagcgggagacgacgaccacggccttcatcggggtgcgcaagcggccgtggggcaagttcgcggccgagatccgcgactccacgcgcaggggcgcccgcgtgtggctcggcaccttcgacacccccgaggccgccgcgctcgcctacgaccaggccgccttcgccgcgcgcggcgccgccgccgtgctcaacttccccgtggagcgcgtgacggagtcgctgggcgcgctcgcgctcgccggcggcacgggcggaggcggtggctcccctgtcctcgcgctgaagcgccggcactccaagcgcacgcgcaggcgcaacaagcccttcgccgccaccgtgacatgcgacgacagcaggaatctaaagacgcaacggcggcagccgcccgtggcgcggcgccaatgctctgggttgtccggcgtgtcgtcgtcctgcacggccatggcggcggcggtgccgcagcagcaggtgacgacgtcgcgtgagttgcgttacggcgtcgtggagctggaggacctcggcaccgattatctggacgagctactccgggtgtcgtcgcacttggagaactag

SEQ ID NO: 17967 - protein, 282 aa, Sorghum bicolor
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: Ceres ANNOT ID no. 8685704
  misc_feature (99)..(151): Pfam ID: AP2 Pfam Description: AP2 domain
MEQGDPTHTSSASNCDDPAAAAPATAWLCHDTTHGDDMLLQQLAAILAPADDECCSDDWLSSSSSEAVHHHQRSWPLHAANNGVVAWAAGGEKRETTTTAFIGVRKRPWGKFAAEIRDSTRRGARVWLGTFDTPEAAALAYDQAAFAARGAAAVLNFPVERVTESLGALALAGGTGGGGGSPVLALKRRHSKRTRRRNKPFAATVTCDDSRNLKTQRRQPPVARRQCSGLSGVSSSCTAMAAAVPQQQVTTSRELRYGVVELEDLGTDYLDELLRVSSHLEN

SEQ ID NO: 17968 - DNA, 1140 bp, Sorghum bicolor
  misc_feature: Ceres ANNOT ID no. 8685737
  misc_feature: Encodes the peptide sequence at SEQ ID NO 17969
atggcgaccgcagggaaagtgatcaagtgcaaagccgccgtggcgtgggaggccagcaagccgctgtcgatcgaggaggtggaggtggcgccgccgcaggccatggaggtgcgcgtcaagatcctctacaccgcgctctgccacaccgacgtctacttctgggaggccaagggccaaactccggtgttccccaggatcttaggacacgaagcgggaggcatcgtggagagcgttggggagggtgtgaccgagctcgcaccaggcgaccatgtcctcccggtgttcaccggcgagtgcaaggagtgtgcccactgcaaatccgaggagagcaacatgtgtgacctcctcaggatcaacgtcgaccgcggcgtgatgatcggcgacgggaagtcccgcttcaccatcaacgggcagcccatcttccacttcgttgggacatccaccttcagcgagtacaccgtcatccatgtcggctgcctcgccaagatcaacccggaggcgcctctcgacaaagtctgtatcctgagctgtggtatctcaactggccttggcgcaacactgaatgtggcaaaaccagtaaagggttcgacagtggcgattttcggtcttggtgctgtgggccttgctgctatggaaggtgctagactggctggagcatcaagaatcttcggtgtggacatcaacccagcaaaatacgagcaagctaagaaatttggctgcactgatttcgttaaccctaaggaccacgacaagccagtgcaagaggtactgattgagctgaccaatggtggtgtcgaccgcagcgtggagtgcaccggcaacgtgaacgccatgatatctgccttcgaatgtgttcacgacggatggggtgtcgccgtgctggttggtgtgccacacagggaggatcagttcaagacccaccccatgaacttcctcaacgagaagactctcaaggggaccttcttcggcaactacaagccccgcactgacctgcccaatgtcgtcgagatgtacatgaagaaggagctggagctggagaagttcatcacgcacagcgtgcccttctcggagatcaacacggcgttcgacctgatgctcaagggggagagcctgcgctgcatcatgagaatggaggactag

SEQ ID NO: 17969 - protein, 379 aa, Sorghum bicolor
  misc_feature: Useful for making plants with modulated heat sensitivity
  misc_feature: Functional homolog of the protein sequence given in SEQ ID NO 14109
  misc_feature: Ceres ANNOT ID no. 8685737
  misc_feature (1)..(379): SWISSPROT Homolog: EC 1.1.1.1 Alcohol dehydrogenase
  misc_feature (194)..(336): Pfam ID: ADH_zinc_N Pfam Description: Zinc-binding dehydrogenase
  misc_feature (34)..(163): Pfam ID: ADH_N Pfam Description: Alcohol dehydrogenase GroES-like domain
MATAGKVIKCKAAVAWEASKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTINGQPIFHFVGTSTFSEYTVIHVGCLAKINPEAPLDKVCILSCGISTGLGATLNVAKPVKGSTVAIFGLGAVGLAAMEGARLAGASRIFGVDINPAKYEQAKKFGCTDFVNPKDHDKPVQEVLIELTNGGVDRSVECTGNVNAMISAFECVHDGWGVAVLVGVPHREDQFKTHPMNFLNEKTLKGTFFGNYKPRTDLPNVVEMYMKKELELEKFITHSVPFSEINTAFDLMLKGESLRCIMRMED

SEQ ID NO: 17970 - DNA, 1026 bp, Sorghum bicolor
  misc_feature: Ceres ANNOT ID no. 8685775
  misc_feature: Encodes the peptide sequence at SEQ ID NO 17971
atggccaccagaaggtgtagtagtagcaacgtgccacctgcaggcttattggccgtgccatgcttgctgctgctgctgctcgccggcgtctccaacgggcagctccaggtggggttctactccaactcctgccccggcgccgagtccaccgtcgcctccgtcgtccggcagtccgggtccgccgaccccaccatcctcccggcgctcatccgcctccagttccacgactgcttcgtccgcggctgcgacgcctcggtgctcatcaagggcggcgccggcggcaacaacgccgaggtggacaacagcaagcaccagggcctccgcggcgtggagatcatcgagggcgccaagacccagctcgaggccctgtgccccggcgtcgtctcctgcgccgacatcgtcgtcctcgccgcccgagacgccatctccttcaccggcgggccgtcgttcgacgtgccgacggggcggctcgacgggaaggtgtccaacctgcgtgacgccgacgcgctgccggacgtgcacgacggcatcgacgcgctccgttccaagttccgcgccaacggactcgacgagaaggacctcgtcctcctcaccgctgcgcacacggtggggacgacggcgtgcttcttcctgcaggaccggctgtacaacttcccgctgcccggcggcggccggggctcggacccgaccatcccgccggggttcctgtcggagctcaagtcgcggtgcgcgccgggggacttgaacacgcggctggcgctggaccggggcagcgagggcgtgttcgacacctcgatcctccggaacatccggaacgggttcgccgtgatcggctccgacgcggcgctctacaacgacacggcgaccgtcgacgtcgtggactcctactccggcctgctcagcaacttcttcgggccctacttccggcaggacttcgcggacgccatggtacgcatgggcagcatcggcgtggtcaccggccggaagcagggcgaggtccggaaggtctgctccaagttcaactga

SEQ ID NO: 17971 - protein, 341 aa, Sorghum bicolor
  misc_feature: Useful for making plants with altered cell wall content and/or composition
  misc_feature: Functional homolog of the protein sequence given in SEQ ID NO 14589
  misc_feature: Useful for making plants with altered carbohydrate content
  misc_feature: Functional homolog of the protein sequence given in SEQ ID NO 13631
  misc_feature: Ceres ANNOT ID no. 8685775
  misc_feature (31)..(341): SWISSPROT Homolog: EC 1.11.1.7 Peroxidase
  misc_feature (51)..(299): Pfam ID: peroxidase Pfam Description: Peroxidase
MATRRCSSSNVPPAGLLAVPCLLLLLLAGVSNGQLQVGFYSNSCPGAESTVASVVRQSGSADPTILPALIRLQFHDCFVRGCDASVLIKGGAGGNNAEVDNSKHQGLRGVEIIEGAKTQLEALCPGVVSCADIVVLAARDAISFTGGPSFDVPTGRLDGKVSNLRDADALPDVHDGIDALRSKFRANGLDEKDLVLLTAAHTVGTTACFFLQDRLYNFPLPGGGRGSDPTIPPGFLSELKSRCAPGDLNTRLALDRGSEGVFDTSILRNIRNGFAVIGSDAALYNDTATVDVVDSYSGLLSNFFGPYFRQDFADAMVRMGSIGVVTGRKQGEVRKVCSKFN

SEQ ID NO: 17972 - DNA, 1587 bp, Sorghum bicolor
  misc_feature: Ceres ANNOT ID no. 8686011
  misc_feature: Encodes the peptide sequence at SEQ ID NO 17973
atggccacctacccctccacgctaggcgctgctcctaaatcattcttcttgtccaactctctcttcaatatcagcttgggaacggcaactcctagccgtatcagctcggtgaaggccgctggagagtgctggacgaagcatcctgcctggaccaatgtccggcaagaacggtgggagggtcatttggccgtggaaggacacctgcctacttggctgaatggcacgtacctaaggaacgggccaggtctctgggaagtcggcgaccactcctcccaccacatattcgacgggtacgccacactggtgcgcatctccttccggcgaggatgcgccaccggagcacatcgtcaggtcgagtcggacgcgtacaaagctgcccgggcgcacggccgtcctctccaccgggaattctcccaactgtgtccctcggagcctggaaccctgctcgaccgcgtgcgcgacgtcgtcggcctcgcaagcggcactttgctcaccgacaacgccaacgtctccgtgcttcctctaggggatggccgggtgctgtgcctcaccgaggccaccaagggctccgtcctgatagacccggaaactctcgacacaatcggcaagtttcggtacgcggataggctatggggcttgctgcagtccgcgcacccggttgtgacagggaacgagctgttgacgctgctcccggacatgttccgccgtggccatcgtgtggtcaggatggcagccgggagcaacgagaggaaaatggtcgggagagtgcactgccggggagggcaagcaccgggatgggtgcattccttcgccgtgacggagaagtacatcgtcgtgccggagatgcccctccgatactccctcgccggcgttctcaagtctcagatgacaccttggtatctcttcgactggctaccggagtctgggagctacatgcatgccatatgcaggttcaccggaaagactgtggcgagcgtggaggttcctccgttcatggcattacacttcattaacgcatacgaacaaggagatgcgatcattgctgactgctgcgagtactatgccgatccttctgtcatcaaggcacttgcactgcgtagactaagatctcccgggatgaacaatgatgcattccctgatgttagggttgcccggttcagtataccactggatggaaccctcatgggtgagctggagactgtgctggaccctgaggtgcatggccggggagtggagatgccttccatcaatccggcttaccagggtaaggaataccgttatgtgtacgcgtgtagcgcgcgaaggccatgcaatttcttgaactgcctcaccaagatcgatcttggggagaaagaggccaagaactggcacgagctgggctctgtgccatcagagcccttttttgtggcgaggccagggggatctgatgaagatgacggggttgtgatctccatcgtaagcaccatggaaggtgatgggtatgcgctactgctggacgccatgacttttcaggaaattgctcgagtaaggctcccctacggcctaccatacggcttccatggctgctggattccagagaatgtatga

SEQ ID NO: 17973 - protein, 528 aa, Sorghum bicolor
  misc_feature: Useful for making plants with modulated biomass
  misc_feature: Functional homolog of the protein sequence given in SEQ ID NO 14452
  misc_feature: Ceres ANNOT ID no. 8686011
  misc_feature (64)..(390): SWISSPROT Homolog: EC 1.14.99.36 Beta-carotene 15,15'-monooxygenase
  misc_feature (34)..(526): Pfam ID: RPE65 Pfam Description: Retinal pigment epithelial membrane protein
MATYPSTLGAAPKSFFLSNSLFNISLGTATPSRISSVKAAGECWTKHPAWTNVRQERWEGHLAVEGHLPTWLNGTYLRNGPGLWEVGDHSSHHIFDGYATLVRISFRRGCATGAHRQVESDAYKAARAHGRPLHREFSQLCPSEPGTLLDRVRDVVGLASGTLLTDNANVSVLPLGDGRVLCLTEATKGSVLIDPETLDTIGKFRYADRLWGLLQSAHPVVTGNELLTLLPDMFRRGHRVVRMAAGSNERKMVGRVHCRGGQAPGWVHSFAVTEKYIVVPEMPLRYSLAGVLKSQMTPWYLFDWLPESGSYMHAICRFTGKTVASVEVPPFMALHFINAYEQGDAIIADCCEYYADPSVIKALALRRLRSPGMNNDAFPDVRVARFSIPLDGTLMGELETVLDPEVHGRGVEMPSINPAYQGKEYRYVYACSARRPCNFLNCLTKIDLGEKEAKNWHELGSVPSEPFFVARPGGSDEDDGVVISIVSTMEGDGYALLLDAMTFQEIARVRLPYGLPYGFHGCWIPENV

SEQ ID NO: 17974 - DNA, 330 bp, Sorghum bicolor
  misc_feature: Ceres ANNOT ID no. 8686029
  misc_feature: Encodes the peptide sequence at SEQ ID NO 17975
atggcaaacagtgcgccgagctgccgtgcattctcttggctgtggctgtggctgctcctgctcctacggctgtggtgcctcctcctcgtcctctactgtccgatgatgtcgtcggcgctcgtcgtcagggaactaccgggattcgatggcccccttcccttcttcctcgaaaccgggtatgtggaggtggacgagagcaatggtgtgcagcttttctactacttcgttcagtcggagagggatcctgctagtgatccgctgctgctgtggctgcaaggtgggcctggctgctcagggctctcgggtcttgtctacgagattgttttctga

SEQ ID NO: 17975 - protein, 109 aa, Sorghum bicolor
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 14160
  misc_feature: Ceres ANNOT ID no. 8686029
  misc_feature (35)..(105): SWISSPROT Homolog: EC 2.3.1.91 Sinapoylglucose--choline O-sinapoyltransferase
MANSAPSCRAFSWLWLWLLLLLRLWCLLLVLYCPMMSSALVVRELPGFDGPLPFFLETGYVEVDESNGVQLFYYFVQSERDPASDPLLLWLQGGPGCSGLSGLVYEIVF

SEQ ID NO: 17976 - DNA, 1551 bp, Sorghum bicolor
  misc_feature: Ceres ANNOT ID no. 8686046
  misc_feature: Encodes the peptide sequence at SEQ ID NO 17977
atggattttttcactgagtatggtgagggaagcaggtacaagatagaagaggtcataggaaaaggaagttacggtgtggtttgctctgctttggacactcacactggtgaaaaggttgcaataaagaagataaatgaaatatttgaacatgtgtctgatgcaacacgtatacttcgtgagatcaagctgcttcggctcctgcgacatccggatattgtagaaataaaacatattttacttcctccatcaaggagggaattcaaggatatatatgttgtgtttgaactcatggagtctgatttacaccaagttataaaggctaatgatgacttaactccagaacactatcaatttttcctgtatcaattacttcgaggattgaagtacatacatacagcaaatgtgtttcaccgagacctaaaaccaaaaaatattttggccaatgctgattgcaagcttaaaatatgtgattttggacttgcaagagtagctttcaatgatactcctactgccatcttctggacggattatgttgcaacaagatggtaccgagctcctgagctgtgtggatcttttttctctaagtatactccagcaatagatatatggagcattggctgtatatttgcagagcttttaactggaaaacctctcttccctgggaaaaatgtggtacatcaacttgatataattacagatctcctgggaacaccatctcctgaagcaatctctaggattcgaaatgagaaggccaagcgctacctgagcagtatgaggcggaaaaggcctataccacttactcagaaatttccaaatgcagatccacttgcattacgtttattggagaagatgctagcttttgatccaaaagataggccaagcgcagaggaggcccttgctgatccatatttcaagaacatagccaatgtggatagagaaccatcagcacagcctgtgacaaagctggaatttgagtttgagaggcggaggattaccaaagaagatataagggaactcatttacagagaaattctggagtatcatccaaatatgttgagagaattccttgaggggacagagtcaactggtttcatgtacccaagtgctgtggatcattttaagaagcaatttgcatatcttgaagaacactatgcaaagggatcaacagcagctccacctgagaggcaacacaactctcttccaaggccttgtgtgttatattcggataatctaactaaaagcacagccaatgtcatggaggatctttccaagtgtggtgcttcaaggcctgctagagtggttggttctgcaatgcgatatggtaacagttcatcatctggtacctaccaatatgaacagaggacagctaaaaacccagcaattggtgctactggtgtttcacctaggggctcatactctagaacaattcctacctgcaagagcgaaacaagcgaggctgacaggattgatgcaagtcaaactagacagcccaagccatacatcccaaacaaactacctactacagtagatggccggaatggtcattggtag

SEQ ID NO: 17977 - protein, 516 aa, Sorghum bicolor
  misc_feature: Useful for making plants with altered cell wall content and/or composition
  misc_feature: Functional homolog of the protein sequence given in SEQ ID NO 14430
  misc_feature: Ceres ANNOT ID no. 8686046
  misc_feature (1)..(447): SWISSPROT Homolog: EC 2.7.11.24 Mitogen-activated protein kinase
  misc_feature (13)..(304): Pfam ID: Pkinase Pfam Description: Protein kinase domain
MDFFTEYGEGSRYKIEEVIGKGSYGVVCSALDTHTGEKVAIKKINEIFEHVSDATRILREIKLLRLLRHPDIVEIKHILLPPSRREFKDIYVVFELMESDLHQVIKANDDLTPEHYQFFLYQLLRGLKYIHTANVFHRDLKPKNILANADCKLKICDFGLARVAFNDTPTAIFWTDYVATRWYRAPELCGSFFSKYTPAIDIWSIGCIFAELLTGKPLFPGKNVVHQLDIITDLLGTPSPEAISRIRNEKAKRYLSSMRRKRPIPLTQKFPNADPLALRLLEKMLAFDPKDRPSAEEALADPYFKNIANVDREPSAQPVTKLEFEFERRRITKEDIRELIYREILEYHPNMLREFLEGTESTGFMYPSAVDHFKKQFAYLEEHYAKGSTAAPPERQHNSLPRPCVLYSDNLTKSTANVMEDLSKCGASRPARVVGSAMRYGNSSSSGTYQYEQRTAKNPAIGATGVSPRGSYSRTIPTCKSETSEADRIDASQTRQPKPYIPNKLPTTVDGRNGHW

SEQ ID NO: 17978 - DNA, 795 bp, Sorghum bicolor
  misc_feature: Ceres ANNOT ID no. 8686546
  misc_feature: Encodes the peptide sequence at SEQ ID NO 17979
atgtggaagctgacggtgggggagggcggcagccccatgctgcgctcgacaaaccgcttcagcgggcggaccgtttgggaattcgaccctgacctcgggacgcctgagcagcgcgccgatgtggaaaaggcgcgccgggacttctccgactaccgcttccagcgcaggcactctgccgatgtcctcatgcgcatgcagtatgcaaaagccaaccctcttaagctggaccttcctgctgtcaagataggggagaatgaagacgttacggtggaagctgtgttgtcctctttgaaacgggctatgaaccacctcgctactctccaggcacatgatggacactggcctggcgattgtagtggtcctctgttccttttgccaggcttggttatagtattgtatgtgactggagcattgaacgttgttttatcttcggaacatcagagggagatgtgccgctatctctataatcatcagaacaaagatggagggtgggggttgcacattgagggccacagcacaatgtttggcacaaccttgaactatgttactctgagattgattggcgagggcccaaatagtggagacggagctatggaaaaaggccgaaattggatcttagagcgcggaggagcaatatatacaacatcatggggcaagttttggctaacggtacttggggtatacgattggtctggtaacaacccactgccaccagaaatgtggctgttgccatatcacctgccttttcacccaggttccgacttctgccttttcattgaaacaactaatctttga

SEQ ID NO: 17979 - protein, 264 aa, Sorghum bicolor
  misc_feature: The sequence is a functional homolog of SEQ ID NO 6 in US patent 7122717
  misc_feature: The sequence is a functional homolog of SEQ ID NO 15 in US patent 7186884
  misc_feature: The sequence is a functional homolog of SEQ ID NO 4 in US patent 7135624
  misc_feature: Ceres ANNOT ID no. 8686546
  misc_feature (1)..(256): SWISSPROT Homolog: EC 5.4.99.8 Cycloartenol synthase
  misc_feature (145)..(188): Pfam ID: Prenyltrans Pfam Description: Prenyltransferase and squalene oxidase repeat
MWKLTVGEGGSPMLRSTNRFSGRTVWEFDPDLGTPEQRADVEKARRDFSDYRFQRRHSADVLMRMQYAKANPLKLDLPAVKIGENEDVTVEAVLSSLKRAMNHLATLQAHDGHWPGDCSGPLFLLPGLVIVLYVTGALNVVLSSEHQREMCRYLYNHQNKDGGWGLHIEGHSTMFGTTLNYVTLRLIGEGPNSGDGAMEKGRNWILERGGAIYTTSWGKFWLTVLGVYDWSGNNPLPPEMWLLPYHLPFHPGSDFCLFIETTNL

SEQ ID NO: 17980 - DNA, 771 bp, Sorghum bicolor
  misc_feature: Ceres ANNOT ID no. 8686559
  misc_feature: Encodes the peptide sequence at SEQ ID NO 17981
atgagccacgtgtccaaaatacataggatccatctaaagacagaacgggccattcagataagagattccaggcacaaccagaatcacagctttaaggtgaagcaacaacccaactttaaacattttaatccttctgagacctttgggggcataatgattgattacccgtatgttgaatgtacatcatcgtcaattcaagctctatctttgttcaagaaactctacccagagcaccgcaggaaagaggtggacaatgctatcagcaagggtgcaaatttcattgagagtatgcaaagaaacgatggttcatggtacggctcttggggcatctgtttcaccaacgccacatggtttgctgtgtttggattagtttgtgctggccgaacgttcaataacagttctgcaataagaaaggcatgtgagtttctattatcaaaagagcttccttctggtggctggggagagagctatttgtcatgtcaggacaaggtttacacaaatcttgaaggcatgcgacctcatgcagtgaacactggttgggccatgctggccctaatctacacagaacaggctgaaagagatccagcgccactacatcgggcagctaaggttttgatcaacctacagttagaggatggagaatttccacagcaagagatcattggagtcttcaatcaaaattgcatgatcggttactcccagtacaggaacatcttcccaatatgggctctaggagagtatcgtaccagggttcacgcacggaagaaatag

SEQ ID NO: 17981 - protein, 256 aa, Sorghum bicolor
  misc_feature: The sequence is a functional homolog of SEQ ID NO 6 in US patent 7122717
  misc_feature: The sequence is a functional homolog of SEQ ID NO 4 in US patent 7135624
  misc_feature: The sequence is a functional homolog of SEQ ID NO 15 in US patent 7186884
  misc_feature: Ceres ANNOT ID no. 8686559
  misc_feature (34)..(251): SWISSPROT Homolog: EC 5.4.99.8 Cycloartenol synthase
  misc_feature (85)..(127): Pfam ID: Prenyltrans Pfam Description: Prenyltransferase and squalene oxidase repeat
  misc_feature (134)..(189): Pfam ID: Prenyltrans Pfam Description: Prenyltransferase and squalene oxidase repeat
MSHVSKIHRIHLKTERAIQIRDSRHNQNHSFKVKQQPNFKHFNPSETFGGIMIDYPYVECTSSSIQALSLFKKLYPEHRRKEVDNAISKGANFIESMQRNDGSWYGSWGICFTNATWFAVFGLVCAGRTFNNSSAIRKACEFLLSKELPSGGWGESYLSCQDKVYTNLEGMRPHAVNTGWAMLALIYTEQAERDPAPLHRAAKVLINLQLEDGEFPQQEIIGVFNQNCMIGYSQYRNIFPIWALGEYRTRVHARKK

SEQ ID NO: 17982 - DNA, 651 bp, Sorghum bicolor
  misc_feature: Ceres ANNOT ID no. 8686556
  misc_feature: Encodes the peptide sequence at SEQ ID NO 17983
atgcgccacattcactatgaagatgagagcactcaatatattaaccttggtcctgtaaacaaggtaatgaatatgcttgcttgttggattgaagatccaaactcagaggcattcaaacttcatgttcctcgaatttatgattatttgtggcttgctgaagatggtatgaaaatgaagggttataatggcagccagctgtgggatgcaggtttaacagttcaggcaattgtgaggaccgacttcattgaagagtttggtccaactcttaaactagcacatgcctttgttaagaattcacagatccttggcaactgccctggagatttgaaacagtggtatcgccacatatcaaaaggtggatggtcattttctacagctgatcacggttggtctgtatcagattgcactgcaacaggactagaggcagccctattgttatcaatgatttctccagaaatagttggtgagccgatggaagttgacagagtttatgatggtgtaaattgtctcatttctcttatgtcagattataacttgctattttttaaaacaaaaggaagctctattaatctcaaacagttgcatcaaggtggtacaatcaatctaatccactcaaggtttttgcatagcaatgaaacaaacaacctatga

SEQ ID NO: 17983 - protein, 216 aa, Sorghum bicolor
  misc_feature: The sequence is a functional homolog of SEQ ID NO 6 in US patent 7122717
  misc_feature: The sequence is a functional homolog of SEQ ID NO 4 in US patent 7135624
  misc_feature: The sequence is a functional homolog of SEQ ID NO 15 in US patent 7186884
  misc_feature: Ceres ANNOT ID no. 8686556
  misc_feature (1)..(175): SWISSPROT Homolog: EC 5.4.99.8 Cycloartenol synthase
MRHIHYEDESTQYINLGPVNKVMNMLACWIEDPNSEAFKLHVPRIYDYLWLAEDGMKMKGYNGSQLWDAGLTVQAIVRTDFIEEFGPTLKLAHAFVKNSQILGNCPGDLKQWYRHISKGGWSFSTADHGWSVSDCTATGLEAALLLSMISPEIVGEPMEVDRVYDGVNCLISLMSDYNLLFFKTKGSSINLKQLHQGGTINLIHSRFLHSNETNNL

SEQ ID NO: 17984 - DNA, 210 bp, Sorghum bicolor
  misc_feature: Ceres ANNOT ID no. 8686553
  misc_feature: Encodes the peptide sequence at SEQ ID NO 17985
atgtggtgccattgtcgagcggtgtatttgcccatgtcttacatctatggaaagaggtttgttggtcgtatgacaccacttgtcttggaattgagaaatgaactctttgaagacccatacgatacgattgattggaacaagtctcgaaaccagtgcgcaaaggtttgttggagagaaactacctggctagcattaaaaatattaatctaa

SEQ ID NO: 17985 - protein, 69 aa, Sorghum bicolor
  misc_feature: The sequence is a functional homolog of SEQ ID NO 4 in US patent 7135624
  misc_feature: The sequence is a functional homolog of SEQ ID NO 6 in US patent 7122717
  misc_feature: Ceres ANNOT ID no. 8686553
  misc_feature (1)..(54): SWISSPROT Homolog: EC 5.4.99.8 Cycloartenol synthase
MWCHCRAVYLPMSYIYGKRFVGRMTPLVLELRNELFEDPYDTIDWNKSRNQCAKVCWRETTWLALKILI

SEQ ID NO: 17986 - DNA, 711 bp, Sorghum bicolor
  misc_feature: Ceres ANNOT ID no. 8687333
  misc_feature: Encodes the peptide sequence at SEQ ID NO 17987
atggcggcaagttcatggtcgtcgtcttcatcctgcacatcgtcgttcgggtccctcgacgacgatgtcgtctgcgtcatcaagtcggattccgtggctgccgcagccgttgcggagggaagcgtcaagttcctgtgcagctacggtggtaggatcctgccccgccacaccgatggcacgctgcgctacgtcggcggcgacaatcgagttctctccgtcgaccgacccctccggttttacgacttgcagcggaagatgagggaattgtgcggctgggaagcgtacctgcggtgccagctaccgacggaggacctggacgcgctcatctccgtgacgtgcgacgacgacctcgccaacctgctccaggagtacgacgaggccagcaaggaccgtctccagtcgctcaaaatccgggcgttcctgttcccgaggacgccggcgcctgcgtcctccataccgcgtagtagcccgccgtcgtccccgtcgtcgcattccagaccgtcaccgagtgctcacctccacaggcgaaacacttcccgggcgcccgcagccggcgtctcgctgacgtgcgcgccgcggtggtgggcagcgccccgggcctctcgccaggcacaagcgcaccagtcgcagaactacgacctgcgtagccttgacgaggagcggtcgcacccgcaccggtaccttgtccaaaatggcaggcacttgcaataa

SEQ ID NO: 17987 - protein, 236 aa, Sorghum bicolor
  misc_feature: Useful for making plants with modulated nitrogen use efficiency
  misc_feature: Functional homolog of the protein sequence given in SEQ ID NO 14590
  misc_feature: Ceres ANNOT ID no. 8687333
  misc_feature (56)..(144): Pfam ID: PB1 Pfam Description: PB1 domain
MAASSWSSSSSCTSSFGSLDDDVVCVIKSDSVAAAAVAEGSVKFLCSYGGRILPRHTDGTLRYVGGDNRVLSVDRPLRFYDLQRKMRELCGWEAYLRCQLPTEDLDALISVTCDDDLANLLQEYDEASKDRLQSLKIRAFLFPRTPAPASSIPRSSPPSSPSSHSRPSPSAHLHRRNTSRAPAAGVSLTCAPRWWAAPRASRQAQAHQSQNYDLRSLDEERSHPHRYLVQNGRHLQ

SEQ ID NO: 17988 - DNA, 762 bp, Sorghum bicolor
  misc_feature: Ceres ANNOT ID no. 8687394
  misc_feature: Encodes the peptide sequence at SEQ ID NO 17989
atggggaacgcgcggtgcccagccgccgactcgccggcggcgtcggaccgggaggtaggattcgcgaagctgcagggcgagtgcttcgagtactacatgcagacctactccatcgtccttggtcgccatagccgccgcagcagcaagggccccgccgccccgccgaccgaggccgacgacggcgtcgacgtggacctcggcgccctcggcggaggcatgaacgtctcccgccgccacgcgcgcatcttctacgacttcccacgccgccggttcgctctcgaggtgcttggcaagaacggctgcctcgtcgagggcgtgcaccacgtccccgggtccgcccccgtcaagctcgactcccaggacctcctccagatgggggaagccaagttctacttcctcctcccctcgcgctccgtcttcgacgccggcatcgcgcgccgtgcccccgccgtccagcgcgggatcccgccgcctccgtctgacgacgacgaggatgaggatgaacagggagaggccgtggcagcggcgaagcgtcggagggagggggataacggatcaaaatcttacagggaagcagatgatcaactattgcttcagttggaagagaaagatgtcatctcatctgctgctactatcttgtctgatctctgtggacctcaggaatggatttctatgaacaagcttcatgaagtggtaagtaagtttttctcctggagaagtatcaatagatgctatttttttttgctgccccccttgttttag

SEQ ID NO: 17989 - protein, 253 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 13680
  misc_feature: Ceres ANNOT ID no. 8687394
  misc_feature (38)..(126): Pfam ID: FHA Pfam Description: FHA domain
MGNARCPAADSPAASDREVGFAKLQGECFEYYMQTYSIVLGRHSRRSSKGPAAPPTEADDGVDVDLGALGGGMNVSRRHARIFYDFPRRRFALEVLGKNGCLVEGVHHVPGSAPVKLDSQDLLQMGEAKFYFLLPSRSVFDAGIARRAPAVQRGIPPPPSDDDEDEDEQGEAVAAAKRRREGDNGSKSYREADDQLLLQLEEKDVISSAATILSDLCGPQEWISMNKLHEVVSKFFSWRSINRCYFFLLPPLF

SEQ ID NO: 17990 - DNA, 255 bp, Sorghum bicolor
  misc_feature: Ceres ANNOT ID no. 8687442
  misc_feature: Encodes the peptide sequence at SEQ ID NO 17991
atgtggcagatgaatttaggagaaaccatggcccccatggaactggggccatacccagagcgtgttggtgagccagactgtagctattacatgaggactggcatgtgcaggtttgggatgacctgtaaatttaatcacccagcagacagaaagctggtaacatccattcttctacccttctttcaggcattagagtatataatcttgttgtgcttacaaaacattaatcgtttgctttgtggctgccttatttga

SEQ ID NO: 17991 - protein, 84 aa, Sorghum bicolor
  misc_feature: Useful for making plants with modulated nitrogen use efficiency
  misc_feature: Functional homolog of the protein sequence given in SEQ ID NO 14480
  misc_feature: Useful for making plants with modulated low light sensitivity
  misc_feature: Functional homolog of the protein sequence given in SEQ ID NO 14481
  misc_feature: Ceres ANNOT ID no. 8687442
  misc_feature (22)..(48): Pfam ID: zf-CCCH Pfam Description: Zinc finger C-x8-C-x5-C-x3-H type (and similar)
MWQMNLGETMAPMELGPYPERVGEPDCSYYMRTGMCRFGMTCKFNHPADRKLVTSILLPFFQALEYIILLCLQNINRLLCGCLI

SEQ ID NO: 17992 - DNA, 1416 bp, Sorghum bicolor
  misc_feature: Ceres ANNOT ID no. 8688253
  misc_feature: Encodes the peptide sequence at SEQ ID NO 17993
atggaccccgtcgccacatgggggctaaccccgctcgccggcgccgacccggagatctacgacctcctggagcgcgagaagcggcgccagcgtcgcggcatcgagctcatcgcctccgagaacttcacctccttcgccgtcatggaggcactcggctctccgctcaccaacaagtactctgagggcatgcccggtgcccgctactacggcggcaacgacgtcatcgacgagatcgagaacctctgccggtcacgcgcgctcgctgccttccgcctcgacgccgcgttctggggcgtcaacgtgcagccctactcgggctcccccgccaacttcgccgcttacaccgcgctgctcaacccgcacgaccggatcatggggcttgaccttccctccggcggacacctcactcacggctactatactgccggcgggaagaagatctccgccacctcgatctactttgagagcctgccgtacaaagtgagcgccaccaccgggtacatcgactacgagaaactcgaggagaaggcacttgacttccgccccaagctcatcatctgcggtggcagcgcgtacccgagggactgggactactccaggctcagggccatcgccgacaaggtcggggccctgctgctctgcgacatggcgcacatcagcggactcgtcgccgcggaggaagctgcaaatccttttgaatattgtgatgtggttaccactaccacacacaagtctcttagagggccaagggctggcatgatcttctacaggaaaggccctaagccccccaagaagggccagcctgagggtgctgtgtatgattatgaagacaagatcaactttgctgtgttcccatctctccaaggtggccctcacaaccaccagattgctgcacttgctgttgctctgcagcaaactatgacacctggcttcaaggcctatgcaaagcaagtgaaggccaatgctgttgcaattggaaactatctcatgagcaagggctacaagatggtgactgatggaactgagaaccaccttgttctctgggatctccgccctcttggcttgactggaaacaaggttgaaaaactctgtgacctttgccacatcacattgaacaagaatgctgtctttggtgacagcagtgcattggctccgggtggtgtccgcattggtgcgccagcaatgacctcgaggggtctagtggagaaggactttgagcagattggagagttcctccaccaggcggtgaccatctgcctgaacattcagaaggagtacggcaagctcctcaaggacttcaacaagggcctgttgaacaacaaggacattgagaacctcaagacccaggtggagaagttcgccgactctttcgacatgcctgggttcacgcttgagagcatgaagtacaaggagtag

SEQ ID NO: 17993 - protein, 471 aa, Sorghum bicolor
  misc_feature: Useful for making plants with modulated nitrogen use efficiency
  misc_feature: Functional homolog of the protein sequence given in SEQ ID NO 13702
  misc_feature: Ceres ANNOT ID no. 8688253
  misc_feature: Down-regulated in shoot tissues in response to salicylic acid treatment
  misc_feature (11)..(470): SWISSPROT Homolog: EC 2.1.2.1 Glycine hydroxymethyltransferase
  misc_feature (12)..(412): Pfam ID: SHMT Pfam Description: Serine hydroxymethyltransferase
MDPVATWGLTPLAGADPEIYDLLEREKRRQRRGIELIASENFTSFAVMEALGSPLTNKYSEGMPGARYYGGNDVIDEIENLCRSRALAAFRLDAAFWGVNVQPYSGSPANFAAYTALLNPHDRIMGLDLPSGGHLTHGYYTAGGKKISATSIYFESLPYKVSATTGYIDYEKLEEKALDFRPKLIICGGSAYPRDWDYSRLRAIADKVGALLLCDMAHISGLVAAEEAANPFEYCDVVTTTTHKSLRGPRAGMIFYRKGPKPPKKGQPEGAVYDYEDKINFAVFPSLQGGPHNHQIAALAVALQQTMTPGFKAYAKQVKANAVAIGNYLMSKGYKMVTDGTENHLVLWDLRPLGLTGNKVEKLCDLCHITLNKNAVFGDSSALAPGGVRIGAPAMTSRGLVEKDFEQIGEFLHQAVTICLNIQKEYGKLLKDFNKGLLNNKDIENLKTQVEKFADSFDMPGFTLESMKYKE

SEQ ID NO: 17994 - DNA, 1620 bp, Sorghum bicolor
  misc_feature: Ceres ANNOT ID no. 8689328
  misc_feature: Down-regulated in shoot tissues in response to salicylic acid treatment
  misc_feature: Encodes the peptide sequence at SEQ ID NO 17995
atgaagactgaagtaatcaccaccatgatctccttggtcttcctcgtgcatttcgctatcaccatcagccctaacgcacaaccttcatggctcttctctctcatgtctctctcccttgccgtggtggcggtcatagtgccattagtagtcaccaccacttgccatgcacgtaagaataccgacgctaccaccaccatcccggggccacgagggtggccgctggtaggctccctgctggtcgtgtcgggcccactcatgcaccgtcgcctagccgcgctggccgacgcgcatagcgcacgtcgcctcatgtcgctcaccctcggtgccacccccgtggtgatcagcagccacccagaaacggcgcgagacatcctctcaggtgccgccttcgtggaccgcccgcctaaggccgcagcccgggaactcatgttttgccgtgccatcgggtttgcccccactggggagtattggcgtcgcctccgtcgcatcacgggcgctggcatgctctccccgcgtcgcatggccatgctcaggggtcttcgctgccgtgttgccgacagcatgatccagcgtgtcgcggaccagatggagaggtccggggaggtggccatgagagccttgctccaaagggcctccctagagagcatggtgggtagcgtgctaggcctcgagggtgacgctgtttgtgaggagctgggtgagatggtgagggaagggtatgagctcgtgggcatgttcaacctagaagaccactactacaagacatcatggggcccgttgatggacctttggggggtgaggcccatgtgcagggagctggctgctatggttagagggtattttgggaagatcattcaggagaggaggctggcaggggactgccacgagagggccgacttgcttagctatatgctttcacttccagaggaggagaagttggaggactctgatgtgattgctgtgctgtgggagatgattttccgtggcgtggacgtcgtggcgattctcctggagtgggccatggcccgcatgtcactgcacccagacatccaatccaaggcccaggaggagatggacgcagcggtgggcgtccgtcgtcgtcgtgccatcaccgactccgacgtccccaaccttgccttcctccaatggatcctcaaggagacgctccggatgcacccgccgggcccgctgctctcctgggcgcgcctggcggtgcaggacgcgcgggtgggcaagcacgtggtgccggcggggacgacggccatggtgaacatgtgggccatctcgcacgacgaggccatctggggagacccctgggtgttccggccggagaggttcgcggcggcggcggccggggaggaggtgagcgtgctcgggtccgacctcaggctggcgccgttcgggtccggccggagggtgtgccctggcaggatgatgggcctcgccaccgcgcagctctggctcggacgcctcctgcaggagtaccggtggctgccgccgccggccaataagcccgtcgagctcgccgagtgcctccgcctgtccatggagatgaagacgcccctcgtctgccgcgcggttcctcgtcgtcgcggaggacggcctcctgctgcagcttga

SEQ ID NO: 17995 - protein, 539 aa, Sorghum bicolor
  misc_feature: Useful for biocontainment applications
  misc_feature: Functional homolog of the protein sequence given in SEQ ID NO 14371
  misc_feature: Ceres ANNOT ID no. 8689328
  misc_feature: Down-regulated in shoot tissues in response to methyl jasmonate treatment
  misc_feature: Down-regulated in root tissues in response to methyl jasmonate treatment
  misc_feature: Down-regulated in root tissues in response to aminocyclopropane carboxylic treatment
  misc_feature: Down-regulated in shoot tissues in response to salicylic acid treatment
  misc_feature (55)..(523): SWISSPROT Homolog: EC 1.14.13.21 Flavonoid 3'-monooxygenase
  misc_feature (66)..(525): Pfam ID: p450 Pfam Description: Cytochrome P450
MKTEVITTMISLVFLVHFAITISPNAQPSWLFSLMSLSLAVVAVIVPLVVTTTCHARKNTDATTTIPGPRGWPLVGSLLVVSGPLMHRRLAALADAHSARRLMSLTLGATPVVISSHPETARDILSGAAFVDRPPKAAARELMFCRAIGFAPTGEYWRRLRRITGAGMLSPRRMAMLRGLRCRVADSMIQRVADQMERSGEVAMRALLQRASLESMVGSVLGLEGDAVCEELGEMVREGYELVGMFNLEDHYYKTSWGPLMDLWGVRPMCRELAAMVRGYFGKIIQERRLAGDCHERADLLSYMLSLPEEEKLEDSDVIAVLWEMIFRGVDVVAILLEWAMARMSLHPDIQSKAQEEMDAAVGVRRRRAITDSDVPNLAFLQWILKETLRMHPPGPLLSWARLAVQDARVGKHVVPAGTTAMVNMWAISHDEAIWGDPWVFRPERFAAAAAGEEVSVLGSDLRLAPFGSGRRVCPGRMMGLATAQLWLGRLLQEYRWLPPPANKPVELAECLRLSMEMKTPLVCRAVPRRRGGRPPAAA

SEQ ID NO: 17996 - DNA, 96 bp, Sorghum bicolor
  misc_feature: Ceres ANNOT ID no. 8689524
  misc_feature: Down-regulated in shoot tissues in response to methyl jasmonate treatment
  misc_feature: Down-regulated in root tissues in response to methyl jasmonate treatment
  misc_feature: Down-regulated in root tissues in response to aminocyclopropane carboxylic treatment
  misc_feature: Down-regulated in shoot tissues in response to salicylic acid treatment
  misc_feature: Encodes the peptide sequence at SEQ ID NO 17997
atgtacaaagtccagtggaatcagtgcaccgaagaggaggctatttgtaaaagagaagaggatctaagaaaaacataccctcagttgtttgagtaa

SEQ ID NO: 17997 - protein, 31 aa, Sorghum bicolor
  misc_feature: The sequence is a functional homolog of SEQ ID NO 1584 in the 10/374,780 US patent application
  misc_feature: The sequence is a functional homolog of SEQ ID NO 1586 in the 10/374,780 US patent application
  misc_feature: The sequence is a functional homolog of SEQ ID NO 1585 in the 10/374,780 US patent application
  misc_feature: The sequence is a functional homolog of SEQ ID NO 1583 in the 10/374,780 US patent application
  misc_feature: Ceres ANNOT ID no. 8689524
MYKVQWNQCTEEEAICKREEDLRKTYPQLFE

SEQ ID NO: 17998 - DNA, 678 bp, Sorghum bicolor
  misc_feature: Ceres ANNOT ID no. 8689518
  misc_feature: Encodes the peptide sequence at SEQ ID NO 17999
atggagaattatcacatgctctttggggcggcgtccacgcacgcctcatctgctgccacccccagctcgtacaacttcatggccactgctgctggaaccagcggcggcggcggcggcggcttccacgaccacgatcgaggccagcgcagcagcgggcacggcggcggcggatcgtcgtcgtccttcttcgcggagctgtcgtccaacaacgacgactccaaggaatatggtggtgcatctagccctccaggtccagctgccggtagtggccgtggggagtcgtccgtggggcctgcggcggccgccggcgaggtggacaggccgcccaagaggaagggggagaagaaggagcgccggccacggtacgccttccagacgcgcagccaggtcgacatcctcgacgacggctaccggtggaggaagtacggacagaaggcagtcaagaacaacaacttcccaagaagctactacagatgcactcaccaagggtgcaacgtgaagaagcaggtgcagcggctgtcaagggatgagggcgtggtggtgaccacatacgagggcacccatacacaccccattgagaagtctaatgacaacttcgagcacatactcacccagatgcagatctactccggcatgggatcaacctttagcagtagtagccacaacatgtttcactga

SEQ ID NO: 17999 - protein, 225 aa, Sorghum bicolor
  misc_feature: The sequence is a functional homolog of SEQ ID NO 86 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8689518
  misc_feature (133)..(192): Pfam ID: WRKY Pfam Description: WRKY DNA -binding domain
MENYHMLFGAASTHASSAATPSSYNFMATAAGTSGGGGGGFHDHDRGQRSSGHGGGGSSSSFFAELSSNNDDSKEYGGASSPPGPAAGSGRGESSVGPAAAAGEVDRPPKRKGEKKERRPRYAFQTRSQVDILDDGYRWRKYGQKAVKNNNFPRSYYRCTHQGCNVKKQVQRLSRDEGVVVTTYEGTHTHPIEKSNDNFEHILTQMQIYSGMGSTFSSSSHNMFH

SEQ ID NO: 18000 - DNA, 1446 bp, Sorghum bicolor
  misc_feature: Ceres ANNOT ID no. 8689619
  misc_feature: Encodes the peptide sequence at SEQ ID NO 18001
atgaagaaaactgtggttctctacccgggcctcggcgccggccacctgatgccgatgatcgagctggccaaggtctttgtccagcacggcgtcgccgtcaccgtggcgctcgtgaagccgcccctcgacctcgaggccctcgacttctccgcggtgatcgcccgcgccgcgtcctccaacccgtccatctccttccacgtcttgccgcctgcgacgacctctgattctggttccggcgacggtcgtcgcagaaagtactacgtcctcgagatggtggactgcctcaaggccatgaacgctccgctccgcgacttcctccggtcgctgcccgccgtcgacgcgctcgtcatcgacatgttctgccctgacgcgctcgacgtcgcggccgaactcaggctgcccgtctactactcctacgcctcgtgcgccggggacctcgccgtcttcctccacctcggcttcaaccaagacacctacgcagcttccatagacgctggcggcgatgctacactttcctttccgggcgctcctccgttcaaggcgtcggatctgccgggagtagttgacagcgaccccgaagcagccatggccatcctccagacgctccatcggatggcggcgtccgacgggatcgtcgtcaacaccttcgtggagctggagacgcgggcggtgcgcgctctgcgggacgggctgtgcgtgcccggccgtgccacgccaccggtctactgcatcgggccactggtgtccggctccggcggcggtggggaaatggagcacgagtgcctccgctggctggacacgcagccggacagcagcgtcgtgttcctctgcttcgggagcctgggcacgttctccgagaggcagctgaaggaggtcgccgtcggcctcgagaggtcggagcagaggtttctctgggtggtgcgcaccccgcgcaccgtcgacgacgagctggccgtgggcgcggggaaggcgctgtcggagccagacctcggcgcgctgcttccagacgggttcttggagaggaccaatggcagaggcctcgtggtcaagtgctgggcgccgcaggtggacgtgctgcgccacagggcggcgggcgctttcgtgacgcactgcgggtggaactcgacgctggagggcatcacggcggggctgccgctcctgtgctggcccatgtacgcggagcagaagatgaacaaggtgttcatcgtgcaggagatgaagctcggggtggagatgaggggatacgacggcgaggtggtggcggcgggtgaggtggagacgaaggtgaagtgggtgatggagtccgagggtgggcgagcgctcagggagagggcagcggcggccaaagatgcggcagccaaggcgatgatccgggaagggggctcgtctcatgctgactttatcagatttctccagggtcttgacaacatttcgtcgcgttcgtga

SEQ ID NO: 18001 - protein, 481 aa, Sorghum bicolor
  misc_feature: Useful for making plants with altered carbohydrate content
  misc_feature: Functional homolog of the protein sequence given in SEQ ID NO 14447
  misc_feature: Ceres ANNOT ID no. 8689619
  misc_feature (5)..(465): SWISSPROT Homolog: EC 2.4.1.218 Hydroquinone glucosyltransferase
  misc_feature (4)..(478): Pfam ID: UDPGT Pfam Description: UDP-glucoronosyl and UDP-glucosyl transferase
MKKTVVLYPGLGAGHLMPMIELAKVFVQHGVAVTVALVKPPLDLEALDFSAVIARAASSNPSISFHVLPPATTSDSGSGDGRRRKYYVLEMVDCLKAMNAPLRDFLRSLPAVDALVIDMFCPDALDVAAELRLPVYYSYASCAGDLAVFLHLGFNQDTYAASIDAGGDATLSFPGAPPFKASDLPGVVDSDPEAAMAILQTLHRMAASDGIVVNTFVELETRAVRALRDGLCVPGRATPPVYCIGPLVSGSGGGGEMEHECLRWLDTQPDSSVVFLCFGSLGTFSERQLKEVAVGLERSEQRFLWVVRTPRTVDDELAVGAGKALSEPDLGALLPDGFLERTNGRGLVVKCWAPQVDVLRHRAAGAFVTHCGWNSTLEGITAGLPLLCWPMYAEQKMNKVFIVQEMKLGVEMRGYDGEVVAAGEVETKVKWVMESEGGRALRERAAAAKDAAAKAMIREGGSSHADFIRFLQGLDNISSRS

SEQ ID NO: 18002 - DNA, 1161 bp, Sorghum bicolor
  misc_feature: Ceres ANNOT ID no. 8689685
  misc_feature: Encodes the peptide sequence at SEQ ID NO 18003
atggccggggagaccgaactcgccggagctcgcggtccggccaactccgagcaccatttttcgaaagaaaatcgccagggaaacgagaagctcaccgcgacctcgctggagacctttgctaggaccgaggagcaacgacagggcggaggcgtttctttgattctttccgtcttggccggaggcatggactgggcagcggcttccggggctccgtcgtggggcgcggcggcgacggaccccggcccgaccatgctgtccttcgcgggcccgtcctcctccaccacacccgccgccgacgccgaggcgcggctccaggatttcgccgcgggtctcgcccagagcgcgcggccggcgggggcggcgggagccgggaggaggtcccgcgcggccgggggaggtgctggcgtggaggcgtgctccgtcgacgggtgccgctctgatctcagccggtgccgcgagtaccaccggcggcataaggtctgtgaggcgcactctaagacgccggtggtggtcgtcgccggccaggagcagcgcttctgccagcaatgcagccggtttcacatgctgtccgagtttgatgagggaaaaagaagttgccggaagcgtttggatggtcataataggcgtcgaagaaagccacagcatgatctgacgaatctagggggtttctttccataccaccaagtgaatcaatttgaggtctatccacgaacaattccaacagtcggccagaattctgatgccatgcacttggtcggtcgtcagcagcccttctccatatcattctcaagaacaccaaatcagttcccttttccacagggtggcggtagcacgctccatgcagcccgccctggtcatcttctggctgaaggtagcagccacactggaagcagcacatgcagcaaccctctctccggcacgctgggccccgagtgtgctctctctcttctgtcatcgtcgctgcatcacccctccgctgctggcatccccaccgctggccagccccaggttgcctcttcactctctcggatcgctgctgtgtcgcaggctgcaacaacagctatggccactgcattcgcggccggtgttggccaccatgtgtttgttcctgatgctatgtttgaggatccttcacaggcactgccattctcttggcagtag

SEQ ID NO: 18003 - protein, 386 aa, Sorghum bicolor
  misc_feature: Useful for making plants with altered terpenoid content
  misc_feature: Useful for making plants with modulated flowering time
  misc_feature: Functional homolog of the protein sequence given in SEQ ID NO 13706
  misc_feature: Ceres ANNOT ID no. 8689685
  misc_feature (138)..(216): Pfam ID: SBP Pfam Description: SBP domain
MAGETELAGARGPANSEHHFSKENRQGNEKLTATSLETFARTEEQRQGGGVSLILSVLAGGMDWAAASGAPSWGAAATDPGPTMLSFAGPSSSTTPAADAEARLQDFAAGLAQSARPAGAAGAGRRSRAAGGGAGVEACSVDGCRSDLSRCREYHRRHKVCEAHSKTPVVVVAGQEQRFCQQCSRFHMLSEFDEGKRSCRKRLDGHNRRRRKPQHDLTNLGGFFPYHQVNQFEVYPRTIPTVGQNSDAMHLVGRQQPFSISFSRTPNQFPFPQGGGSTLHAARPGHLLAEGSSHTGSSTCSNPLSGTLGPECALSLLSSSLHHPSAAGIPTAGQPQVASSLSRIAAVSQAATTAMATAFAAGVGHHVFVPDAMFEDPSQALPFSWQ

SEQ ID NO: 18004 - DNA, 1215 bp, Sorghum bicolor
  misc_feature: Ceres ANNOT ID no. 8689830
  misc_feature: Encodes the peptide sequence at SEQ ID NO 18005
atggttaccccttatcagcgtcaatgggccattcggatggttccatccaatctgtttttccccagcgcacgggcggcccacgaacggatcggccacactcccacacgcgcacggagggagaccccatctctctcctctcctctcctctcctcgccggcgttctgtctgccgcattgcgaattcgaattcgaattcgaattagagcccgattcctcccctctctctctctctctctcctctcttccgcacgcggcgagcggaggcccggtgaggaccgcccggatcgacaggatgcagcagaagccggacgacgccatggaggaggcggcggcggcgcccaaggcggcagcggttacagcagggccggagctagggttctggttggcggcacggcggcggctcgcccccgacgaccccttcttcgccgccggggacctcgagcgcgagctccttgccaagcaccttgccctggatctctctgaagatgaccgcgaccagcttgagaagatggaagtggccagcacgtgcacagtgttttgcccaattgctggttgtggtgcccatctagattgtttggaggagtttgaggaccactatgtcactcgccatactgcttcatgctctgtatgttcacgagtttatccaacttcaaggttgctgagcatccatgtttctgaggcacacgactcgtatttccaagcaaaagttgcccgtggttttccaatgtatgagtgtttggtggagggttgtggtatgaaattgaagagttacaagagtcggctgcagcatctcatcgataagcatcaatttcccaaatcatttgagttcttcaaaaaggcacgggcctcccagcgtcagcggcaaaagtcccagaggaggcaaactgctcacaagggtgaagagacaagggataattcaatggatgtcgatggaaaaggtgcaaggcaaacaaaccagaggtaccggcagaagcaacatgatcataatgaattaaaagagagcaagcagcagcataaggaggccaaggagaacgaaatggaggtcgagcagaagattgatgagctcacctctgctgtatcgaagttgagcacagcagattctacacctgcaaaggtaacctttggccaccgtcgctctcgtggccttacgtttgtgccaaggtcaatcaggcagaacaagcaggcggcctcccagctggaagcaacaaatgactaa

SEQ ID NO: 18005 - protein, 404 aa, Sorghum bicolor
  misc_feature: Useful for making plants with altered alkaloid content
  misc_feature: Functional homolog of the protein sequence given in SEQ ID NO 14591
  misc_feature: Ceres ANNOT ID no. 8689830
MVTPYQRQWAIRMVPSNLFFPSARAAHERIGHTPTRARRETPSLSSPLLSSPAFCLPHCEFEFEFELEPDSSPLSLSLSSLPHAASGGPVRTARIDRMQQKPDDAMEEAAAAPKAAAVTAGPELGFWLAARRRLAPDDPFFAAGDLERELLAKHLALDLSEDDRDQLEKMEVASTCTVFCPIAGCGAHLDCLEEFEDHYVTRHTASCSVCSRVYPTSRLLSIHVSEAHDSYFQAKVARGFPMYECLVEGCGMKLKSYKSRLQHLIDKHQFPKSFEFFKKARASQRQRQKSQRRQTAHKGEETRDNSMDVDGKGARQTNQRYRQKQHDHNELKESKQQHKEAKENEMEVEQKIDELTSAVSKLSTADSTPAKVTFGHRRSRGLTFVPRSIRQNKQAASQLEATND

SEQ ID NO: 18006 - DNA, 1383 bp, Sorghum bicolor
  misc_feature: Ceres ANNOT ID no. 8689913
  misc_feature: Encodes the peptide sequence at SEQ ID NO 18007
atgaagcaggagaacggcggcgcggcggtggcggcggcgggcgagaagcagcagcagcagcaggcgccgccgcagctggtgatgagcgtgaagcgcggggaggcgacgctggtggcgccggcggaggcgacgccgaggggcgggcagtactacctgtcgaacctggaccagaacatcgcggtgatcgtgcagacggtgtactgctacaagccgccgccgtcgccgtccagcggcaatggtgacgacgacgacgtggtgggcgtgctccgcgacgcgctggcgcgcgtgctggtgcactaccacccgctggcggggcggctggggatcagcccggagatgaagctgaccgtggagctcaccggcgagggcgccgtgttcgtggaggccgacgccgcctgcgacctcgccgacgtcggcgacctcaccaagcccgacccggccgcgctcggccagctcgtctactccgtccccggcgccaagcacatcctcgagatgccacccatgaccgcgcaggtgacgagattcagatgcggcggcttcgcgctcggcctggccatgaaccactgcatgttcgacggcatcggcgccatggagttcgtcaactcgtgggccgagacggcgcgcggcgtcgccgagctcaccgtgccgccgttcctggaccgcagcgtcctcaaggcgcgcgacccgcccgtgcacaccttcccgcaccacgagttcgccgagatccccgacgtgtccgacacggcggcgctctacggcgcgcaggagctccggtaccgctccttctgcttcgacccggaccggctggagcgcgtgcgcgcgctggcgctggcgctcgccgacggcggccgccgcttcaccaccttcgaggcgctgtcggggctggtgtggcgcgcccgcacggcggcgctcgggctggcgcccgagcagcgcaccaagctgctgttcgccgtggacgggcggcgccggttcgcgccgccgctcccgcggggctacttcgggaacggcatcgtgctgaccaacgcggtggcgacggcgggggagctgctgtccgcgcccgtcttccgcgcggcggggctggtgcaggacgccgtgcggatggtcaccgacgagtacatgcggtcggcggtggactacttcgaggcgacgcgggcgcggccgtcgctggcgtccacgctgctcatcaccacgtggtcgcgcctcgagttccacggcgccgacttcgggtggggcgagcccgtcatgtcgggccccgtcacgctgccggagaaggaggtcatcctcttcctcgcgcacggcaaggagaggaagagcatcaacgtgctgctcggcctgcccgccacggccatggacgcattccaagagctcatggacgacatatga

SEQ ID NO: 18007 - protein, 460 aa, Sorghum bicolor
  misc_feature: Useful for biocontainment applications
  misc_feature: Functional homolog of the protein sequence given in SEQ ID NO 14111
  misc_feature: Ceres ANNOT ID no. 8689913
  misc_feature (28)..(417): SWISSPROT Homolog: EC 2.3.1.144 Anthranilate N-benzoyltransferase
  misc_feature (28)..(460): Pfam ID: Transferase Pfam Description: Transferase family
MKQENGGAAVAAAGEKQQQQQAPPQLVMSVKRGEATLVAPAEATPRGGQYYLSNLDQNIAVIVQTVYCYKPPPSPSSGNGDDDDVVGVLRDALARVLVHYHPLAGRLGISPEMKLTVELTGEGAVFVEADAACDLADVGDLTKPDPAALGQLVYSVPGAKHILEMPPMTAQVTRFRCGGFALGLAMNHCMFDGIGAMEFVNSWAETARGVAELTVPPFLDRSVLKARDPPVHTFPHHEFAEIPDVSDTAALYGAQELRYRSFCFDPDRLERVRALALALADGGRRFTTFEALSGLVWRARTAALGLAPEQRTKLLFAVDGRRRFAPPLPRGYFGNGIVLTNAVATAGELLSAPVFRAAGLVQDAVRMVTDEYMRSAVDYFEATRARPSLASTLLITTWSRLEFHGADFGWGEPVMSGPVTLPEKEVILFLAHGKERKSINVLLGLPATAMDAFQELMDDI

SEQ ID NO: 18008 - DNA, 1167 bp, Sorghum bicolor
  misc_feature: Ceres ANNOT ID no. 8689919
  misc_feature: Encodes the peptide sequence at SEQ ID NO 18009
atgcaggaacaggacagcggtcttcagctggtgcacctgctcctggcgtgcgccgacttcgtctccaagggggaccagccatcggcactgcgccacctgcacctcctccgccgcgtcgcctccccgctgggcgactccatgcagcgcgtggcctcctacttcgccgacgccctcgccgcccgcctcaccctctcctccaacccgtcctcctgctcctcgtcgggcggcgtcgccacgccgcgcggcggcgcgggtgccggcgtcgcgccctacacgttccctccgtcgccggacacgctcaagatctaccagatcctgtaccaggcctgcccctacgtcaagttcgcgcacttcaccgccaaccaggccatcttcgaggcgttccacggcgaggaccgcgtccacgtcgtcgacctcgacatcctgcagggctaccagtggccggcgttcctgcaggcgctggcggcgcgccccggcggcccgccgaccctgcgtctcaccggcgtcgggcacccctcggcagccgtcagggagaccggtcgccacctcgcctccctcgccgcgtcgctgcgcgtgccgttcgagttccacgccgccgtcgccgacaggctcgagcgcctgcgccccggcgcgctccagcgccgcgtcggcgaggcgctcgctgtcaacgctgtcaacaggctccaccgcgtccccggcgtccacctcggcccgcttctctccatgatccgcgaccaggcgcccaagatcatgacgctcgtcgagcaggaggccggccacaacggcccctacttcctgggcaggtttttagaggcgctgcactactactcggcgatcttcgactcgctggacgcgacgttcccggcggactcggcgccgcggatgaaagtggagcagtgcctgctggcgccggagatcaggaacgtggtggcgtgcgagggcgcggagcgggtggcgcggcacgagcggctggaccggtggaggcgcctcatggaaggccggggcttcgagcccgtgccgctcagcccggccgccgttggacagagccaggtcctgctcggcctctacggcgccggcgacgggtaccggctcaccgaggacaaaggatgcctcctcctcgggtggcaggatcgcgccatcatcgccgcctccgcgtggcggtgctaa

SEQ ID NO: 18009 - protein, 388 aa, Sorghum bicolor
  misc_feature: The sequence is a functional homolog of SEQ ID NO 68 in the 10/666,642 US patent application
  misc_feature: Ceres ANNOT ID no. 8689919
  misc_feature (2)..(295): Pfam ID: GRAS Pfam Description: GRAS family transcription factor
MQEQDSGLQLVHLLLACADFVSKGDQPSALRHLHLLRRVASPLGDSMQRVASYFADALAARLTLSSNPSSCSSSGGVATPRGGAGAGVAPYTFPPSPDTLKIYQILYQACPYVKFAHFTANQAIFEAFHGEDRVHVVDLDILQGYQWPAFLQALAARPGGPPTLRLTGVGHPSAAVRETGRHLASLAASLRVPFEFHAAVADRLERLRPGALQRRVGEALAVNAVNRLHRVPGVHLGPLLSMIRDQAPKIMTLVEQEAGHNGPYFLGRFLEALHYYSAIFDSLDATFPADSAPRMKVEQCLLAPEIRNVVACEGAERVARHERLDRWRRLMEGRGFEPVPLSPAAVGQSQVLLGLYGAGDGYRLTEDKGCLLLGWQDRAIIAASAWRC

SEQ ID NO: 18010 - DNA, 2091 bp, Sorghum bicolor
  misc_feature: Ceres ANNOT ID no. 8689932
  misc_feature: Encodes the peptide sequence at SEQ ID NO 18011
atggcggccgcccctgctcaagcagggcgcttcctgctcgtcgtgctcgtcgccacggcgtcgctattgccatggctcgccggggtctccacggaagcagcagctgccggccgtggtgttacgctacgcgtcggcccgcgccaggtggtcgtggacaatggcgcggtgcaggtggcgctgtcggcgccggacggccggatcaccggcgtcagctacagcggcgagcccaacctgctggagtacgacgccggcgccggcgagggagactacggagggtactgggattcggtatggaactatcccggctctgatctccgacaactctacgatacgttggatagtacagagttcaacgtagtgtcctcaagtgaagaccaagtggagctttctttcaggagtagctctgggttctactgctatgccatctttgagcatgacagggcctaccctgctctcaacatcaccgaagctcggcttgtcttcaagcttaacccggcaaagttcaattacatggctattacagacgacatacagaggtacatgcccagcgcggtggacagagaagaacctcgtgctgtcccactggcttacaaggaggctgttctgctggttgaccccaaggaaccccaattcagaggagaggtagatgacaagtaccagtactctctggataacaaggacaacgttgttcacggatggatcagcggcagcgatccaaacccaattggtttctgggtcatcactcccagcaacgagttcaagagcggtggccctctcaaacgggagctcacctcccatgtcggccccacatctctcaccatgtttatggggacgcattatgtcggcaagtacatggtggccgacatcgacgacggcgaggagtggaagaaggtcctcggccccgtgttcatctacctcaactcaggtcccaagacaggcgacctgtgggaggacgccaaggcgcaggcggaggccgaggcgaggagctggccctacggcttcctggcgtcaccggacttccccaagtcagccgagagagggtccgtcaccgggaggctgttggtcagcgacaggcacctgaacaagaagcacgacatgcccgccggggcggcggcctacgtcggcctggcctcgccggggcagccgggctcctgggcgacggagagcaaggggtaccagttctggacgagggccgcgtccgacggcaccttcaccatcgccaacgtcagggaaggcgtgtacgacctgtacgccttcgttccgggggttcttggagactactacgaccgcggctcgccgtcgtcgccgctgaccgtagcgcctggccgtgccgtcgccgtcggtgaccttgtcttcgagcccccgaggtccggcccgacggtgtgggagattggcgtccccgaccgtacggcggcggagttctacgtcccggacccggaccccaggtacgtcaacagggtcttcgtcggcgaccgagacaggtaccggcagtacggtctctgggagaggtacgccgagttgtacccggacaaggatctcgtcttcaccgtcggtgaaagcaacgaatccaaggactggttctttgcacacgtcacaagaaaggttggccaggttgccgtgccaacgacatggcagatacggttcagtctggacagcgtcgaggctgacggcgactacacgctgcggatcgccattgcagcttctgaaaggtgcaggttgcaggtgcaagtgaatgacgatggggatgatgcgaggagaggcggggtgtttacggcggccggcgacatggccatgggggacgacaacgccatcacgcgccacgggatacacggcatgcagcggagcctcgagttcgcggtcgggggccacctgctgcggcgaggcggcaacaccattggcctaaaactcatcagccaccagcaaggaccggaaggtccggccatggtcgccggagtcatgtatgactacatccgcctagaagggccgccgtcgtccagaggcgttgcgtcacgcggggttccacttcaccgtgtttgggtgcagattttgctcgtgtcttcactggcctgcttcctcgtgatgtcccagtag

SEQ ID NO: 18011 - protein, 696 aa, Sorghum bicolor
  misc_feature: Useful for making plants with altered cell wall content and/or composition
  misc_feature: Functional homolog of the protein sequence given in SEQ ID NO 14592
  misc_feature: Useful for making plants with altered carbohydrate content
  misc_feature: Functional homolog of the protein sequence given in SEQ ID NO 14593
  misc_feature: Ceres ANNOT ID no. 8689932
  misc_feature (1)..(215): Pfam ID: Rhamnogal_lyase Pfam Description: Rhamnogalacturonate lyase family
MAAAPAQAGRFLLVVLVATASLLPWLAGVSTEAAAAGRGVTLRVGPRQVVVDNGAVQVALSAPDGRITGVSYSGEPNLLEYDAGAGEGDYGGYWDSVWNYPGSDLRQLYDTLDSTEFNVVSSSEDQVELSFRSSSGFYCYAIFEHDRAYPALNITEARLVFKLNPAKFNYMAITDDIQRYMPSAVDREEPRAVPLAYKEAVLLVDPKEPQFRGEVDDKYQYSLDNKDNVVHGWISGSDPNPIGFWVITPSNEFKSGGPLKRELTSHVGPTSLTMFMGTHYVGKYMVADIDDGEEWKKVLGPVFIYLNSGPKTGDLWEDAKAQAEAEARSWPYGFLASPDFPKSAERGSVTGRLLVSDRHLNKKHDMPAGAAAYVGLASPGQPGSWATESKGYQFWTRAASDGTFTIANVREGVYDLYAFVPGVLGDYYDRGSPSSPLTVAPGRAVAVGDLVFEPPRSGPTVWEIGVPDRTAAEFYVPDPDPRYVNRVFVGDRDRYRQYGLWERYAELYPDKDLVFTVGESNESKDWFFAHVTRKVGQVAVPTTWQIRFSLDSVEADGDYTLRIAIAASERCRLQVQVNDDGDDARRGGVFTAAGDMAMGDDNAITRHGIHGMQRSLEFAVGGHLLRRGGNTIGLKLISHQQGPEGPAMVAGVMYDYIRLEGPPSSRGVASRGVPLHRVWVQILLVSSLACFLVMSQ

SEQ ID NO: 18012 - DNA, 1251 bp, Sorghum bicolor
  misc_feature: Ceres ANNOT ID no. 8690288
  misc_feature: Encodes the peptide sequence at SEQ ID NO 18013
atgggctcagcccactcctcccactcgtccgtctccaccgccggcggcgacgacgacgaggacgacgaggagccgtccgcggcggccgtctcctccgcgggcgcacgcgcaccggcgccggcgccggcgccggtccgcgtgcccccgtcgtccgcgtccgcgtccaaggtgctggagcaggagcccgaggtactgccgtgcctcgccgcggactcgccgctgtcgccgcagccctcggcggcgggcaccccgcgcctcctcgcggggcccggcatcaaggtctgggacccctgccacgtcctcctgcccccgccgccgccgtccccgtccccgcacccgggcaggcaggccgacgccgcggccgtcgaggtcgtgctggtcagccacggcgagtgcgccgccgcgatgcgcccggacctcgtcggcggccggtggccggccgcggcgctcacggcgcgcggggagcgccaggggcgcgcgctcgccgtgttcctgcgctcccgcggcgccaggctcgccgctgcctacgcgtccccgcttgaccgcgcgcgcgccaccgccgccctcgtctgtcgggaactcgatttcccagaggagcagatccaactgtcagatgctttgactgaaatgagtcaaggtcagtgggagggctgcccaaaatccgagatttatactccagaaatggtcaatctgatggaaagcacgcaacctgatttctctgcaccgtccggggagtcactcagacaggtacagtttcggatgatggaattcctcaaccggacagtcctaagactaccagaaaaggtggcaatgggggacacactgtcacaacaaaatgagttgaaggggttctctcggcagagctccagtaattctgtccaagatggtcctccttgggatttgctttacaggctcaaccggcacagcctccaacgaaagaaatctgggaaaagccgactccagtttgtcacttcaggggacaatgaagctgaagatgatttctcccctaaagaagtaaaccagaggcatctccttcatgaaggaagtcttgggggctcagcggcctccattgctattttcagccacgtgacccctattcggtgcctcattgcaggcctgctagactgcaatcctataatgtccaagagaatatgtatagacgattcttctgttactgttcttgagcattcgctgaaaacaggatggcaaataaaaaggctgaatgatactgcacatctcaggcttctctag

SEQ ID NO: 18013 - protein, 416 aa, Sorghum bicolor
  misc_feature: Useful for making plants with altered cell wall content and/or composition
  misc_feature: Functional homolog of the protein sequence given in SEQ ID NO 14594
  misc_feature: Ceres ANNOT ID no. 8690288
  misc_feature (124)..(314): SWISSPROT Homolog: EC 5.4.2.1 Phosphoglycerate mutase
  misc_feature (123)..(275): Pfam ID: PGAM Pfam Description: Phosphoglycerate mutase family
MGSAHSSHSSVSTAGGDDDEDDEEPSAAAVSSAGARAPAPAPAPVRVPPSSASASKVLEQEPEVLPCLAADSPLSPQPSAAGTPRLLAGPGIKVWDPCHVLLPPPPPSPSPHPGRQADAAAVEVVLVSHGECAAAMRPDLVGGRWPAAALTARGERQGRALAVFLRSRGARLAAAYASPLDRARATAALVCRELDFPEEQIQLSDALTEMSQGQWEGCPKSEIYTPEMVNLMESTQPDFSAPSGESLRQVQFRMMEFLNRTVLRLPEKVAMGDTLSQQNELKGFSRQSSSNSVQDGPPWDLLYRLNRHSLQRKKSGKSRLQFVTSGDNEAEDDFSPKEVNQRHLLHEGSLGGSAASIAIFSHVTPIRCLIAGLLDCNPIMSKRICIDDSSVTVLEHSLKTGWQIKRLNDTAHLRLL

SEQ ID NO: 18014 - DNA, 702 bp, Sorghum bicolor
  misc_feature: Ceres ANNOT ID no. 8690530
  misc_feature: Encodes the peptide sequence at SEQ ID NO 18015
atggccctgcaggtgcaggcccagtcgtctctcctcggccggttcgcggccatcacggccgggtgcagcgaggtggagccgtgggcggccgtcgtctgcgggttcgtgtccgcgtgggtgctcatcagcgccaacgcgctcgccgcgcgcctcaagttcgacgacccgctggaggcggcgcagctgcacggcgggtgcggcgcctggggcgtcctcttcacgggcctcttcgcgagccaaaagtacgtggagcagatctacggctccgggaggccctacgggctgttcatgggcagcggcgggaagctcctcgccgcgcagatcatccagatcctggtgatcgccgggtggaagctggacctgctgtgcatctcggccgacgacgagatgtccggcatggacctcaccaggcacggaggtttcgcctacatctaccacgacgaggacccaagcgacaaggccgggggttggtgggttcatgctcaagtccgcgcagcaccgtgtcgagccgccggcggcgacagcgaccagcaaccaggtgtaaaaatcagaagcaaattaaaacctatcgagctgaagttacgtgcttgcctttttcagtgtgtcatcgcgtattcatatttgattttgatctcgatcatatctgccggtactgtttgggcaatacttcgccactcttcggagtcgcaagaatttgtgtaa

SEQ ID NO: 18015 - protein, 233 aa, Sorghum bicolor
  misc_feature: Useful for making plants with modulated carbon-nitrogen partitioning
  misc_feature: Functional homolog of the protein sequence given in SEQ ID NO 14551
  misc_feature: Useful for making plants with altered carbon content
  misc_feature: Useful for making plants with altered nitrogen content
  misc_feature: Functional homolog of the protein sequence given in SEQ ID NO 14552
  misc_feature: Ceres ANNOT ID no. 8690530
MALQVQAQSSLLGRFAAITAGCSEVEPWAAVVCGFVSAWVLISANALAARLKFDDPLEAAQLHGGCGAWGVLFTGLFASQKYVEQIYGSGRPYGLFMGSGGKLLAAQIIQILVIAGWKLDLLCISADDEMSGMDLTRHGGFAYIYHDEDPSDKAGGWWVHAQVRAAPCRAAGGDSDQQPGVKIRSKLKPIELKLRACLFQCVIAYSYLILISIISAGTVWAILRHSSESQEFV

SEQ ID NO: 18016 - DNA, 1695 bp, Sorghum bicolor
  misc_feature: Ceres ANNOT ID no. 8690552
  misc_feature: Encodes the peptide sequence at SEQ ID NO 18017
atgggcgcgtgtgggcactggcaccactgctctgggctctggcagagagaactcagacgacaccgctggtccgcccgctgtcctctggagctctgccacccccaagaaagagagccctcgcgcggcgccgtcatgctcccgccgttcggcaacccgctctgggtaccggaggacgtcaacgatcagcagcagcagcacgcgcctccgccgacgcccatggggttggtgacggtgccggcgcagcaggggcacgaggagcagaacctcctggccctggcctccgccgccgccatgggggtcggtggtgttttcagctcgccggcggtgctcgatgacgactggtgcttcgaccccgtggctgcggcctccgccgccggcgcgcaggggcacctgctactggcgccgccggcgccggcccccggcgccgggtcgcagatgttctcgctcttcaacgttggcggcgcgacgttcgacgtccacgggttcgacctcggcctcggtggcctcggcggcggggccggtggggaactggtcccgttcgccggcgccgggaacgcgtcgaattccgcgtccttttccctgataccggcagggaacgccggcttcctcggctcgttcggcggcttcggcacagcgccagcgcaaatgccggactttggcggcctcggcgggttcgacatgttcaacaacggcgccggctcctccaccgcggcgccccctcctgcctcggtgtccctgacggcgccgttctctgggcgcgggaaggctgctgtgctccgcccgctggagatcttcccgcccgtgggcgcgcagccgacgctgttccagaagcgcgcgctccgccggaacgccggcgaggaggacgacgacaagaagcgcaaggctgaggccatcaccgcggctgcgggagcttcgtcggctggtggcggtgacacggtgctggacgacgccgacgacgatgacggcgggagcatcgacgcgtccgggctcaactacgactcggaggacgccaggggcgtcgaggacagtgaaaagaaggacggtaaggattccaacgccaacagcacggtgacaggcggcagcaccggcgacgggaagggtaagaggaagggattgccggccaagaacctcatggcggagcgccgtcgccggaagaagcttaatgaccggctctacatgctccggtctgtcgtgcccaagatcagcaagatggacagggcctccattcttggcgacgcgatcgagtacctcaaggagctgctgcagaagatcaatgatcttcagaatgagctggagtcatccccttccacagcctcactgcctccaacacccacaagcttccacccactgactccgacactgcccactctaccatctcgtgtgaaggaagaggtgtgcccaagtgcattgcctagccctacttcccagcaaccaagggttgaggttaggatgagggaaggccgggcggtcaacatccacatgctctgtgctcgcaggcctggtcttctgctttctgctatgagggcgatcgaaggcctcggactcgatgtccagcaagctgttatcagttgcttcaatggattttccttggacatcttcaaggctgagctatgcaatgaaggccctgggcttctgccagaagagatcaagtccgtgctcctgcaatctgctgggttccatggcgtgatgccatga

SEQ ID NO: 18017 - protein, 564 aa, Sorghum bicolor
  misc_feature: Useful for making plants with altered lignin content
  misc_feature: Functional homolog of the protein sequence given in SEQ ID NO 12905
  misc_feature: Ceres ANNOT ID no. 8690552
  misc_feature (374)..(421): Pfam ID: HLH Pfam Description: Helix-loop-helix DNA-binding domain
MGACGHWHHCSGLWQRELRRHRWSARCPLELCHPQEREPSRGAVMLPPFGNPLWVPEDVNDQQQQHAPPPTPMGLVTVPAQQGHEEQNLLALASAAAMGVGGVFSSPAVLDDDWCFDPVAAASAAGAQGHLLLAPPAPAPGAGSQMFSLFNVGGATFDVHGFDLGLGGLGGGAGGELVPFAGAGNASNSASFSLIPAGNAGFLGSFGGFGTAPAQMPDFGGLGGFDMFNNGAGSSTAAPPPASVSLTAPFSGRGKAAVLRPLEIFPPVGAQPTLFQKRALRRNAGEEDDDKKRKAEAITAAAGASSAGGGDTVLDDADDDDGGSIDASGLNYDSEDARGVEDSEKKDGKDSNANSTVTGGSTGDGKGKRKGLPAKNLMAERRRRKKLNDRLYMLRSVVPKISKMDRASILGDAIEYLKELLQKINDLQNELESSPSTASLPPTPTSFHPLTPTLPTLPSRVKEEVCPSALPSPTSQQPRVEVRMREGRAVNIHMLCARRPGLLLSAMRAIEGLGLDVQQAVISCFNGFSLDIFKAELCNEGPGLLPEEIKSVLLQSAGFHGVMP

SEQ ID NO: 18018 - DNA, 2565 bp, Sorghum bicolor
  misc_feature: Ceres ANNOT ID no. 8690553
  misc_feature: Encodes the peptide sequence at SEQ ID NO 18019
atgacttcggcggcggccgcggcccaggcggcgggagggggtggaggaggaggaggagtctgcgagggggatgccgctgccgcggcgcgaggcggaggcggaggcggaacggaggacggcatgtacacggagctctggagcctctgcgccggcccgctggtcacggtgcccagggtcggggacaaggtctactacttcccacagggccatatcgagcaggtggaggcatcgaccaaccaggtggctgagcagcacatgcaactttacaatctcccatggaagatcctgtgtgaggtcatgaatgttgaattgaaggctgagccggacaatgatgaggtttatgcccagctcactctgctacctgaatcgaagccagaggagaatggctctagtcaggaggagatgcctgctgcacctcctgctgcacttgcaaggccacgtgtgcactccttctgcaagacattgacagcctctgacaccagcacacatggtggtttctcggtgctgcgtcgccatgcagatgaatgccttccaccgctggatatgagtcgtcaacctccaacacaagagcttgtggccaaggatctgcatggtgtggaatggcgctttcgtcacatattcagaggtcaacccggaaggctttttttgcagagtggctggagtgtttttgttagtgcaaagcgtcttgttgctggggatgccttcatctttctgagaggtgataatggggagctgcgtgtgggagtcaggcgtgccatgaggcagcaagcaaatgttccgtcttcagtaatatcaagccacagcatgcatcttggtgttcttgctactgcatggcatgctgttaacactgggaccatgttcactgtctactacaaacctaggacaagtccagctgagtttgttgtcccctgtgatcgctatacggagtcactgaaacgaaattaccctatagggatgagatttaaaatgaggtttgaaggtgaagaggctccagagcaaaggttcactgggacgattgttggaaatgtggatcctgaacaagctggatgggctgaatctaaatggcgttacctcaaggtgaggtgggatgaagcttcctccattccacgtcctgaaagggtttctccttggcaaatagaacctgcagtcagccctccccctgtcaatccacttccagtacacaggcccaagaggcctcgctctaatgctgtagcttctctggctgagtcttcagctccaacaaaagaagctgctccgaaggtcacattagagactcaacaacatgccctgcaaaggcccttgcagacccaggataatgcggccccaaaaagtggttttggtgataacagtgagttggacgctgctcataagtcagccctgcgaccatcagggtttgatctagagaagaacaccattggcatgcagaggaagctgggttcagatagttggatgcatatgaacagacctgaaggatacaatgaaatgttatctggatatcaacaacctaataaagatgtacagaatccacagggtttctgttctttacctgatcagattgctgccggtcgtcctaatttctggcacaccgtaaatgctcattatcaagaccagcaaggcaatcacaatctattccctggttcatggtccatgatgccttcaagtactggctttgggttgaacagacagagctatccaatgatgcaggaagttggtgggttgtctcagagtgctacgaacaccaagtttgggaatggagcttatgctgcactacctggtcatggcattgatcaatactcttctggatggtttgggcacatgatacctggtgctcgcatggacgatgtccagccacgcgtgattaagcctcaacctttggtccttgctcatggtgaagctcagaaaatgaaaggcaattcatgcaagctttttggaattcaccttgatagcccagccaaatctgaacctttgaaatctccaccaagtgttgcctatgatgggatgccacaaactccagcagcagctgaatggcggatggttgattcaattgaagcagacagatgttctgatccacttaagatgccaaagcaactcgatgctacacaggtagatcctgttccagagaaatgttcacaagtttcaagaggcacacagtgcaaatcacaaggtggatcaactaggagctgcaagaaggtccacaagcaaggaatcgcacttggcaggtctgtggatcttacaaagttcaatggctacacggaattgattgctgagctggatgagatgtttgacttcaatggggagctgaaaggttctaacaaggaatggatggttgtgtacaccgacaatgaaggtgatatgatgctggttggggatgatccctggaatgagttctgcaacatggtccacaagatcttcatctacacaagggaggaggtccagaggatgaatccgggcaccctgaattcaaggtccgaggacagccttgctaattcaatggaaaggggctctactgctagggagacacctggcagcctatccgcctcttcccttgactctgagaactgctaa

SEQ ID NO: 18019 - protein, 854 aa, Sorghum bicolor
  misc_feature: Useful for making plants with modulated biomass
  misc_feature: Useful for making plants with modulated seed size
  misc_feature: Functional homolog of the protein sequence given in SEQ ID NO 13377
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: The sequence is a functional homolog of SEQ ID NO 298 in the 10/412,699 US patent application
  misc_feature: The sequence is a functional homolog of SEQ ID NO 300 in the 10/412,699 US patent application
  misc_feature: Useful for biocontainment applications
  misc_feature: Useful for making plants with modulated flowering time
  misc_feature: Functional homolog of the protein sequence given in SEQ ID NO 13656
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: Ceres ANNOT ID no. 8690553
  misc_feature: Up-regulated in root tissues in response to methyl jasmonate treatment
  misc_feature: Up-regulated in shoot tissues in response to methyl jasmonate treatment
  misc_feature (277)..(359): Pfam ID: Auxin_resp Pfam Description: Auxin response factor
  misc_feature (150)..(255): Pfam ID: B3 Pfam Description: B3 DNA binding domain
  misc_feature (625)..(818): Pfam ID: AUX_IAA Pfam Description: AUX/IAA family
MTSAAAAAQAAGGGGGGGGVCEGDAAAAARGGGGGGTEDGMYTELWSLCAGPLVTVPRVGDKVYYFPQGHIEQVEASTNQVAEQHMQLYNLPWKILCEVMNVELKAEPDNDEVYAQLTLLPESKPEENGSSQEEMPAAPPAALARPRVHSFCKTLTASDTSTHGGFSVLRRHADECLPPLDMSRQPPTQELVAKDLHGVEWRFRHIFRGQPGRLFLQSGWSVFVSAKRLVAGDAFIFLRGDNGELRVGVRRAMRQQANVPSSVISSHSMHLGVLATAWHAVNTGTMFTVYYKPRTSPAEFVVPCDRYTESLKRNYPIGMRFKMRFEGEEAPEQRFTGTIVGNVDPEQAGWAESKWRYLKVRWDEASSIPRPERVSPWQIEPAVSPPPVNPLPVHRPKRPRSNAVASLAESSAPTKEAAPKVTLETQQHALQRPLQTQDNAAPKSGFGDNSELDAAHKSALRPSGFDLEKNTIGMQRKLGSDSWMHMNRPEGYNEMLSGYQQPNKDVQNPQGFCSLPDQIAAGRPNFWHTVNAHYQDQQGNHNLFPGSWSMMPSSTGFGLNRQSYPMMQEVGGLSQSATNTKFGNGAYAALPGHGIDQYSSGWFGHMIPGARMDDVQPRVIKPQPLVLAHGEAQKMKGNSCKLFGIHLDSPAKSEPLKSPPSVAYDGMPQTPAAAEWRMVDSIEADRCSDPLKMPKQLDATQVDPVPEKCSQVSRGTQCKSQGGSTRSCKKVHKQGIALGRSVDLTKFNGYTELIAELDEMFDFNGELKGSNKEWMVVYTDNEGDMMLVGDDPWNEFCNMVHKIFIYTREEVQRMNPGTLNSRSEDSLANSMERGSTARETPGSLSASSLDSENC

SEQ ID NO: 18020 - DNA, 1815 bp, Sorghum bicolor
  misc_feature: Ceres ANNOT ID no. 8690689
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 18021
atgccaccgcgggcgccgtcgtctctgccgcctactatcccggcctgcgacccgcacgacgggccagcgagcctgcagctcatcgaggacctgaccacccacgccggcgccatccagcagcgcgtcctcagagagatcctcgccatgaacgccggcaccgactacctccgcggcttccttggcgccggcgccgagggacgcgacgccgacgagctcgccgccacgttcaaggaccgcgtgccggtcgtggagtacgaggacgtcaagccgtacatcgagcgcatcgccaacggcgccccctcgtcgctcatctcctccaagaccatcaccgagctcctcacaagctccggcacgtccggcgggcagccgaagctgatgccgtccacagaggaggagctcgaccgcaagaccttcctctacaacctcctcgtccccgtaatgaacaagtacgtggaaggtctggacaaagggcggtgcatgtacctgctgttcgtgaagccggagatcacgacggcgtcggggctggtggcgcggccggtgctgacgagctactacaagtcccggcacttccgggagcggccggacagtccgtacacgcggtacacgagcccgaacgaggcgatcctgtgcccggacagcgcgcagagcatgtacgcgcagctgctgtgcggcctggcgcgccgcggcgaggtgctccgcgtcggcgccgtcttcgcctccgcgttcctgcgcgccgtcaagttcctcgaggcgcactggcgcgcgctctgcgacgacatccgcgccggccgcgtcgacgcgtcccgcgtcaccgacgccgcctgccgggacgccgtcgccagggtcgtggcgcggccggacccggcgctggccgacgccatcgccgccgagtgcgaagggtcgtcgtcgtcgtcgtggcggggcatcgtgcgccggctctggccgcggaccaagtacatcgacgtcatcgtgacggggtccatggcgcagtacatcccgctgctggagttctacggcggcggcctgccgctggtgtccaccatgtacgcctcgtcggagtgctacttcggcatcaacctccggccgctggacccgccggaggacgtggcgtacacgctgctgcccaacatgtgctactacgagttcatcaaggtggagaaggacggtctgtaccggtaccgcgtgggcgacatcctgcaggtgtccggcttccacaacgcggcgccgcagttccggttcgtgcaccgccgcaacgtggtgctgagcgtggacaccgacaagacctccgaggacgacctcctccgcgccgtcaccgccgccaagcgcctcctggcgcctctcggcggcgccaccatcctctccgagtacaccgcctacgccgacacggcctccatcccgggccactacgtcctcttctgggagctcacgcccacgccgcccatgcccggcgacggcgacaccgcggcccgcgtcatggcggcgtgctgcgccgaggtggaggccggccttgacgccgtgtaccagcggtgccggagccgcgaccggtccgttggcccgctggagatccgcgtggtgtccaccggcgccttcgacgcgctcatggacctctgcgtctcccacgggtcgtcggtgaaccagtacaagacgccgcgctgcatcaagcaccccgacgccatcgccgtcctggaggcgcgcgtcgtcggcaggttcttcagcgacaccgtgccgcactgggagcccttcaacgtcgtcgacactgccgccgccggcgccgccgccaccaccacccccagcctgaacgaaggcgcgacgtaa

SEQ ID NO: 18021 - protein, 604 aa, Sorghum bicolor
  misc_feature: Useful for making plants with modulated biomass
  misc_feature: Useful for making plants with modulated light quality response
  misc_feature: Useful for making plants with modulated low light sensitivity
  misc_feature: Functional homolog of the protein sequence given in SEQ ID NO 14293
  misc_feature: Ceres ANNOT ID no. 8690689
  misc_feature (23)..(561): Pfam ID: GH3 Pfam Description: GH3 auxin-responsive promoter
MPPRAPSSLPPTIPACDPHDGPASLQLIEDLTTHAGAIQQRVLREILAMNAGTDYLRGFLGAGAEGRDADELAATFKDRVPVVEYEDVKPYIERIANGAPSSLISSKTITELLTSSGTSGGQPKLMPSTEEELDRKTFLYNLLVPVMNKYVEGLDKGRCMYLLFVKPEITTASGLVARPVLTSYYKSRHFRERPDSPYTRYTSPNEAILCPDSAQSMYAQLLCGLARRGEVLRVGAVFASAFLRAVKFLEAHWRALCDDIRAGRVDASRVTDAACRDAVARVVARPDPALADAIAAECEGSSSSSWRGIVRRLWPRTKYIDVIVTGSMAQYIPLLEFYGGGLPLVSTMYASSECYFGINLRPLDPPEDVAYTLLPNMCYYEFIKVEKDGLYRYRVGDILQVSGFHNAAPQFRFVHRRNVVLSVDTDKTSEDDLLRAVTAAKRLLAPLGGATILSEYTAYADTASIPGHYVLFWELTPTPPMPGDGDTAARVMAACCAEVEAGLDAVYQRCRSRDRSVGPLEIRVVSTGAFDALMDLCVSHGSSVNQYKTPRCIKHPDAIAVLEARVVGRFFSDTVPHWEPFNVVDTAAAGAAATTTPSLNEGAT

SEQ ID NO: 18022 - DNA, 435 bp, Sorghum bicolor
  misc_feature: Ceres ANNOT ID no. 8690752
  misc_feature: Encodes the peptide sequence at SEQ ID NO 18023
atgcccagaagcagtgaccattcggccaccgtactgcatgacatccaccagagacaacgagccgacggccccgcggccatgctgggcaccggcacggcaaacccggccggtgacagatcaggaatcaagaagcgacggtgcctggatcgaacggggtcttctgggcggtgtacccggccaggcggccctgcggtcttggacagctacgaatccgctctcggtctagagccggggaagcttgcggccagccgccacgtgctaattagtgagtacggcaacatgatgggcgccatgatcttctttcttctcgacgagatatgccgccgctgcgaagaggatgctaaaaagaactgccgggtgatgtcggggctcggccccggactcacaatcgagacaattgtgttgcatgccaccggcagcaaggacgaaaactag

SEQ ID NO: 18023 - protein, 144 aa, Sorghum bicolor
  misc_feature: The sequence is a functional homolog of SEQ ID NO 2 in US patent 7202397
  misc_feature: Ceres ANNOT ID no. 8690752
  misc_feature (60)..(137): SWISSPROT Homolog: EC 2.3.1.74 Naringenin-chalcone synthase
  misc_feature (7)..(139): Pfam ID: Chal_sti_synt_C Pfam Description: Chalcone and stilbene synthases, C-terminal domain
MPRSSDHSATVLHDIHQRQRADGPAAMLGTGTANPAGDRSGIKKRRCLDRTGSSGRCTRPGGPAVLDSYESALGLEPGKLAASRHVLISEYGNMMGAMIFFLLDEICRRCEEDAKKNCRVMSGLGPGLTIETIVLHATGSKDEN

SEQ ID NO: 18024 - DNA, 138 bp, Sorghum bicolor
  misc_feature: Ceres ANNOT ID no. 8690895
  misc_feature: Encodes the peptide sequence at SEQ ID NO 18025
atggtggtcgctgctgcctccaccgtgcagaagtcggccatagccctagacgcggtgactgtggcggtcggcttggatgttgcgtccaaaattatggccttttctcaacaaggcccgcacactacatgcataatttga

SEQ ID NO: 18025 - protein, 45 aa, Sorghum bicolor
  misc_feature: The sequence is a functional homolog of SEQ ID NO 1503 in the 11/479,226 US patent application
  misc_feature: The sequence is a functional homolog of SEQ ID NO 646 in the 11/435,388 US patent application
  misc_feature: The sequence is a functional homolog of SEQ ID NO 374 in the 10/374,780 US patent application
  misc_feature: The sequence is a functional homolog of SEQ ID NO 604 in the 10/225,066 US patent application
  misc_feature: Ceres ANNOT ID no. 8690895
MVVAAASTVQKSAIALDAVTVAVGLDVASKIMAFSQQGPHTTCII

SEQ ID NO: 18026 - DNA, 855 bp, Sorghum bicolor
  misc_feature: Ceres ANNOT ID no. 8691145
  misc_feature: Encodes the peptide sequence at SEQ ID NO 18027
atgaggaagaagctcggcacccggttccccgcggatggttttgactcttcaaaacctcatattattctgttgtcatggaaccaacgtgagttgaagttccaagctacacacacctgtatggctcgaatcaaaaagattatgcaagcagatgaggatgtcggaaagattgcactagcggtgcctgttttagtctcgagggctcttgaattgtttttacaagatttaattgaccggacttatgaaattactcttcaaagtggagcaaagacactgaattccttccacctgaagcaatgtgtgaagaggtacagttcttttgatttcctaactgaagttgtcaacaaggtaccagatcttggtggcgctgattcctgtggagatgaaagaggattacctagaagaagaaagtcaaatggcagtgacccagagaatgatgaatcaagatctagtaaaatggtcataagaaatgcaaacatcagccccagaggacgtgggaggggtcgaggcagagggcgaggtcggccaccaaccaagagaaaggaagttggttatgtgcaatttgaagatgagagcagcatgtttgctgaacaaggtgaacccttaccaggagaggaaacagttcaagagatcaacaatggcaacgagatcatgcctcaaagcacgcaacctccagtagaggctccgccaacagcccctgcacaagctacaagttctaaggtggaagaagcgaacaccaatcatcagtcagattggcctatgccagatgccattggaagcatcggtgtcggtccgtctggttttgggcatctgacagtgcaggtcgatgaagacgaggactacgacaatgaggactag

SEQ ID NO: 18027 - protein, 284 aa, Sorghum bicolor
  misc_feature: The sequence is a functional homolog of SEQ ID NO 32 in US patent 7288695
  misc_feature: Ceres ANNOT ID no. 8691145
  misc_feature (40)..(183): SWISSPROT Homolog: EC 2.7.7.7 DNA-directed DNA polymerase
  misc_feature (40)..(100): Pfam ID: CBFD_NFYB_HMF Pfam Description: Histone-like transcription factor (CBF/NF-Y) and archaeal histone
MRKKLGTRFPADGFDSSKPHIILLSWNQRELKFQATHTCMARIKKIMQADEDVGKIALAVPVLVSRALELFLQDLIDRTYEITLQSGAKTLNSFHLKQCVKRYSSFDFLTEVVNKVPDLGGADSCGDERGLPRRRKSNGSDPENDESRSSKMVIRNANISPRGRGRGRGRGRGRPPTKRKEVGYVQFEDESSMFAEQGEPLPGEETVQEINNGNEIMPQSTQPPVEAPPTAPAQATSSKVEEANTNHQSDWPMPDAIGSIGVGPSGFGHLTVQVDEDEDYDNED

SEQ ID NO: 18028 - DNA, 93 bp, Sorghum bicolor
  misc_feature: Ceres ANNOT ID no. 8691207
  misc_feature: Encodes the peptide sequence at SEQ ID NO 18029
atgttcccttttgagagattcatgggattcttgaagaaatatgttctcaaccatgctcggcgagaaggaagcatcaccaaggctatggaatag

SEQ ID NO: 18029 - protein, 30 aa, Sorghum bicolor
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: Ceres ANNOT ID no. 8691207
MFPFERFMGFLKKYVLNHARREGSITKAME

SEQ ID NO: 18030 - DNA, 150 bp, Sorghum bicolor
  misc_feature: Ceres ANNOT ID no. 8691222
  misc_feature: Encodes the peptide sequence at SEQ ID NO 18031
atggttgaaggagagggtcatgcgaaaagacaaatcaaagcaattcaagagatagtagctggattttttaatgaccaagtcatagatcccaagggcgagcactactacaaccacaaagaacaattgaagccaaacatagataataattaa

SEQ ID NO: 18031 - protein, 49 aa, Sorghum bicolor
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: Ceres ANNOT ID no. 8691222
MVEGEGHAKRQIKAIQEIVAGFFNDQVIDPKGEHYYNHKEQLKPNIDNN

SEQ ID NO: 18032 - DNA, 927 bp, Sorghum bicolor
  misc_feature: Ceres ANNOT ID no. 8691221
  misc_feature: Encodes the peptide sequence at SEQ ID NO 18033
atggcggtccggctggaccctggctatttgaggataggagtcgctccagctgaactttgcacatcatcaccatcatcatcagcatcaccacagccctgcacttcccccaattggacgatcgacgtgtcggacgtcagaactatcaaggtgaccaacgtacctctctcagcgaccgcggagaacatgaaggagttcttctccttctctggcgagatcgagtatgtcgagatgcgaagggactcggagacgtctcaggtcgcttatgtcaccttcaaggagttccatggagctgacacagctctactcctctctggatcaagcatgtgtggcgatgttcctgtgaacatcgcgccagtggaagactacgaactgccaccggaagcctactcccactcgcatccagaagaaaggtcgccggcgccgggcacgccgaccggggaggccgtgaagaaggcggaggaggtggtgagcaccatgctggccaagggcttcgtgctgagcaaggacgcgctgcggcgcgcgcagtcgttcgacgggcggcaccagcagctgctgtccacggcgacggcgcgcgtcgcgtcgctggaccgccgcctggggctcagcgacaagttcagcctcggcacggcggcggcccgcggcgcggcgcgcggcgtcgacgagcggttccaggtcacggagcgcgcctggggcgccttctccgcggccggggaggtcgtggccggcagcccctacgcgtcgcgcggcgccgcgtgggtgtcggccgccgtcggcgccgtcgccagggccgcgtccgacgtcggcgccatgaccatggagaaggtggtcagggccgaggaggaaggcacggcggcggagcaagggaacgcgggtcgtgtcgacgtgcacgacggacaggtagctgcagctcagcacggtgcaatgtag

SEQ ID NO: 18033 - protein, 308 aa, Sorghum bicolor
  misc_feature: Useful for making plants with modulated biomass
  misc_feature: Functional homolog of the protein sequence given in SEQ ID NO 13029
  misc_feature: Ceres ANNOT ID no. 8691221
  misc_feature (48)..(116): Pfam ID: RRM_1 Pfam Description: RNA recognition motif. (a.k.a. RRM, RBD, or RNP domain)
MAVRLDPGYLRIGVAPAELCTSSPSSSASPQPCTSPNWTIDVSDVRTIKVTNVPLSATAENMKEFFSFSGEIEYVEMRRDSETSQVAYVTFKEFHGADTALLLSGSSMCGDVPVNIAPVEDYELPPEAYSHSHPEERSPAPGTPTGEAVKKAEEVVSTMLAKGFVLSKDALRRAQSFDGRHQQLLSTATARVASLDRRLGLSDKFSLGTAAARGAARGVDERFQVTERAWGAFSAAGEVVAGSPYASRGAAWVSAAVGAVARAASDVGAMTMEKVVRAEEEGTAAEQGNAGRVDVHDGQVAAAQHGAM

SEQ ID NO: 18034 - DNA, 273 bp, Sorghum bicolor
  misc_feature: Ceres ANNOT ID no. 8691479
  misc_feature: Encodes the peptide sequence at SEQ ID NO 18035
atggagacaggtgttaggtgcggcaagaaggatcgatcattggagaagacgttccgcgccgacggcgagcagaagccgttcgcgcaggccaagctgcagctgcagagcttccccaccatgctcctgttcccgagccgcaccgccaggcccatcaagtacccgtcggagaagagagacgtcaactcgctcctgtccccgatctggtcccggccactgcaatcaggtatcctgcgttatcttttcctcgttgatctccatgcctgctcgatctag

SEQ ID NO: 18035 - protein, 90 aa, Sorghum bicolor
  misc_feature: Useful for making plants with modulated nitrogen use efficiency
  misc_feature: Functional homolog of the protein sequence given in SEQ ID NO 14355
  misc_feature: Ceres ANNOT ID no. 8691479
  misc_feature (18)..(65): SWISSPROT Homolog: EC 1.8.4.9 Adenylyl-sulfate reductase (glutathione)
METGVRCGKKDRSLEKTFRADGEQKPFAQAKLQLQSFPTMLLFPSRTARPIKYPSEKRDVNSLLSPIWSRPLQSGILRYLFLVDLHACSI

SEQ ID NO: 18036 - DNA, 891 bp, Sorghum bicolor
  misc_feature: Ceres ANNOT ID no. 8691574
  misc_feature: Encodes the peptide sequence at SEQ ID NO 18037
atgaagaccgggcctccgcacgtcgccatgctcgccacgcctgggataggccacgtgatcccgctcgcggagctcgccaagcgcctcgcgtctcggcccggcgcgacggcgacgctcatcaccttcgcgtccacggcgtccgccacccagcgcgcgttcctcgcgtcgctgccgccgtccgtcgcctcgctcccgctccctcccgtcgacgtctccgacctgccccatgatgccgccattgagacgctcatgtccgaggagtgcgcgcgctcactcccggcactcacgggcatcctctctgagctcagggagtccacccgcctcgtcgcgttcgacaggtccaacccctcgtacatggtgatggtgcacctcgccatgcgccaccgtgaagctgatgccatcctggtaaactccttcgacgccgtcgagcctgaggtcgccaaggtgctgcgccagccagagcccggccggcggcggccacctgtgtaccctatcggccctctaatagtgcagcagtccaatggcaccaccaccaacaccgttgccaacggcggcgtgcctccacactccctggccccgcgtgcggcttgcctggagtggctcgatcatcaacctgccaggtcggtcatcttcgtctcgttcggctccggcggcgcaatacccaaggaggagatgcacgagctcgcgcttggcctggagctcagccggcagcgcttcctctgggtggtgcgcagcccaagctacgagggcacactcagcgacaactactacgatgcggagagcaagaaggaccccttcaaggctgctgcagagggcctgcgtgaaggtggcgccgccaccatggcacttgatgaggtggtgcagaagtgggaagctgatgctgccaactag

SEQ ID NO: 18037 - protein, 296 aa, Sorghum bicolor
  misc_feature: Useful for making plants with altered carbohydrate content
  misc_feature: Functional homolog of the protein sequence given in SEQ ID NO 14172
  misc_feature: Ceres ANNOT ID no. 8691574
  misc_feature (154)..(264): SWISSPROT Homolog: EC 2.4.1.218 Hydroquinone glucosyltransferase
MKTGPPHVAMLATPGIGHVIPLAELAKRLASRPGATATLITFASTASATQRAFLASLPPSVASLPLPPVDVSDLPHDAAIETLMSEECARSLPALTGILSELRESTRLVAFDRSNPSYMVMVHLAMRHREADAILVNSFDAVEPEVAKVLRQPEPGRRRPPVYPIGPLIVQQSNGTTTNTVANGGVPPHSLAPRAACLEWLDHQPARSVIFVSFGSGGAIPKEEMHELALGLELSRQRFLWVVRSPSYEGTLSDNYYDAESKKDPFKAAAEGLREGGAATMALDEVVQKWEADAAN

SEQ ID NO: 18038 - DNA, 471 bp, Sorghum bicolor
  misc_feature: Ceres ANNOT ID no. 8691584
  misc_feature: Encodes the peptide sequence at SEQ ID NO 18039
atgtggcattcgtggccgacctcttcgatcagcgtggactccctcgatgccgcgggggtcccacggaggtgcgtcttcttccccaccaacctccatgtgctcacgctcctcctccacctcccagagctggacgtctccattccttgcgagttttgggacctcctcgagccgctgcacctgcacgggtgcgtgcccatcccgggtcctgacgacaagaccgacccctgctaccgctggatggtgcaccacgacaccaagtaccgagaggccaacgccatccttgtcaactccttcaactccgtcgagataggccttgcaaggatcttgagccagccggacaccatgggcagctggctcgcggtgtacctgatcagcgtgctcatccacaccgaggacaacaacaagggcacaccaccgctgtgcatggagtggttggaccggcagccgcctaggtcggcgatcttcgtctaa

SEQ ID NO: 18039 - protein, 156 aa, Sorghum bicolor
  misc_feature: Useful for making plants with altered carbohydrate content
  misc_feature: Functional homolog of the protein sequence given in SEQ ID NO 14172
  misc_feature: Ceres ANNOT ID no. 8691584
  misc_feature (44)..(156): SWISSPROT Homolog: EC 2.4.1.218 Hydroquinone glucosyltransferase
MWHSWPTSSISVDSLDAAGVPRRCVFFPTNLHVLTLLLHLPELDVSIPCEFWDLLEPLHLHGCVPIPGPDDKTDPCYRWMVHHDTKYREANAILVNSFNSVEIGLARILSQPDTMGSWLAVYLISVLIHTEDNNKGTPPLCMEWLDRQPPRSAIFV

SEQ ID NO: 18040 - DNA, 1443 bp, Sorghum bicolor
  misc_feature: Ceres ANNOT ID no. 8691573
  misc_feature: Encodes the peptide sequence at SEQ ID NO 18041
atgaaggccgggcctccgccgcacgttgccatgctggcgacgccggggatgggccacctcatcccgctggcggagctggcgaagcgcctggcgtcgcggcacggcgcgacggcgacgctcatcaccttcgcgtccacggcgtcggcgacgcagcgggcgctcctggcctcgctgccgcccgcggtgtcgtcgctctccctcccgcccgtcgacctctccgacctgccgtccgacgccgccatcgagacgctcatgtccgaggagtgcgcgcggtccctccccgcgctcacgcgcgtcctctcggagctcggggaggccaccaccgccaccggccgcctcgtcgcgttcgtcgccgaccagttcgggatcgactcgttcgacgccgcgcgcgacgccggcgtccggacgtgctacctcttcatacccatgaacctccacgcgctctcgctcgtcctcgacctcccggacctcgcggcgtccgtccccggcgagttccgggacctcgccgagccggtgcgcctgcccggctgcgtgcccatcccggggtccgacgttccctcgccgctccaggacaggtccaacccttcgttctcggtgatggtgcacctcgccaagcgctaccgtgaagctgacgccatcctcgtcaactccttcgacgccgtcgagcccgaggtcgcccaggtgcttcgccagccagagtccggccggccgcctgtgtaccctatcggtccactcatacggcagttcgtcggaagcgaaactgatggtccaccatcgtcaccgcgtgcggcgtgcctggagtggctcgaccggcagccggcgaggtcggtcatcttcgtctcgttcgggtccggcggcgcgctgccaaaggaggagatgcgcgagctcgcgctcgggctggagctcagcgggcagcggttcctctgggtggtgcgcagccccagcgacgagggcacgctcagcgacaactactacaacgcagagagcaagaaggaccccttcgtctacctcccggaagggttcctggagaggaccaaggacgtgggtctcgtggtgccgtcgtgggcaccgcagacgcaggtgcttgcacacagggccaccggaggtttcctgacgcactgcgggtggaactcgacgctagagagcctggtgcacggcgtgccgatggtggcctggccgttgttcgccgagcagaggcttaacgcggtgatgctggcagccgagggggtaggagcggcgatacggttgccggagaggaaggataaggagagcatcgcagcggtggtgagggagctgatggcaggggaagggaaaggtggcatggtgcgggtgaaggtggcggagctgcagaaggctgcggcagagggactccgtgagggtggcgccgccgcgacggcgcttgacgaggtggtggagaagtgggaagctgatgaagcgaactag

SEQ ID NO: 18041 - protein, 480 aa, Sorghum bicolor
  misc_feature: Useful for making plants with altered carbohydrate content
  misc_feature: Functional homolog of the protein sequence given in SEQ ID NO 14172
  misc_feature: Ceres ANNOT ID no. 8691573
  misc_feature (7)..(475): SWISSPROT Homolog: EC 2.4.1.218 Hydroquinone glucosyltransferase
  misc_feature (8)..(478): Pfam ID: UDPGT Pfam Description: UDP-glucoronosyl and UDP-glucosyl transferase
MKAGPPPHVAMLATPGMGHLIPLAELAKRLASRHGATATLITFASTASATQRALLASLPPAVSSLSLPPVDLSDLPSDAAIETLMSEECARSLPALTRVLSELGEATTATGRLVAFVADQFGIDSFDAARDAGVRTCYLFIPMNLHALSLVLDLPDLAASVPGEFRDLAEPVRLPGCVPIPGSDVPSPLQDRSNPSFSVMVHLAKRYREADAILVNSFDAVEPEVAQVLRQPESGRPPVYPIGPLIRQFVGSETDGPPSSPRAACLEWLDRQPARSVIFVSFGSGGALPKEEMRELALGLELSGQRFLWVVRSPSDEGTLSDNYYNAESKKDPFVYLPEGFLERTKDVGLVVPSWAPQTQVLAHRATGGFLTHCGWNSTLESLVHGVPMVAWPLFAEQRLNAVMLAAEGVGAAIRLPERKDKESIAAVVRELMAGEGKGGMVRVKVAELQKAAAEGLREGGAAATALDEVVEKWEADEAN

SEQ ID NO: 18042 - DNA, 960 bp, Sorghum bicolor
  misc_feature: Ceres ANNOT ID no. 8691669
  misc_feature: Encodes the peptide sequence at SEQ ID NO 18043
atggaacaacctcagttctgcaccgcctacgcgcatagtgatggccactatggcctacaatactacgacgacagcctcttgcagccctcctcagcgtacgacgatcctatcgcgtacactggtgagtctgcaggtgaccactacccttcttcctcgtcgacggcgtgggcatcgtcgtcaggcgccgccacaccctccatccaccaccaccaccaccaccaacagcagcagcagctacattttggcggcggccgcgttgatgaacactacagctaccaggaggatggcacgggcgtggtggacatggaacagatcagcgctctcatgggagcggcctgcatctccaccaacacaccagctgcatactcctcgtcggcgtcaacgacgacaacgacgacgacggcgacgatgcaacccagcgccgtccacgggccgagcccctgcggcttcggccaccagcagaaggcggcggccgacgcgccactgattggggtgcggaggcggccatggggcaggttcgcagcggagataagggactcgacgcgcaatggccagcgcgtgtggatcggcaccttcgacaccgcgcaggctgccgcgctcgcctacgaccaggccgcctactccatgcgcggctctgccgcggtgctcaacttccccgtcgagcacgtgctggagtcgctgcgcgcgctggggatccgcggtgacgccgccggcgagggggactcgccgccgctggcgctgaagcggcgccactgcatccgtaagcgcttgcacaggaacaagaaggcgaccggcggcaaggaacagaaggtggtggcgacgagtagccatggccatgatgggcatgctgtcaagctcaagccaaagcagcagggagctgcggcttcttgcgtgctggagctggaggaccttggggcggactacttggaggagctgctcgccacgtcagatcgtcaatga

SEQ ID NO: 18043 - protein, 319 aa, Sorghum bicolor
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: Ceres ANNOT ID no. 8691669
  misc_feature (160)..(212): Pfam ID: AP2 Pfam Description: AP2 domain
MEQPQFCTAYAHSDGHYGLQYYDDSLLQPSSAYDDPIAYTGESAGDHYPSSSSTAWASSSGAATPSIHHHHHHQQQQQLHFGGGRVDEHYSYQEDGTGVVDMEQISALMGAACISTNTPAAYSSSASTTTTTTTATMQPSAVHGPSPCGFGHQQKAAADAPLIGVRRRPWGRFAAEIRDSTRNGQRVWIGTFDTAQAAALAYDQAAYSMRGSAAVLNFPVEHVLESLRALGIRGDAAGEGDSPPLALKRRHCIRKRLHRNKKATGGKEQKVVATSSHGHDGHAVKLKPKQQGAAASCVLELEDLGADYLEELLATSDRQ

SEQ ID NO: 18044 - DNA, 2025 bp, Sorghum bicolor
  misc_feature: Ceres ANNOT ID no. 8691718
  misc_feature: Encodes the peptide sequence at SEQ ID NO 18045
atggtggcccttcttatcccttccctccaccactggcccggtgcagccaaggccgaggaggcggcacgggccaagggccaggagaggccggccggagacccagccctgtccaccaacaaggcctctctgcgcacagtgtggagcgaccaggatgaaccaagagatctaccaggcatgatagatgccatcaagggaactttgaagatcattgatgaagtcaaggtcagcgtttcagcttatgacacggcatgggtcgcccttgtgaagaaccaagcagagggaggcgatggcccccaattcccctcatccatcgattggattgctcagaatcagctggcagacggatcatggggtgacaaaacattcttcttgatccatgatcggatcatcaacaccctagcatgcatcattgcacttaaatcatggaacgttcatgacgacaagtacaataaaggtcgatcattcatctgtgaaaatctatggaggttaaacgaggatgacgaggactggatgctagttggcttcgagataaccctcctcacattgctagagaaggccaaggacttgggccatgacttgccatatgacgagcccgccttgcaagcgatatatgccaaaagagatctaaagcttgccaagatccctaaagatatactgtatgccgtcccgacgacattacttcttagtattgaaggaatgccgagcttggactggaaaaggctacttaggctgcagtgtgcagatggttcatttatgtcatcccctgctcccacagcgtatgctctcatggaaactggtgacgagaagtgccttgaattccttgatagagttgtcaaaaagttcaatggaggagtaccctttacctatcccctcgatatctttgagcggttatgggtagttgatcggttggagcgcctaggcatttcaaggcaatggactcgagagggcttaggttcgacccgggacttcgtgctcagtgacatcgatgacacagccatgggtcttcgtctcctccggttgcatggctaccatgtcaatccatgtgtattggagcatttcaagaaggacggcgagttcgtgtgctatccaatgcagtcgaagcagtctgtgacggcaatgtacaacctgtaccgtgcctctcaggtagcctttcccggggaaaaaatcctcgagcaggccagcgcctactgccgatccttcttggatgagaggcgagcctctggcaggctcgaccaagacaaatgggtgattgccaaggacctgcctggcgaggtcggctacagcctcgacttcccctggacagcaagcctgccacgcgtcgaaacaaggacgtatctagagcaatacggtggcagtcacgacgtgtggattgggaaggttctctacaggatgccactgttcagcaacgacgtcttcctcgaggcagcaaaacaagatttccggaattttcagaggctatgcaaactggagtggcatgcccttgccaaggaccaagtggagggtccgatgacagagacagacaaggtcctcttgcgtgcgattcgtgagctcatcgatctcgatgcttctcatggtcttcgtgaagtttgggtgcagtggctcaggtcatggagccatgacccggtggcagtcggaggaaacactgcgttgctgttagttcgtgccatggagtgttgttcaggaaggtacatcagtgtggccgacaggaacgtgaaccatctggatgagtactcccagctcgagcagctcacccattccatctgctgcaaactgacgtctagggttcttgctcagaatggagaagacaataacaaggaagctgctgatagtagcttggatcagcaggccgtggagctggagatgcaggagctggctcggtgtgttcttcagagctgcaaatccatcgacagagccgccaggcaggcatttctccatgtggccaagacctactactacgtcgctcattgctcaaatgaaacaattgacactcacatctccaaggttatatttgaggatgtcgtctag

SEQ ID NO: 18045 - protein, 674 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 14150
  misc_feature: Useful for making plants with modulated biotic stress sensitivity
  misc_feature: Functional homolog of the protein sequence given in SEQ ID NO 14595
  misc_feature: Ceres ANNOT ID no. 8691718
  misc_feature (49)..(505): SWISSPROT Homolog: EC 5.5.1.13 Ent-copalyl diphosphate synthase
  misc_feature (238)..(453): Pfam ID: Terpene_synth Pfam Description: Terpene synthase, N-terminal domain
MVALLIPSLHHWPGAAKAEEAARAKGQERPAGDPALSTNKASLRTVWSDQDEPRDLPGMIDAIKGTLKIIDEVKVSVSAYDTAWVALVKNQAEGGDGPQFPSSIDWIAQNQLADGSWGDKTFFLIHDRIINTLACIIALKSWNVHDDKYNKGRSFICENLWRLNEDDEDWMLVGFEITLLTLLEKAKDLGHDLPYDEPALQAIYAKRDLKLAKIPKDILYAVPTTLLLSIEGMPSLDWKRLLRLQCADGSFMSSPAPTAYALMETGDEKCLEFLDRVVKKFNGGVPFTYPLDIFERLWVVDRLERLGISRQWTREGLGSTRDFVLSDIDDTAMGLRLLRLHGYHVNPCVLEHFKKDGEFVCYPMQSKQSVTAMYNLYRASQVAFPGEKILEQASAYCRSFLDERRASGRLDQDKWVIAKDLPGEVGYSLDFPWTASLPRVETRTYLEQYGGSHDVWIGKVLYRMPLFSNDVFLEAAKQDFRNFQRLCKLEWHALAKDQVEGPMTETDKVLLRAIRELIDLDASHGLREVWVQWLRSWSHDPVAVGGNTALLLVRAMECCSGRYISVADRNVNHLDEYSQLEQLTHSICCKLTSRVLAQNGEDNNKEAADSSLDQQAVELEMQELARCVLQSCKSIDRAARQAFLHVAKTYYYVAHCSNETIDTHISKVIFEDVV

SEQ ID NO: 18046 - DNA, 186 bp, Sorghum bicolor
  misc_feature: Ceres ANNOT ID no. 8691766
  misc_feature: Encodes the peptide sequence at SEQ ID NO 18047
atgcggaggaagattttgcccaaaacgcaaagcaaggaagattcttctggtgctgatggtactaaagaggactatgttcatatccgggcaaagcgaggtcaagtcactaacagccacagcctgcttgcagaaagactgaggagaaagaagataattgagagaatgaagcttcttcaagataattaa

SEQ ID NO: 18047 - protein, 61 aa, Sorghum bicolor
  misc_feature: The sequence is a functional homolog of SEQ ID NO 1916 in the 11/479,226 US patent application
  misc_feature: Useful for making plants with altered alkaloid content
  misc_feature: Functional homolog of the protein sequence given in SEQ ID NO 14050
  misc_feature: Useful for making plants with altered lignin content
  misc_feature: Functional homolog of the protein sequence given in SEQ ID NO 13280
  misc_feature: The sequence is a functional homolog of SEQ ID NO 104 in the 11/375,241 US patent application
  misc_feature: The sequence is a functional homolog of SEQ ID NO 188 in the 10/225,066 US patent application
  misc_feature: The sequence is a functional homolog of SEQ ID NO 416 in the 10/374,780 US patent application
  misc_feature: The sequence is a functional homolog of SEQ ID NO 554 in the 11/435,388 US patent application
  misc_feature: The sequence is a functional homolog of SEQ ID NO 672 in the 11/435,388 US patent application
  misc_feature: The sequence is a functional homolog of SEQ ID NO 1106 in the 10/225,066 US patent application
  misc_feature: The sequence is a functional homolog of SEQ ID NO 220 in the 10/225,068 US patent application
  misc_feature: The sequence is a functional homolog of SEQ ID NO 2368 in the 10/374,780 US patent application
  misc_feature: The sequence is a functional homolog of SEQ ID NO 390 in the 10/412,699 US patent application
  misc_feature: The sequence is a functional homolog of SEQ ID NO 909 in the 11/479,226 US patent application
  misc_feature: The sequence is a functional homolog of SEQ ID NO 1211 in the 11/479,226 US patent application
  misc_feature: The sequence is a functional homolog of SEQ ID NO 546 in the 10/412,699 US patent application
  misc_feature: The sequence is a functional homolog of SEQ ID NO 188 in the 10/714,887 US patent application
  misc_feature: The sequence is a functional homolog of SEQ ID NO 188 in the 11/435,388 US patent application
  misc_feature: The sequence is a functional homolog of SEQ ID NO 190 in the 10/714,887 US patent application
  misc_feature: The sequence is a functional homolog of SEQ ID NO 190 in the 11/435,388 US patent application
  misc_feature: The sequence is a functional homolog of SEQ ID NO 186 in the 10/714,887 US patent application
  misc_feature: The sequence is a functional homolog of SEQ ID NO 186 in the 11/435,388 US patent application
  misc_feature: The sequence is a functional homolog of SEQ ID NO 192 in the 10/714,887 US patent application
  misc_feature: The sequence is a functional homolog of SEQ ID NO 192 in the 11/435,388 US patent application
  misc_feature: The sequence is a functional homolog of SEQ ID NO 182 in the 10/714,887 US patent application
  misc_feature: The sequence is a functional homolog of SEQ ID NO 182 in the 11/435,388 US patent application
  misc_feature: The sequence is a functional homolog of SEQ ID NO 184 in the 10/714,887 US patent application
  misc_feature: The sequence is a functional homolog of SEQ ID NO 184 in the 11/435,388 US patent application
  misc_feature: The sequence is a functional homolog of SEQ ID NO 180 in the 10/714,887 US patent application
  misc_feature: The sequence is a functional homolog of SEQ ID NO 180 in the 11/435,388 US patent application
  misc_feature: The sequence is a functional homolog of SEQ ID NO 1258 in the 10/412,699 US patent application
  misc_feature: The sequence is a functional homolog of SEQ ID NO 172 in the 10/714,887 US patent application
  misc_feature: The sequence is a functional homolog of SEQ ID NO 172 in the 11/435,388 US patent application
  misc_feature: Ceres ANNOT ID no. 8691766
MRRKILPKTQSKEDSSGADGTKEDYVHIRAKRGQVTNSHSLLAERLRRKKIIERMKLLQDN

SEQ ID NO: 18048 - DNA, 1926 bp, Sorghum bicolor
  misc_feature: Ceres ANNOT ID no. 8691889
  misc_feature: Encodes the peptide sequence at SEQ ID NO 18049
atgaaggttctgtattttctgcaggtatttgcattatatgtcactggatcactcaatactgttttatcaacacaacatcgatacgagatttgtcgctatatttacaaccatcagaatgaagatggtggttggggaatgcaagagttaggaccaagcaccatgtttagctcatgcttaaactatgttacgttaagacttcttggggaggtgtgtacacatgacgctttaatcaaaggacgagcatggattttgtctcatggaagtgcagcagcaatacctcaatggggaaagatttggctctcggtgatcggtttatatgactggaacgggaataattcgatcattcctgagttgtggcttgttccatactctcttccatttcatccaggacgattctggtgcttctgcaggttgatatatatgccaatggcttatttatatggcaagaagtttgttgggccaattacaccaaccatattgtcaataagagacgaaatctataaaatatcatacgatgagatcgactggaacaaagctcgagatacatgtgctaaggaagaccttctctacccaaggtcattcgtgcaaaacgttatttggacttctgtgaataaaattgtggaaccattgctgaatttctggccagctaagatgttaagagatacggcattgaaaaaaatcatgaaacatatccattatgaagatgaaagtactaggtacctttgtatatgcccagtaaacaaggcactaaatatgatttgttgttgggtcgaaaatccaaattcggatgcattcaagcaacaccttccaaggatctatgattatttatggcttgctgaagatggcatgaagttaaaggtgtatgacggcacgcaagcatgggatacagctttcattgtcaaaggatattgctcgactgacctggttcatgagttttctccaacactccggaaagctcacgagttcataaaaagtttgcagatccctgaaaatcaaccagaccatgaaaattattaccgccatagatcaaaaggttcatgggctcattcaacaatagacaatggatggtctgtatctgattctacagcagaagcaattcaggcattgttaatgttatcgaagatctcttccaatcttgtgggggatcccataaaggaagaaagattatatgatgctgtggattgcttgctttcttttatgaacaaagatggcaccttttcaacatacgagtgtaagagaactgcatctttgttggaggttctcaacccttctgagactttcctgaacattgttgttgatcacccatctgttgaatgcacatcatcagcaactcaagctcttgttatgtttagagagttgtatccagggtaccgtgatgaagagataaaaaattgtattaaaggagcatccaaatttatcgagagcaaacaacgaaaggatggcacatggtttggcacttggggtgtatgtttcacttatgggacattatttgcagtgcaaggattagttgctgccggaagaacttatgaaaatagttcttccattaggaaagcatgcagctttctattgtcaaagcagctaagtacaggtggatggggtgagacttacccttctaatgaaactgaggtctatgcagaggccactagtcctcatgcagtgaatactgcttgggcaatgttggctttaatttacgctggacaggttaagcgagatccaacaccactgtatggtgctgcaaaagaactgatcaatatgcaacaagagtcaggcgagtttccccaacaacaacacattgggagcttcaattgttccttttacttcaactatggaaactaccgtaacttgttcccaatttgggctcttggagagtttcggagacgaattgttgcagcaaaagaagaggaaccaacaagcatgatgttttag

SEQ ID NO: 18049 - protein, 641 aa, Sorghum bicolor
  misc_feature: The sequence is a functional homolog of SEQ ID NO 15 in US patent 7186884
  misc_feature: The sequence is a functional homolog of SEQ ID NO 6 in US patent 7122717
  misc_feature: The sequence is a functional homolog of SEQ ID NO 4 in US patent 7135624
  misc_feature: Ceres ANNOT ID no. 8691889
  misc_feature (9)..(634): SWISSPROT Homolog: EC 5.4.99.8 Cycloartenol synthase
  misc_feature (25)..(68): Pfam ID: Prenyltrans Pfam Description: Prenyltransferase and squalene oxidase repeat
  misc_feature (464)..(506): Pfam ID: Prenyltrans Pfam Description: Prenyltransferase and squalene oxidase repeat
  misc_feature (513)..(566): Pfam ID: Prenyltrans Pfam Description: Prenyltransferase and squalene oxidase repeat
MKVLYFLQVFALYVTGSLNTVLSTQHRYEICRYIYNHQNEDGGWGMQELGPSTMFSSCLNYVTLRLLGEVCTHDALIKGRAWILSHGSAAAIPQWGKIWLSVIGLYDWNGNNSIIPELWLVPYSLPFHPGRFWCFCRLIYMPMAYLYGKKFVGPITPTILSIRDEIYKISYDEIDWNKARDTCAKEDLLYPRSFVQNVIWTSVNKIVEPLLNFWPAKMLRDTALKKIMKHIHYEDESTRYLCICPVNKALNMICCWVENPNSDAFKQHLPRIYDYLWLAEDGMKLKVYDGTQAWDTAFIVKGYCSTDLVHEFSPTLRKAHEFIKSLQIPENQPDHENYYRHRSKGSWAHSTIDNGWSVSDSTAEAIQALLMLSKISSNLVGDPIKEERLYDAVDCLLSFMNKDGTFSTYECKRTASLLEVLNPSETFLNIVVDHPSVECTSSATQALVMFRELYPGYRDEEIKNCIKGASKFIESKQRKDGTWFGTWGVCFTYGTLFAVQGLVAAGRTYENSSSIRKACSFLLSKQLSTGGWGETYPSNETEVYAEATSPHAVNTAWAMLALIYAGQVKRDPTPLYGAAKELINMQQESGEFPQQQHIGSFNCSFYFNYGNYRNLFPIWALGEFRRRIVAAKEEEPTSMMF

SEQ ID NO: 18050 - DNA, 444 bp, Sorghum bicolor
  misc_feature: Ceres ANNOT ID no. 8691887
  misc_feature: Encodes the peptide sequence at SEQ ID NO 18051
atgtggaggctgaggattggcgagggcagcggtccatggctgcggtcagcgaataacttcatcggcaggcaggtatgggagtttgaccccgacgctgggagccaggatgagctcgctgagattgagagactgaggaaggagttcacagagaaccgtttccagaagagggtgtcacaggatctccttctgcgcatgcagtatgcaaaacaaaacgatcttcaagtggatgttccagtcatcaaacttgcacatagtgcagaagtcacggaagagactatactagcatcattgaggcgagcccttgcccaatattctactctacaagcacatgatggtcactggccttgtgattatagtggtgtcatgttcattatgcctattctggatccaactgactggttgatcacaagcctaaaacttctcctgaggagtgtggggaaatag

SEQ ID NO: 18051 - protein, 147 aa, Sorghum bicolor
  misc_feature: The sequence is a functional homolog of SEQ ID NO 15 in US patent 7186884
  misc_feature: The sequence is a functional homolog of SEQ ID NO 6 in US patent 7122717
  misc_feature: Ceres ANNOT ID no. 8691887
  misc_feature (1)..(126): SWISSPROT Homolog: EC 5.4.99.8 Cycloartenol synthase
MWRLRIGEGSGPWLRSANNFIGRQVWEFDPDAGSQDELAEIERLRKEFTENRFQKRVSQDLLLRMQYAKQNDLQVDVPVIKLAHSAEVTEETILASLRRALAQYSTLQAHDGHWPCDYSGVMFIMPILDPTDWLITSLKLLLRSVGK

SEQ ID NO: 18052 - DNA, 1389 bp, Sorghum bicolor
  misc_feature: Ceres ANNOT ID no. 8692019
  misc_feature: Encodes the peptide sequence at SEQ ID NO 18053
atgggtcacctgatcccgctagcggagctagcgaagcggctggcgtcgcggcacggagccacggcgacgctcatcacgttcgcgtccacggcgtcggcgacgcagcgcgcgttcctggcgtcgctcccgcccgcggtgacctcgctctcgctcccgcccgtcgacctctccgacctgccccgcggcgccgccatcgagacgctcatgtccgaggagtgcgcgcgctctgtcccggcgctcacgtccatcctcctcgacctcaagcggaccacggggggccgcctggcggcgttcgtggcggacctgttcggcgccgactccctggacgcggcgcgcgcggccggggtgcgacggcggtgcatcttcttccccaccaacctccacgcgctcacgctcatgctccacctccccgagctcgacgcctcggtgtcgtgcgagttccgggacctcccggagccgctgcggctccccgggtgcgtgcctatcccgggtcccgacatcctgatgccgctgcaggacaaggccaacccgtgctaccgctggatggtgcaccacggcggcaagtaccgggacgccgacgccatcctcgtcaactccttcgacgccgtcgagccgggccccgccaagatcctgcgccagccggcagcggaccaccgccccgtcgtgtacccgatcggcccgctcatccacgccgacggacgcaaggacgagaaggacgcgctgtgcctggagtggctggaccggcagccggcgaggtcggtgatgttcgtgtcgtttggttccggcggcgcgctgccgacggaggagatgcgggagctggcgctggggctggagctcagcgggcagcggttcctgtgggtggtgcggagccccagcgacgagggcgccgtcaacgacaactactacgacgccgagagcaagaaggaccccttcgcctacctcccggagggattcgtggaccgcgtcaccgccaccggcgtggggctggtcgtcccgtcctgggcgccgcagaccaaggtgctggcgcacgccgccacgggcgggttcctcacccactgcggctggaactccgtgctcgagagcctcgtctacggcgtgcccatggtggcgtggccgctcttcgccgagcagcggcagaacgccgtgatgctctccgacggcgtcggcgccgcgctccgggtacccgagtcgtccaaggggagggaggagatcgcggccacggtgcgggaggtgatgcagggggaagggaagggcgccgcggtcagggcgaaggtggccgagctgcagaaggccgccgctgagggcctccgcgacggcggcgccgccgccaccgcgctggccgaggtggtggaggggtggacgacgacaggtggacaagaggaggactag

SEQ ID NO: 18053 - protein, 462 aa, Sorghum bicolor
  misc_feature: Useful for making plants with altered carbohydrate content
  misc_feature: Functional homolog of the protein sequence given in SEQ ID NO 14172
  misc_feature: Ceres ANNOT ID no. 8692019
  misc_feature (1)..(453): SWISSPROT Homolog: EC 2.4.1.218 Hydroquinone glucosyltransferase
  misc_feature (1)..(457): Pfam ID: UDPGT Pfam Description: UDP-glucoronosyl and UDP-glucosyl transferase
MGHLIPLAELAKRLASRHGATATLITFASTASATQRAFLASLPPAVTSLSLPPVDLSDLPRGAAIETLMSEECARSVPALTSILLDLKRTTGGRLAAFVADLFGADSLDAARAAGVRRRCIFFPTNLHALTLMLHLPELDASVSCEFRDLPEPLRLPGCVPIPGPDILMPLQDKANPCYRWMVHHGGKYRDADAILVNSFDAVEPGPAKILRQPAADHRPVVYPIGPLIHADGRKDEKDALCLEWLDRQPARSVMFVSFGSGGALPTEEMRELALGLELSGQRFLWVVRSPSDEGAVNDNYYDAESKKDPFAYLPEGFVDRVTATGVGLVVPSWAPQTKVLAHAATGGFLTHCGWNSVLESLVYGVPMVAWPLFAEQRQNAVMLSDGVGAALRVPESSKGREEIAATVREVMQGEGKGAAVRAKVAELQKAAAEGLRDGGAAATALAEVVEGWTTTGGQEED

SEQ ID NO: 18054 - DNA, 1494 bp, Sorghum bicolor
  misc_feature: Ceres ANNOT ID no. 8692015
  misc_feature: Encodes the peptide sequence at SEQ ID NO 18055
atggagaacggcaccagcaacggctccaccggcggcgccgcctgctgcaacggcaacggcgccgtccgcgggccgcacgtggcgatgctggcgacgccggggatgggtcacctgatcccgctagcggagctggcgaagcggctggcgtcgcggcacggcgccacggcgacgctcatcacgttcgcgtccacggcgtcggcgacgcagcgcgcgttcctggcgtcgctcccgcccgcggtgacctcgctctcgctcccgcccgtcgacctctccgacctgccccgcggcgccgccatcgagacgctcatgtccgaggagtgcgcgcgctctgtcccggcgctcacgtccatcctcctcgacctcaagcggaccacggggggccgcctggcggcgttcgtggcggacctgttcggcgccgactccctggacgcggcgcgcgcggccggggtgcggcggcggtgcatcttcttccccaccaacctccacgcgctcacgctcatgctccacctccccgagctcgacgcctcggtgtcgtgcgagttccgggacctcccggagccgctgcggctccccgggtgcgtgcctatcccggggcccgacatcctgatgccgctgcaggacaaggccaacccgtgctaccgctggatggtgcaccacggcggcaagtaccgggacgccgacgccatcctcgtcaactccttcgacgccgtcgagccgggccccgccaagatcctgcgccagccggcggcggaccaccgccccgtggtgtacccgatcggcccgctcatccacgccgacggacgggaggacgacaaggacgcgctgtgcctggagtggctggaccggcagccggcgaggtcggtgatgttcgtgtcgtttggttccggcggcgcgctgccgacggaggagatgcgggagctggcgctggggctggagctcagcgggcagcggttcctgtgggtggtgcggagccccagcgacgagggcgccgtcaacgacaactactacgacgccgagagcaagaaggaccccttcgcctacctcccggagggattcgtggaccgcgtcaccgccaccggcgtggggctggtcgtcccgtcctgggcgccgcagaccaaggtgctggcgcacgccgccacgggcgggttcctcacccactgcggctggaactccgtgctcgagagcctcgtctacggcgtgcccatggtggcgtggccgctcttcgccgagcagcggcagaacgccgtgatgctctccgacggcgtcggcgccgcgctccgagtgcccgagtcgtccaaggggagggaggagatcgcggccacggtgcgggaggtgatgcagggggaagggaagggcgccgcggtcagggcgaaggtggccgagctgcagaaggccgccgctgagggcctccgcgacgggggcgccgccgccaccgcgctggccgaggtggtggaagggtggacgacgacaggtggacaagaggaggaggactag

SEQ ID NO: 18055 - protein, 497 aa, Sorghum bicolor
  misc_feature: Useful for making plants with altered carbohydrate content
  misc_feature: Functional homolog of the protein sequence given in SEQ ID NO 14172
  misc_feature: Ceres ANNOT ID no. 8692015
  misc_feature (25)..(481): SWISSPROT Homolog: EC 2.4.1.218 Hydroquinone glucosyltransferase
  misc_feature (26)..(491): Pfam ID: UDPGT Pfam Description: UDP-glucoronosyl and UDP-glucosyl transferase
MENGTSNGSTGGAACCNGNGAVRGPHVAMLATPGMGHLIPLAELAKRLASRHGATATLITFASTASATQRAFLASLPPAVTSLSLPPVDLSDLPRGAAIETLMSEECARSVPALTSILLDLKRTTGGRLAAFVADLFGADSLDAARAAGVRRRCIFFPTNLHALTLMLHLPELDASVSCEFRDLPEPLRLPGCVPIPGPDILMPLQDKANPCYRWMVHHGGKYRDADAILVNSFDAVEPGPAKILRQPAADHRPVVYPIGPLIHADGREDDKDALCLEWLDRQPARSVMFVSFGSGGALPTEEMRELALGLELSGQRFLWVVRSPSDEGAVNDNYYDAESKKDPFAYLPEGFVDRVTATGVGLVVPSWAPQTKVLAHAATGGFLTHCGWNSVLESLVYGVPMVAWPLFAEQRQNAVMLSDGVGAALRVPESSKGREEIAATVREVMQGEGKGAAVRAKVAELQKAAAEGLRDGGAAATALAEVVEGWTTTGGQEEED

SEQ ID NO: 18056 - DNA, 2052 bp, Sorghum bicolor
  misc_feature: Ceres ANNOT ID no. 8692090
  misc_feature: Encodes the peptide sequence at SEQ ID NO 18057
atgcgcggcggccatgccatggcggcggggtacgcggttgccggcctgctgctgatcgccctcacgctgccgctcacggcggctataccatggccggcgtgcggcaacagcagcaccgggaactacaccaccaacagcgcctacggcaggaacctccgccaggtcgccgcatccttgccaggcaacgtctcctcatcagccactctcttcgccacggccgtcaccgggacggcaccgagcacggtgtacgccctcgggcaatgcggcggcgaccagagcgccgccgcgtgccgcgactgcatcgcggcgagcttcgagcaggcttacaagatgtgccccggcggcaacaagcgcgtggccatcttctacgacacgtgcctcctcggcttctccgaccaggacttcctcgcctccaccaccaactccgacgaccagtcggtgttcctcgagaacggcctcaacgtcacctccgactccgacgacgtcgcccaccagttcaacgcgacagcctacgagcttctcggcaccatggccgcctacattggcgccaccatggacgaaggcggcaactcgtccaacaagttgaagttcctcaccggatccattgccttcgacgcggcctacccgttgatctacggtttgacgtcctgcaacccggacatgacgcccgggcagtgccgcggatgccttgacgcgtcgatcgccgagatgccacagaaattctaccccaacaccaagggcgctaggatcgcggggctccggtgcgtcgcgcggtatgaggtgtaccggttcttcaatggttccatcatgctgcagctgccactacctccaccaggcaaccaggatggcaataagagtaatcatactggcatgattgttgcaatcgtaataccttcagttgtggctatagctgcaagcatggcgatgtgccttttttgctggaggaggagaacaaaaagtaaaaggtcacgttcatttggatctcacatggaaagcattgaaagtattgaatcacttcttatagacctgccaacactacggttggccactaataactttgctgagaataataagcttggtgaaggaggatttggatcagtctacaagggaacacttcctagtagtcaagaaatagcggtgaaaaggctctctcatagttctcgtcagggaattggagaactgaagaatgagctagtgttaattgccaagctccaacacaaaaatctcgtaaggcttgttggtgtttgcttgcaagaggacgagaagcttctggtttatgagtacctaccaaacagaagtctggatacctttcttttcgattcagagaggcggaaagggctaggatggggcacaaggtttaccataataaatggagttgctcgagggttgcaatatctacatgaagattcgcagttgaagatagtccaccgagatctgaaagccagcaacgttcttttggatgcggatatgaaccctaagatttccgactttggcttggcaaggctttttgaaggggatcagtcacaagagactaccaaacgagttgttgggacatatggatacatggcaccagaatatgctctacgtgggcaatactctataaagtcagacatatatagctttggcgtgttgattttggagattatcacgggaaggagaaacagtgactcgtacagttctgacgaagctgttgacctaccaagtcttgtgtgggaacactggagaatgaaatcaatcatggagataattgacccttacttgaggagcgcttcctctgaggacgagatagtgaggtgcatccatattggactgttgtgtgtccaggaagacccacttgacaggccaactatatcttctatcagcatcatgttcgacggcaacacggtcccctcccaagctccagcccggccagcattctatgtagaaatgagcggtttcattggatcagggacatactcccaccaatacccagggtttattaatgactctactcaaaggtcgacagtaatgtcaccgaatgagctatcgataacagatcctgaaccaagataa

SEQ ID NO: 18057 - protein, 683 aa, Sorghum bicolor
  misc_feature: Useful for making plants with altered carbohydrate content
  misc_feature: Functional homolog of the protein sequence given in SEQ ID NO 14360
  misc_feature: Useful for making plants with modulated biomass
  misc_feature: Functional homolog of the protein sequence given in SEQ ID NO 14141
  misc_feature: Useful for making plants with altered cell wall content and/or composition
  misc_feature: Functional homolog of the protein sequence given in SEQ ID NO 14596
  misc_feature: Ceres ANNOT ID no. 8692090
  misc_feature (346)..(620): SWISSPROT Homolog: EC 2.7.11.1 Non-specific serine/threonine protein kinase
  misc_feature (353)..(624): Pfam ID: Pkinase Pfam Description: Protein kinase domain
MRGGHAMAAGYAVAGLLLIALTLPLTAAIPWPACGNSSTGNYTTNSAYGRNLRQVAASLPGNVSSSATLFATAVTGTAPSTVYALGQCGGDQSAAACRDCIAASFEQAYKMCPGGNKRVAIFYDTCLLGFSDQDFLASTTNSDDQSVFLENGLNVTSDSDDVAHQFNATAYELLGTMAAYIGATMDEGGNSSNKLKFLTGSIAFDAAYPLIYGLTSCNPDMTPGQCRGCLDASIAEMPQKFYPNTKGARIAGLRCVARYEVYRFFNGSIMLQLPLPPPGNQDGNKSNHTGMIVAIVIPSVVAIAASMAMCLFCWRRRTKSKRSRSFGSHMESIESIESLLIDLPTLRLATNNFAENNKLGEGGFGSVYKGTLPSSQEIAVKRLSHSSRQGIGELKNELVLIAKLQHKNLVRLVGVCLQEDEKLLVYEYLPNRSLDTFLFDSERRKGLGWGTRFTIINGVARGLQYLHEDSQLKIVHRDLKASNVLLDADMNPKISDFGLARLFEGDQSQETTKRVVGTYGYMAPEYALRGQYSIKSDIYSFGVLILEIITGRRNSDSYSSDEAVDLPSLVWEHWRMKSIMEIIDPYLRSASSEDEIVRCIHIGLLCVQEDPLDRPTISSISIMFDGNTVPSQAPARPAFYVEMSGFIGSGTYSHQYPGFINDSTQRSTVMSPNELSITDPEPR

SEQ ID NO: 18058 - DNA, 1830 bp, Sorghum bicolor
  misc_feature: Ceres ANNOT ID no. 8692108
  misc_feature: Encodes the peptide sequence at SEQ ID NO 18059
atggcgaacaaggccagctcgggggcgcggagcccgctgagcctggtggtggccatggcgctgtgctgcttcttctacgtgctcggcgcgtggcagcgcagcggctacggcaagggcgaccgcatcgccgccgcggtgaccaggcagacggcctgcggcgacgggtccgccgccgtcgccgcggagcacagcttcgagacgcaccacggcggcgcggcgggcatcaacgcgtcgacgtcgctgcccttcagcgccgacgcgccgccgccgacgttcccgccgtgcgcggcggcgctggcggaccacacgccgtgccacgaccaggaccgcgccatgaagttcccccgcaagaacatggtgtaccgggagcggcactgccccgccgacggcgaccggctgcggtgcctggtgccggcgccgcccgggtacgtgacgccgttcccgtggccccggagccgcgactacgtgcccttcgccaacgcgccgtacaagagcctcaccgtcgagaaggccgtccagaactgggtccagtacgagggcgccgtgttccggttccccggcggcggcacccagttcccgcagggcgccgacaagtacatcgaccagctcggctccatcgtccccttcgccggcggccacgtccgcaccgtcctcgacaccggatgcggcgtggcgagcctgggcgcgtacctggacgcccgcggcgtgatcgccatgtcgttcgcgccgcgcgactcgcacgaggcgcaggttcagttcgcgctggagcgcggcgtgccggccttcatcggcgtcctcggctccgtcaagctcccgttcccgccgcgctccttcgacatggcgcactgctcccggtgcctcatcccttggggcggcaacgacgggatgtacatgatggagatcgaccgcgtgctccggccaggcggctactgggtgctctccggcccgccgatcaactggaagacgaaccacaaggcctgggagcgcacggaggcggacctctccgccgagcagcagcggatcgaggagtacgccgccatgctctgctgggagaaggtcaccgaggtccgcgagatcggcatctggcggaagcagctcgacccctcggcggcggggtgcccggcgaggccgccggtccggacgtgccacgacgccaaccccgacgacgtctggtacaagaacatggagacctgcgtcacgccgccggctacttctggcgccggcgagctgcagccattcccagcgcggctaacggccgtgccaccgcggatatctgccggtgccgtgccgggcttcacgacggagtcgtacgaggaggagaaccggcggtgggagcggcatgtggcggcgtacaagaaggtgaactataagctcaacagcgagcggtaccggaacatcatggacatgaacgccggagttgcggccgagctgtccaccctcggcgtggtgtacgagagggggctcatcggcatgtaccacgactggtgtgaggcattctcaacttacccaagaacatatgaccttatacatgccaatggcatcttcacgctctacaaggacaggtgcaaaatggaggacatcctgctggaaatggatcgaattctgcgcccggaggggaccgtgattcttcgagaccacgtcgatatcctgctgaaggtacagaggacagtgaaggggatgcggtggaagacgctgttagcaaaccatgaggacagcctgaacatacctgagaaggtcctctttgctgtcaagctgtattggacagccggcgagggctcagaggagaagaagaagacagatagctcttcagtagcaggcaaggattcatag

SEQ ID NO: 18059 - protein, 609 aa, Sorghum bicolor
  misc_feature: Useful for making plants with altered cell wall content and/or composition
  misc_feature: Functional homolog of the protein sequence given in SEQ ID NO 13686
  misc_feature: Ceres ANNOT ID no. 8692108
  misc_feature (218)..(313): Pfam ID: Methyltransf_11 Pfam Description: Methyltransferase domain
MANKASSGARSPLSLVVAMALCCFFYVLGAWQRSGYGKGDRIAAAVTRQTACGDGSAAVAAEHSFETHHGGAAGINASTSLPFSADAPPPTFPPCAAALADHTPCHDQDRAMKFPRKNMVYRERHCPADGDRLRCLVPAPPGYVTPFPWPRSRDYVPFANAPYKSLTVEKAVQNWVQYEGAVFRFPGGGTQFPQGADKYIDQLGSIVPFAGGHVRTVLDTGCGVASLGAYLDARGVIAMSFAPRDSHEAQVQFALERGVPAFIGVLGSVKLPFPPRSFDMAHCSRCLIPWGGNDGMYMMEIDRVLRPGGYWVLSGPPINWKTNHKAWERTEADLSAEQQRIEEYAAMLCWEKVTEVREIGIWRKQLDPSAAGCPARPPVRTCHDANPDDVWYKNMETCVTPPATSGAGELQPFPARLTAVPPRISAGAVPGFTTESYEEENRRWERHVAAYKKVNYKLNSERYRNIMDMNAGVAAELSTLGVVYERGLIGMYHDWCEAFSTYPRTYDLIHANGIFTLYKDRCKMEDILLEMDRILRPEGTVILRDHVDILLKVQRTVKGMRWKTLLANHEDSLNIPEKVLFAVKLYWTAGEGSEEKKKTDSSSVAGKDS

SEQ ID NO: 18060 - DNA, 756 bp, Sorghum bicolor
  misc_feature: Ceres ANNOT ID no. 8692244
  misc_feature: Encodes the peptide sequence at SEQ ID NO 18061
atggaggagcgggagaagctcgtgtgcctggccaagctcgccgagcaggcggagcgatacgacgatatggtggaattcatgaagaatcttgctaggatggatgtggacatgagtgctgaagaaaggcatttgttctcagttggtttcaagaacactatcggggcaaagagagcatcgtggagaatcatttgttcacatgagcaaaaggtcacaactgatcgtcagactggtgtgatgatagatgcctataagaagatagtagaagatgaactaaggaaggtttgcaatgaagtattgtcagtcatcgctattcactgccttcccttggccaatacgagtgaaaatgtcgtattcttttataagatgaaaggtgactactaccgatacttggctgaatttagcagtggaactgaaaagaaagctgcctctgaccagtcacttatggcctatcagcatgccatggttgtcgcctccagtgagctctcacctgcccaccagatccggcttggtcttgctctcaatttgtcggtcttcttttatgagataatgaactctcatgagagagcttgccaagtggcaaaacaagcattcaatgaggctcttactgagataaattctggtgaaggggtttacaaggatagcacacttatgatgcagcttctgaaggacaacttagcattgtggacatcagaactaaccggaggtgaagcatccaaggataatgatgtcgacatggaggaccctgatgggctgtag

SEQ ID NO: 18061 - protein, 251 aa, Sorghum bicolor
  misc_feature: The sequence is a functional homolog of SEQ ID NO 793 in the 11/479,226 US patent application
  misc_feature: The sequence is a functional homolog of SEQ ID NO 2350 in the 10/374,780 US patent application
  misc_feature: The sequence is a functional homolog of SEQ ID NO 344 in the 10/412,699 US patent application
  misc_feature: The sequence is a functional homolog of SEQ ID NO 790 in the 10/225,066 US patent application
  misc_feature: The sequence is a functional homolog of SEQ ID NO 805 in the 11/479,226 US patent application
  misc_feature: The sequence is a functional homolog of SEQ ID NO 789 in the 11/479,226 US patent application
  misc_feature: The sequence is a functional homolog of SEQ ID NO 786 in the 11/479,226 US patent application
  misc_feature: The sequence is a functional homolog of SEQ ID NO 801 in the 11/479,226 US patent application
  misc_feature: Useful for making plants with modulated drought sensitivity
  misc_feature: Functional homolog of the protein sequence given in SEQ ID NO 13373
  misc_feature: Useful for making plants with modulated water use efficiency
  misc_feature: Functional homolog of the protein sequence given in SEQ ID NO 13942
  misc_feature: The sequence is a functional homolog of SEQ ID NO 342 in the 10/412,699 US patent application
  misc_feature: The sequence is a functional homolog of SEQ ID NO 782 in the 11/479,226 US patent application
  misc_feature: The sequence is a functional homolog of SEQ ID NO 797 in the 11/479,226 US patent application
  misc_feature: Ceres ANNOT ID no. 8692244
  misc_feature (4)..(236): Pfam ID: 14-3-3 Pfam Description: 14-3-3 protein
MEEREKLVCLAKLAEQAERYDDMVEFMKNLARMDVDMSAEERHLFSVGFKNTIGAKRASWRIICSHEQKVTTDRQTGVMIDAYKKIVEDELRKVCNEVLSVIAIHCLPLANTSENVVFFYKMKGDYYRYLAEFSSGTEKKAASDQSLMAYQHAMVVASSELSPAHQIRLGLALNLSVFFYEIMNSHERACQVAKQAFNEALTEINSGEGVYKDSTLMMQLLKDNLALWTSELTGGEASKDNDVDMEDPDGL

SEQ ID NO: 18062 - DNA, 804 bp, Sorghum bicolor
  misc_feature: Ceres ANNOT ID no. 8692301
  misc_feature: Encodes the peptide sequence at SEQ ID NO 18063
atggcggccaagatattttccctcattatgctccttgctctttttgcaagtgctgctaccgcgacctatatcccgcaaccgcactgctcacaaatttctatagctgcccctcatcccgcatacctcccaccagtgtgcgcaaacccaatgctacaaccctatgggctccaacaggcaatcgcagcaagcatcttacagtcatcacccttgttcatccaacaaccatcggccctattgcagcagttgtccttggtgaatttgttggcacaaagcatcagggcacaacaactgcagcaactggtgctaccttcgatcaaccaagtaacgttggcaaaccttgctgcgtactcccagcaacagcagtttattccattcagccaactggctgcagtgaaccccgctgcctatttgcagctgcaacaactacaacaattcagccagctagctgctgcgagccctgccgccttctggccacaacaacagctgctgccgttctacccgcagggtgtggctaacgccgccaccctcttacaactacaacagttgctcccattcaaccaactagctgcagtgaaccctgctgcctatttgcagctacaactactactacaattcagccagctaggtgctgtgagtcctgccaccttctggccacaacaacagctgctgccgttctacccgcagggtgtggctaatgccgccaccctctttcaacaacaacagttgttgccattcatccagcttgctctggcgaacccagcaacgtcctgccaacaacccttcattggtggtgccctcttttag

SEQ ID NO: 18063 - protein, 267 aa, Sorghum bicolor
  misc_feature: Useful for making plants with modulated nitrogen use efficiency
  misc_feature: Functional homolog of the protein sequence given in SEQ ID NO 13286
  misc_feature: Ceres ANNOT ID no. 8692301
  misc_feature (1)..(267): Pfam ID: Zein Pfam Description: Zein seed storage protein
MAAKIFSLIMLLALFASAATATYIPQPHCSQISIAAPHPAYLPPVCANPMLQPYGLQQAIAASILQSSPLFIQQPSALLQQLSLVNLLAQSIRAQQLQQLVLPSINQVTLANLAAYSQQQQFIPFSQLAAVNPAAYLQLQQLQQFSQLAAASPAAFWPQQQLLPFYPQGVANAATLLQLQQLLPFNQLAAVNPAAYLQLQLLLQFSQLGAVSPATFWPQQQLLPFYPQGVANAATLFQQQQLLPFIQLALANPATSCQQPFIGGALF

SEQ ID NO: 18064 - DNA, 237 bp, Sorghum bicolor
  misc_feature: Ceres ANNOT ID no. 8692311
  misc_feature: Encodes the peptide sequence at SEQ ID NO 18065
atgaagtacagaaacattaagtacatgagatgcaatccagaaaatggatcccccccctcatctgtcaactatgcatcgaagactcgaacagatattattttcttttgttcacctaataatcctgctggtggagctgcatttcaggaccagctaaccaaattagtcaaatttgcaaaggacaataggtctgtcatagtctacgattcagctaatgcaatgcatgtacatatcagatga

SEQ ID NO: 18065 - protein, 78 aa, Sorghum bicolor
  misc_feature: Useful for making plants with modulated nitrogen use efficiency
  misc_feature: Functional homolog of the protein sequence given in SEQ ID NO 13353
  misc_feature: Ceres ANNOT ID no. 8692311
  misc_feature (2)..(75): SWISSPROT Homolog: EC 2.6.1.83 LL-diaminopimelate aminotransferase
MKYRNIKYMRCNPENGSPPSSVNYASKTRTDIIFFCSPNNPAGGAAFQDQLTKLVKFAKDNRSVIVYDSANAMHVHIR

SEQ ID NO: 18066 - DNA, 1242 bp, Sorghum bicolor
  misc_feature: Ceres ANNOT ID no. 8692329
  misc_feature: Encodes the peptide sequence at SEQ ID NO 18067
atggccagcagcggcacgaacgccaccggcgacgggacggtgccgcagccaccgccgtcgcaggggaggctcatcaccgttctgagcatcgatggcggcggcatccgggggctcatccctgccaccatcatcacctgcctcgagaccaagctccaggagctggacgggccggacgcacgcatcgccgactacttcgacgtgatcgccgggacgagcaccggcgcgctgctgacgtcgatgctggcggcgcccgacgagaacaggcggccgctgttcgccgccaaggacctcaccaccttctacctcgagaacggccccaacatcttcccacagagaaaggtggggtggctgacgccggtggcgaacctgatcggcacgatgaggggtcccaagtacgacggcgtgttcctgcacgacaagatcaagagcctgacgcacgacgtgcggatcgcggacacggtcaccaacatcgtggtgccggcgttcgacgtcaagtacctgcagccgatcatcttctccacgtacgaggccaagaccgacgcgctgaagaacgcgcacctctccgacatctgcatcagcacgtcggcggcgccgacctacttcccggcgcactacttcacgacggagcccgccgggcccggcgacgcgcgcccgccgcgggagtaccacctcgtcgacggcggcgtggcggccaacaaccccaccatgatcgccatgtccatgctcaccaaggaggtgctccgccggaacccggacttcaaccccggtaagcccaccgagtaccggaactacctcgtcatctccgtcgggacagggtccgccaagctcgccgagaagtacaccgcgccgcagtgcgccaagtggggcctcatccagtggctctacgagggcgggttcacccccatcatcgacatcttctcgcacgccagcgccgacatggtcgacatccatgccgccgtgctcttcgaggccctccattgcgagaagaattacctccgcattcaggacgattctctgacgggccatgcgtcgtcggtggacatcgcgacgaaggagaacatggaggcactgattgggatcgggaagaagcttctgaagaagccggtggcgagagtgaacatcgacacggggatgtacgagcccgtcgccggcgagggcacaaacgaggacgcgcttgcgcgcttcgccaagatgctctccgacgagcggaggctacgccaggccaacctcaactcctactag

SEQ ID NO: 18067 - protein, 413 aa, Sorghum bicolor
  misc_feature: Useful for making plants with modulated heat sensitivity
  misc_feature: Functional homolog of the protein sequence given in SEQ ID NO 13256
  misc_feature: Ceres ANNOT ID no. 8692329
  misc_feature (19)..(239): SWISSPROT Homolog: EC 3.1.1.5 Lysophospholipase
  misc_feature (28)..(239): Pfam ID: Patatin Pfam Description: Patatin-like phospholipase
MASSGTNATGDGTVPQPPPSQGRLITVLSIDGGGIRGLIPATIITCLETKLQELDGPDARIADYFDVIAGTSTGALLTSMLAAPDENRRPLFAAKDLTTFYLENGPNIFPQRKVGWLTPVANLIGTMRGPKYDGVFLHDKIKSLTHDVRIADTVTNIVVPAFDVKYLQPIIFSTYEAKTDALKNAHLSDICISTSAAPTYFPAHYFTTEPAGPGDARPPREYHLVDGGVAANNPTMIAMSMLTKEVLRRNPDFNPGKPTEYRNYLVISVGTGSAKLAEKYTAPQCAKWGLIQWLYEGGFTPIIDIFSHASADMVDIHAAVLFEALHCEKNYLRIQDDSLTGHASSVDIATKENMEALIGIGKKLLKKPVARVNIDTGMYEPVAGEGTNEDALARFAKMLSDERRLRQANLNSY

SEQ ID NO: 18068 - DNA, 915 bp, Sorghum bicolor
  misc_feature: Ceres ANNOT ID no. 8692354
  misc_feature: Encodes the peptide sequence at SEQ ID NO 18069
atggccatgtacatgtgcggccatgccgtgggctactacgcggttgttgttggcctgctgatcaccaccctcacgccaccgctggcggctggcataccatggccagtctgcagcagcagctccgccgggaactacaccgctaacagcacctacggcggcaacctccgcctggtcgccgccgccctgccaagcgacgtctccacgtcccctaccctcttcgccgtcgccacaaccgggacggcaccggacatagtttacgccatcgggcaatgcatcggcgacctgcagagcgccgccgctgcctgccgcgactgcatcgcggccagctttgagcaggcgcagaagatgtgcccacacaacaagggtgcggccatcttcgaccacgacaacggcacatgccaaatcggcttctccaaccaggattttctcgtttcccacgccaactcgcaggaccaggaggtgatggtctataacgctgagaacatcacctccgacatcgccagccggttcaacgcgttcacctacacgctgctcaacagtatggccgagtacgtttcgacaacaaactcaacaaacaagtacgtgacagcatcgatcgccatagatgccgcgacctacccgtatatctacggtatggcgtcgtgtacccctgacctggtaccttggcagtgccgtgggtgcctttctgctgcaatttccgatatgatatcaggagacaaaattaccgtctacaccaagggcgccaggatccgtggtctgcggtgcaccgcgcagtatgagctgtaccgtttctacaacagttccaccatgcttcagctgtcagcggcggtgccaccgccaccgccaccgccaccaccgccagccattcatcatcaggatggtctgtttcatggcgtttattctttttttgtctga

SEQ ID NO: 18069 - protein, 304 aa, Sorghum bicolor
  misc_feature: Useful for making plants with altered carbohydrate content
  misc_feature: Functional homolog of the protein sequence given in SEQ ID NO 14586
  misc_feature: Ceres ANNOT ID no. 8692354
MAMYMCGHAVGYYAVVVGLLITTLTPPLAAGIPWPVCSSSSAGNYTANSTYGGNLRLVAAALPSDVSTSPTLFAVATTGTAPDIVYAIGQCIGDLQSAAAACRDCIAASFEQAQKMCPHNKGAAIFDHDNGTCQIGFSNQDFLVSHANSQDQEVMVYNAENITSDIASRFNAFTYTLLNSMAEYVSTTNSTNKYVTASIAIDAATYPYIYGMASCTPDLVPWQCRGCLSAAISDMISGDKITVYTKGARIRGLRCTAQYELYRFYNSSTMLQLSAAVPPPPPPPPPPAIHHQDGLFHGVYSFFV

SEQ ID NO: 18070 - DNA, 1536 bp, Sorghum bicolor
  misc_feature: Ceres ANNOT ID no. 8692362
  misc_feature: Encodes the peptide sequence at SEQ ID NO 18071
atggagctcaagtcctcggcctccacaagaagaaactcgttccatggagtaggagcagcagcagcagcaccaccaccaccaaccggaggaggaagacgaggcggaggtgaaagcagcgtgttcgagcccaccttcagtgatccactctccaccctcaaggcctccgccgagttcgtccgctcctccttccccatggccacccttgccaggagcagcagcagcagcaacagccacgggcgccaccacgaggcctcctcctcctccaccaccaccacctcctcctcctcgtcctccgcggcggcctcggctcagaggcggcgaggcgagtcgcagcagcagcagcaggccgtggccgtcccggcgacaccggggcggccgctgcagttcttcacgagccccgcgcaccaccagctcgtcgcacccaggcggtccgtgccgtccaagtgggaggacgccgagaagtggctgcggcagtcgtcggcttctgaccacggcaatggcagcggcaacggcaaggctgcattctccaggcagcggagcagcgggtttggacaccgaggcggcgccggaggcgaggacgagaagagggcggccgtgacggtgaggaggtcggtggacgcgctccgggacgcccactcgctcgcgctgtacacgccgccggcagaagtgctcctcaaagacaagttcaccgacaacgaggagccgtccaaggagagcttcgtgttccggagctcgtactgcgagccggtgccggtggcgaagggctcggcggtagtgggcgccgccgaccacgacgaccaccagcggagggacgtcggcacggagatgacgccgctgggcagctcgtgccacacgccgctcaagagcacgtccccggtgcggcacaacacgccggcgagcaggtcgggcccgctggtgccgtacaccggcggcgggatggacatctcggagctggcggattgccacctcgccaagctggacctgggcgtgcggttcgacgccatgctcgtcaactggagctctaaggaggaggaggaagaggaggtgtccaagagcctcaggcacttcgaggccaccgtcggcgccggagctggagccggagccagcggcgggccgccttgtgataaacgcggtggcggcgactgccgttgggatgatgatgacagggccaagagctgcattaggtatcagagggaagaggcaaagatacaggcttggattaacctggagagtgccaaggctgaagcacaatcaagaaagctggaggtgaagattcagaagatgaggtcgaacctggaggagaagctgatgcggcggatgacgacggtgcaccggcgcgccgaggagtggcgcgccacggcgcaggcgcagcacctccagcagctgcggcgcgcggccgccgacaacacccggcggctcagggccacgagccaccaccgccacctgccggggagcgacgcgccctcctgcgcctgcttcccctgcagcaacaacagcaacaatgtcgttagcggcaacctcctcaactattactag

SEQ ID NO: 18071 - protein, 511 aa, Sorghum bicolor
  misc_feature: The sequence is a functional homolog of SEQ ID NO 1042 in the 10/666,642 US patent application
  misc_feature: Ceres ANNOT ID no. 8692362
  misc_feature (375)..(492): Pfam ID: Remorin_C Pfam Description: Remorin, C-terminal region
MELKSSASTRRNSFHGVGAAAAAPPPPTGGGRRGGGESSVFEPTFSDPLSTLKASAEFVRSSFPMATLARSSSSSNSHGRHHEASSSSTTTTSSSSSSAAASAQRRRGESQQQQQAVAVPATPGRPLQFFTSPAHHQLVAPRRSVPSKWEDAEKWLRQSSASDHGNGSGNGKAAFSRQRSSGFGHRGGAGGEDEKRAAVTVRRSVDALRDAHSLALYTPPAEVLLKDKFTDNEEPSKESFVFRSSYCEPVPVAKGSAVVGAADHDDHQRRDVGTEMTPLGSSCHTPLKSTSPVRHNTPASRSGPLVPYTGGGMDISELADCHLAKLDLGVRFDAMLVNWSSKEEEEEEVSKSLRHFEATVGAGAGAGASGGPPCDKRGGGDCRWDDDDRAKSCIRYQREEAKIQAWINLESAKAEAQSRKLEVKIQKMRSNLEEKLMRRMTTVHRRAEEWRATAQAQHLQQLRRAAADNTRRLRATSHHRHLPGSDAPSCACFPCSNNSNNVVSGNLLNYY

SEQ ID NO: 18072 - DNA, 903 bp, Sorghum bicolor
  misc_feature: Ceres ANNOT ID no. 8692399
  misc_feature: Encodes the peptide sequence at SEQ ID NO 18073
atgtcgacgtcctccgcgaagatggtgaccgggtggcacgtgctcaagatcgaggggtaccccagaacgaaggggctccctggtcgcaggagcattcagtccagcacgttcatcgtcggagggcacagctggtacatcggctacttccctggcggtatgggcagccttggcttggggaacactgactacgttagcgtccaactcaatctccatcatcctgctgccagtgccgaggtgtttacacaatttaagttcagtctactcgaccatgctggagagtcagtatactctggaaccaacagcatattcacattctccagcaaaactatatcacatggcatttccgggttcataaaaaagacggaactcgaatccttgtacgtcaaggacgacagtttcaagatcaggtgtgatgttaccgtcatcaaggacatccacggagaggatgaccctgtcgccgtgccgccatcgtcggttttcatggcccagctctttggtccgatgaaagagaagactgcaaaccatgtgcgtattgacgacatggacgcgagggtcttcaaggcgatgctccgcttcatgtacactgacatgctgcctgacatggaggaggacgaaaagacagtgatgtctcagcacctgctcgtggcggcagacagatacaatatggagaggctaaagttgatctgcgaggatatgttgcgcaagcgaatcaacactgacatagtagcaactacacttgtgctagcagagcaacatggttgctgtgggctcaaggatgtatgttttaagttcctcatatctccaggcaatctgaagacagtcatggcaaatgatagtttccaatatctgaagaacagctgcccctctctactcgatgaactcctcgccaatgttgctccatga

SEQ ID NO: 18073 - protein, 300 aa, Sorghum bicolor
  misc_feature: Useful for making plants with modulated biomass
  misc_feature: Functional homolog of the protein sequence given in SEQ ID NO 12898
  misc_feature: Ceres ANNOT ID no. 8692399
  misc_feature (129)..(237): Pfam ID: BTB Pfam Description: BTB/POZ domain
MSTSSAKMVTGWHVLKIEGYPRTKGLPGRRSIQSSTFIVGGHSWYIGYFPGGMGSLGLGNTDYVSVQLNLHHPAASAEVFTQFKFSLLDHAGESVYSGTNSIFTFSSKTISHGISGFIKKTELESLYVKDDSFKIRCDVTVIKDIHGEDDPVAVPPSSVFMAQLFGPMKEKTANHVRIDDMDARVFKAMLRFMYTDMLPDMEEDEKTVMSQHLLVAADRYNMERLKLICEDMLRKRINTDIVATTLVLAEQHGCCGLKDVCFKFLISPGNLKTVMANDSFQYLKNSCPSLLDELLANVAP

SEQ ID NO: 18074 - DNA, 1047 bp, Sorghum bicolor
  misc_feature: Ceres ANNOT ID no. 8692403
  misc_feature: Encodes the peptide sequence at SEQ ID NO 18075
atgtacacaccatgcgtccaatcccctccccagtccacacgtacacttgcgtacgtacgctccgctgctagtcccttaattagcttcactggaggcctgcgtccagccagccagccgctcccgacgacgacaccgatgatggcctccgcggcggtgccggcggccacaggaggcctgaaggaggacatcgcggggctatacgacgagtcgtcgggggtgtgggaacgcatctgcggcgagcacctgcaccacggcttctacgaaccggccggcgacgccacggcggtgcggcccgacgtccgccgcgcccagatccgcaccatcgacgaggcgctcgcattcgccgccgtcccagatgatctagagaagaggcccaaaacaatagtcgacgtaggatgtggcattggaggcagctcaaggtacttggccagaaaatacggagcacaatgtacgggcatcacgttgagccctgttcaagctgagagaggaaatgctcttactgccgcccagggcttgtcagaccaggtttccctccaagttgctgatgctctagaacaaccctttcctgatggaatgtttgatcttgtatggtccatggagagtggtgagcacatgccggataaaagaaagtttgttagtgagctagcgcgtgtcgcagctcctggagggacaataatcatcgtgacatgctgccataggaacctcaatccgtctgaaacttccctgaaacccgatgaacagagactcctaaagaggatatctgatgcatactgtcttgccgactggttcctaccttcagactatgtcagcattgctaagtcactgtctctcgaggatatcaggacagctgactggtcggagaacgtggtcccgttttggcccgctgtgataaaactgtcattgtcatggaagggcctgacctctgcgttaacatgtggatggaagacgatcaatggggcgatggggatactactgctgatccaaggctacaggaaggggctcatcaaattcacagtcatcacctgccgcaagcctggaccaccatag

SEQ ID NO: 18075 - protein, 348 aa, Sorghum bicolor
  misc_feature: The sequence is a functional homolog of SEQ ID NO 22 in US patent 7226745
  misc_feature: The sequence is a functional homolog of SEQ ID NO 36 in US patent 7244877
  misc_feature: Useful for making plants with modulated nitrogen use efficiency
  misc_feature: Functional homolog of the protein sequence given in SEQ ID NO 13084
  misc_feature: Ceres ANNOT ID no. 8692403
  misc_feature (10)..(345): SWISSPROT Homolog: EC 2.1.1.95 Tocopherol O-methyltransferase
  misc_feature (129)..(227): Pfam ID: Methyltransf_11 Pfam Description: Methyltransferase domain
MYTPCVQSPPQSTRTLAYVRSAASPLISFTGGLRPASQPLPTTTPMMASAAVPAATGGLKEDIAGLYDESSGVWERICGEHLHHGFYEPAGDATAVRPDVRRAQIRTIDEALAFAAVPDDLEKRPKTIVDVGCGIGGSSRYLARKYGAQCTGITLSPVQAERGNALTAAQGLSDQVSLQVADALEQPFPDGMFDLVWSMESGEHMPDKRKFVSELARVAAPGGTIIIVTCCHRNLNPSETSLKPDEQRLLKRISDAYCLADWFLPSDYVSIAKSLSLEDIRTADWSENVVPFWPAVIKLSLSWKGLTSALTCGWKTINGAMGILLLIQGYRKGLIKFTVITCRKPGPP

SEQ ID NO: 18076 - DNA, 2520 bp, Sorghum bicolor
  misc_feature: Ceres ANNOT ID no. 8692453
  misc_feature: Encodes the peptide sequence at SEQ ID NO 18077
atgacaagacttctgtcgtcgtaccttctcaccgtgatcttcaccgtgttcttgcttttgctcaaagcctcggccgccggcactccatctgacacactcagcagcagcagcaacatcaccgatggcgagacgttggtctcatccggcagctccttcaccttgggcttcttctccccggccggcgtgccagccaagagatatcttggcgtctggttcaccatgtcaccagaggccatctgttgggtggccaaccaagaaacacccctcaacaacacctcaggcgtgctggtcgtcgacgacagcaccggcacccttcgccttctcgacggctctggccacaccgcgtggtcttcttccagttccaccacgacgacgagttccgctcctcctccacctgtcgtgctgccgcaggcacagctcctcgattctggcaacctagtcgttcgcgatcagagcaccggcgacgtgctatggcagtggttcgatcacccggggaacacctacctcgccggcatgaaattcggcaagaacctccggactggcgctgagtggaccacgacgtcgtggcgtgcgtccaacgacccggcgcccggagactactggcgttccctggacaccaggggcctcccggacaccataacttggcatggcaacgtcaagatgtaccggacggggccctggaacgggcagtggttcagcggcatcccggagatggcgtcgtacttggacctgtactccaaccagctcgtcgtcggcgccgacgagatcgcgtactccttcaacaccacggccggcgcgccgatctccaggctactgctgaatgagaacggcgtgatgcaccggctggggtgggatccggtgagcctggtgtggacctcgttcgcggaggcgccgagggacgtctgcgacaactacgccatgtgcggcgcgttcgggctgtgcaacatgaacacggcgtccacgatgttctgcagctgcgccgtggggttcagccccgtgaacccgtctcagtggtccatgagggagacccatggcgggtgccggagggacgtgccgctggagtgcggcaacgggacgacgacagacgggttcaagatggtgcgggcggtgaagctgccggacacggacaacacaacggtggacatgggcgtgacgctggagcagtgcagggagaggtgcctcgccaactgcgcttgcgtggcctacgccgccgccgacatccgaggcggtgaccatggctgcgtcatgtggacggatgcgatcgtggatgttcgatacattgacaaagggcaggatatgtacctgaggttagcaaagtctgaattagttgagaagaagaggaatgtggtactaataatcttgctgccagttacgacatgtctgcttgccctcatggggatgttctttgtctgggtatggtgcaggcgcaagcttagaggcaaacgacgaaacatggatatccataagaagatgatgctaggacacttggatgagacaaatacacttggtgatgaaaatctcgaccttccgttttttagctttgatgatattgtttctgcaacaaataattttgctgaagacaatatgctcgggcaaggaggcttcgggaaagtttataagggtattctaggcgaaaacagagaggtcgcgatcaaaaggctcagtcagggctctggacaaggcacagatgaattcagaaatgaggtagttctaattgcgaaattgcagcacaggaaccttgttaggctccttggttgctgcattcatggagatgagaagttgctaatttacgaatatctaccaaacaaaagcttggattccttcatttttgatgctgcaaggaaaaacgttcttgattggccaacaaggttcaggataatcaaaggaatatcaaggggagttctttatctgcaccaggattcaagattgacaattgtgcaccgagatctgaaaacaagcaacatattgttggatgcagatatgaaccctaagatatcagattttggtatggcaagaatctttggagggaaccaacaagaagcaaatactaaccgagttgttgggacatatggttacatgtctcctgaatatgcaatggatggagctttttctgtcatgtctgatacatatagccttggtgttatactcttggagatcataagcggtttgaaaatcacttcgactcactccacgagcttccctagcctattagcttatgcatggagcttatggaatgatggcaaggcaatggatttggtggactcttttgttcttgaaagttgttcggcaaatgaagctttgaggtgcatccacataggactcttgtgtgtgcaagacaatccgaatagtaggccacttatgtcaacagttgtgttcatgttggagaacgaaaccacgttactttcagtcccaaaacagcccatgtacttctcgcaatggtatttagaagctcaaggaacaggagaaaatacaaatagctccatgaataacatgactgtcacagtgttggagggacggtaa

SEQ ID NO: 18077 - protein, 839 aa, Sorghum bicolor
  misc_feature: Useful for making plants with altered cell wall content and/or composition
  misc_feature: Functional homolog of the protein sequence given in SEQ ID NO 14359
  misc_feature: Useful for making plants with modulated biomass
  misc_feature: Functional homolog of the protein sequence given in SEQ ID NO 14141
  misc_feature: Ceres ANNOT ID no. 8692453
  misc_feature (512)..(794): SWISSPROT Homolog: EC 2.7.11.1 Non-specific serine/threonine protein kinase
  misc_feature (210)..(338): Pfam ID: S_locus_glycop Pfam Description: S-locus glycoprotein family
  misc_feature (524)..(792): Pfam ID: Pkinase Pfam Description: Protein kinase domain
  misc_feature (355)..(424): Pfam ID: PAN_2 Pfam Description: PAN-like domain
  misc_feature (76)..(196): Pfam ID: B_lectin Pfam Description: D-mannose binding lectin
MTRLLSSYLLTVIFTVFLLLLKASAAGTPSDTLSSSSNITDGETLVSSGSSFTLGFFSPAGVPAKRYLGVWFTMSPEAICWVANQETPLNNTSGVLVVDDSTGTLRLLDGSGHTAWSSSSSTTTTSSAPPPPVVLPQAQLLDSGNLVVRDQSTGDVLWQWFDHPGNTYLAGMKFGKNLRTGAEWTTTSWRASNDPAPGDYWRSLDTRGLPDTITWHGNVKMYRTGPWNGQWFSGIPEMASYLDLYSNQLVVGADEIAYSFNTTAGAPISRLLLNENGVMHRLGWDPVSLVWTSFAEAPRDVCDNYAMCGAFGLCNMNTASTMFCSCAVGFSPVNPSQWSMRETHGGCRRDVPLECGNGTTTDGFKMVRAVKLPDTDNTTVDMGVTLEQCRERCLANCACVAYAAADIRGGDHGCVMWTDAIVDVRYIDKGQDMYLRLAKSELVEKKRNVVLIILLPVTTCLLALMGMFFVWVWCRRKLRGKRRNMDIHKKMMLGHLDETNTLGDENLDLPFFSFDDIVSATNNFAEDNMLGQGGFGKVYKGILGENREVAIKRLSQGSGQGTDEFRNEVVLIAKLQHRNLVRLLGCCIHGDEKLLIYEYLPNKSLDSFIFDAARKNVLDWPTRFRIIKGISRGVLYLHQDSRLTIVHRDLKTSNILLDADMNPKISDFGMARIFGGNQQEANTNRVVGTYGYMSPEYAMDGAFSVMSDTYSLGVILLEIISGLKITSTHSTSFPSLLAYAWSLWNDGKAMDLVDSFVLESCSANEALRCIHIGLLCVQDNPNSRPLMSTVVFMLENETTLLSVPKQPMYFSQWYLEAQGTGENTNSSMNNMTVTVLEGR

SEQ ID NO: 18078 - DNA, 1599 bp, Sorghum bicolor
  misc_feature: Ceres ANNOT ID no. 8692458
  misc_feature: Encodes the peptide sequence at SEQ ID NO 18079
atgagcatcaagtcagaaaccaatgagcgtagcagcacaatccagagcgccggccaccggatatgcagcatcgtcaagctgtgctaccaacacctgatgctggcggtctcctacgcactctacctcttcctggcgcccatcatccttgccacactcgtgctccacctctcacgacacactagcgctgacgatgacctcatcgtgtccgcacgctccacgctcaccgctaatctgcccttcaccgtcgtcgtcgtcgccgccgccgccactgccgtctacctcatgcggcggccgcgggccgtctacctgctagacttggcgtgctacaagcccggggcggagcacgcggtgacccgggagacgttcatgcggcttgtcgtcgggtacgggaccttctccgacgacagccttgctttccagcgcaagatcctggagcggtcgggactggggcaaggaacctacttgcccaaggccctgaccagctcgccgcccaacccgtgcatggcagaggcccgccgcgaggcggaggctgtcatgttcggcgccgtcgaccagttgcttgccaagactggcgtccgcgccggcgacatcgggatcgtcgtcgtcaacagcggcctcttcagccccacaccgtcgctctctgccatgatcgtccaccactacaagctccgccgggacgtttccagctataacctcgccggcatgggctgcagcgctagcctcatctccgtcgacctcgccaagcagctgcttcaggtgcagcggaacacctacgctctggtcgtgagcctggagatcatggcggccagcgcgtacgtcggcaacacccggtcgatgctcgtgcccaactgcatcttcaggatgggcggcgccgccgtgctcctgaccaaccacggcacggagcggcgccgggccaagtaccagctactgcacacggtacggacgcaccagggcgccgacgaccgggcgtaccgctgtgtgtaccaagaagaggacgagtccgggcacgtaggggtggcgctgtccaaggacctcatgagcgtggctgccgaggcgctcaagaccaacatcacgacgctgggaccgcgggtgctgcccatgtcggagaagatgaagatgatgctcgtcggcggcaaggcggcggtggtgcaggtgctcggcgtgcagcagcagggccagggcggcagcaggagcaggccctatatcccggacttgacgacggcgttcgagcacttctgcatccacgccggcgggagggcggtgctggacaccgtggagaggagcctggacctcagcgcgtggcacatggagccgtcacggatgacgctctaccggtgggggaacacctccagcagctcgctgtggtatgagctcgcctacacggaggccaagggacgggtgcggcgcggccaccgcgtgtgccagatcgcctttgggtcagggttcaagtgcaacagcgctgtgtggcgcgcgctgcgcaccattgatccagccaaggagagcgccgccgccgggaacccgtgggtggaggagatccacaggttccccgtcgaggtgcctcaggtagagagggtcgacgtcgccgccatggcgtcctga

SEQ ID NO: 18079 - protein, 532 aa, Sorghum bicolor
  misc_feature: The sequence is a functional homolog of SEQ ID NO 2 in US patent 7038112
  misc_feature: Ceres ANNOT ID no. 8692458
  misc_feature (25)..(525): SWISSPROT Homolog: EC 2.3.1.119 Icosanoyl-CoA synthase
  misc_feature (93)..(380): Pfam ID: FAE1_CUT1_RppA Pfam Description: FAE1/Type III polyketide synthase-like protein
  misc_feature (409)..(491): Pfam ID: ACP_syn_III_C Pfam Description: 3-Oxoacyl-[acyl-carrier-protein (ACP)] synthase III C terminal
MSIKSETNERSSTIQSAGHRICSIVKLCYQHLMLAVSYALYLFLAPIILATLVLHLSRHTSADDDLIVSARSTLTANLPFTVVVVAAAATAVYLMRRPRAVYLLDLACYKPGAEHAVTRETFMRLVVGYGTFSDDSLAFQRKILERSGLGQGTYLPKALTSSPPNPCMAEARREAEAVMFGAVDQLLAKTGVRAGDIGIVVVNSGLFSPTPSLSAMIVHHYKLRRDVSSYNLAGMGCSASLISVDLAKQLLQVQRNTYALVVSLEIMAASAYVGNTRSMLVPNCIFRMGGAAVLLTNHGTERRRAKYQLLHTVRTHQGADDRAYRCVYQEEDESGHVGVALSKDLMSVAAEALKTNITTLGPRVLPMSEKMKMMLVGGKAAVVQVLGVQQQGQGGSRSRPYIPDLTTAFEHFCIHAGGRAVLDTVERSLDLSAWHMEPSRMTLYRWGNTSSSSLWYELAYTEAKGRVRRGHRVCQIAFGSGFKCNSAVWRALRTIDPAKESAAAGNPWVEEIHRFPVEVPQVERVDVAAMAS

SEQ ID NO: 18080 - DNA, 369 bp, Sorghum bicolor
  misc_feature: Ceres ANNOT ID no. 8692471
  misc_feature: Encodes the peptide sequence at SEQ ID NO 18081
atggagggggacagctactccggcgccatggcgaacggcggcgggcaggcggtggacgggaagctgatccagacgttccacaagagcttcgtgcaggtgcagagcctgctggaccagaaccggatgctcatcagcgagatcaaccagaaccacgagtcccgggcgcccgacaacctcacccgcaacgtcggcctcatccgggagctcaacaacaacatccgccgcgtcgtcggcctctacgccgacctctccgcctccttcgcccgcaccatggacgcttcctccgacggcgactcctccggcaccgccatccgctcctccgccgccgccgccgccgccgccggacacaagcgcgtccgccccgcctag

SEQ ID NO: 18081 - protein, 122 aa, Sorghum bicolor
  misc_feature: Useful for making plants with altered lignin content
  misc_feature: Functional homolog of the protein sequence given in SEQ ID NO 13163
  misc_feature: Ceres ANNOT ID no. 8692471
MEGDSYSGAMANGGGQAVDGKLIQTFHKSFVQVQSLLDQNRMLISEINQNHESRAPDNLTRNVGLIRELNNNIRRVVGLYADLSASFARTMDASSDGDSSGTAIRSSAAAAAAAGHKRVRPA

SEQ ID NO: 18082 - DNA, 1047 bp, Sorghum bicolor
  misc_feature: Ceres ANNOT ID no. 8692491
  misc_feature: Encodes the peptide sequence at SEQ ID NO 18083
atgggccactccaacgtctggaactcccaccccaagaactacggccccggctcccgcgtctgccgggtctgtgcgaatcctcatggtctgatcaggaagtacgggctcatgtgctgcaggcagtgcttccgcagcaacgccaaggacattggcttcatcaaggtagcctttgcatttatcctgttgacaatcttctgttattctcaagagaggcttagacttcagttgaaaagcttcagccctgcaacatattacctgcagcacttgccacagaccttaggagtactagagcatagagttgaaggttctgtcagcagaatggaagcaaattctgcatccatttggagcgaggaatctgagatgattgctcacttgcagtctatgttttggagcagcagcaatgctgattcctgcctttcttctcccaacagcagcactagttcttgtgttgaaaatgagccctttgataaagagcaatgtctggacactggtgcagtttggtgctttgatcaccagagtcaggttttcgctccaattactaatgaagttacaggcatcaagagggtatgtcttatggatgagaataagaagagtaagaatgctaagaaactccgaaccattgccctggtatcgaggacaagttcaaatgctcctgctgacgagattaacacagagcttgtcagtcagagctgttcctggagctgcagctctgaagatgattcaattggtgtgtgtgaagaatctgttgttctgaaacaaagtaccagttcaagaggtcgtagtcggtcctcaaaggatttacagagcctttacgcaaagaggagaagagagaggatcaatgaaagactaaggacgctgcagcagctaattcctaatggcaccaaagttgacatgagcactatgctagaggaagcagttcagtatgtcaagttcctgcagctgcaaataaagctcctgagctctgaagatacatggatgtacgcacctcttgcttataaccacatgagcatggacgtcagtcaaaatgctgctgtgaaccaatcatga

SEQ ID NO: 18083 - protein, 348 aa, Sorghum bicolor
  misc_feature: Useful for making plants with modulated nitrogen use efficiency
  misc_feature: Functional homolog of the protein sequence given in SEQ ID NO 14091
  misc_feature: Ceres ANNOT ID no. 8692491
  misc_feature (3)..(56): Pfam ID: Ribosomal_S14 Pfam Description: Ribosomal protein S14p/S29e
  misc_feature (264)..(313): Pfam ID: HLH Pfam Description: Helix-loop-helix DNA-binding domain
MGHSNVWNSHPKNYGPGSRVCRVCANPHGLIRKYGLMCCRQCFRSNAKDIGFIKVAFAFILLTIFCYSQERLRLQLKSFSPATYYLQHLPQTLGVLEHRVEGSVSRMEANSASIWSEESEMIAHLQSMFWSSSNADSCLSSPNSSTSSCVENEPFDKEQCLDTGAVWCFDHQSQVFAPITNEVTGIKRVCLMDENKKSKNAKKLRTIALVSRTSSNAPADEINTELVSQSCSWSCSSEDDSIGVCEESVVLKQSTSSRGRSRSSKDLQSLYAKRRRERINERLRTLQQLIPNGTKVDMSTMLEEAVQYVKFLQLQIKLLSSEDTWMYAPLAYNHMSMDVSQNAAVNQS

SEQ ID NO: 18084 - DNA, 237 bp, Sorghum bicolor
  misc_feature: Ceres ANNOT ID no. 8692682
  misc_feature: Encodes the peptide sequence at SEQ ID NO 18085
atggacctgtacgagaagttggagaaggttggggagggcacgtacgggaaggtgtacagggcgcgggagaaggcgacggggcggatcgtggcgctgaagaagacgcggctccccgaggacgacgagggcgtgcctcccaccgcgatgcgggaggtctccctgctgcggatgctgtcgcagggcggcgctagcgcgtacggcgcgggcgcgcagcgtacggcgcgggcgcgggcgtga

SEQ ID NO: 18085 - protein, 78 aa, Sorghum bicolor
  misc_feature: Useful for making plants with modulated nitrogen use efficiency
  misc_feature: Functional homolog of the protein sequence given in SEQ ID NO 14265
  misc_feature: Useful for making plants with modulated growth rate
  misc_feature: Functional homolog of the protein sequence given in SEQ ID NO 14264
  misc_feature: Ceres ANNOT ID no. 8692682
  misc_feature (1)..(56): SWISSPROT Homolog: EC 2.7.11.22 Cyclin-dependent kinase
MDLYEKLEKVGEGTYGKVYRAREKATGRIVALKKTRLPEDDEGVPPTAMREVSLLRMLSQGGASAYGAGAQRTARARA

SEQ ID NO: 18086 - DNA, 969 bp, Sorghum bicolor
  misc_feature: Ceres ANNOT ID no. 8692723
  misc_feature: Encodes the peptide sequence at SEQ ID NO 18087
atgaagctcgcggggctcaagtctgtggacggcgcccacgaggagtccatctgggcggcggcctgggcgcccgccgccgaccaccgccccacggcggtgctcctcaccggggcgctcgacgagaccgtccgcgcttggctccccgacgacctcgccgccttgggatcccccgcgcgcggccacgcgctcggagtcgtctccctcgccgcccaccccgccggcgcgctcgccgccgccgtgtcgctcgacagcttcatccgcgtcttcgatgtcgacacgggggcgtccgtcgccacgctggaggcgccgccgtctgaggtctggggcgtccagttccaccccatgggtaatgctctagctgcagctggtggtggcagtggatcagtgaagctctgggacacagagaggtggcagccaattaccagcctgactgtcccacgtccagagggagctcgccctgacaggacaggcagtggcaagtttgtcctttcagttgcctggagtcctgatgggaagctcttagcatgtgggtccatggacggcaccattgccatctacgacgctgtccgcatgaagttccttcaccacctcgagggccaccacatgccggtgcggtccatggtgttctccccagtggatccccacgtgctcttcacggcctgcgatgactgccacatccacatctacgacgccaaggagaagagcctcatcggtgccatgtcaggccacgcgagctgggtgctgagcatcgacgtgagccccgatggcttggcggtggctacgggatccagtgaccgcacagtccggctctgggacatcaacatgaggacctcggtgcagaccatgagcaaccattctgaccaggtctgggctgtggccttccggccgccaggtggggcgggaatccgggctgggcgcctagctagcgcgtcggatgacaagagcatctccctgtatgattactcatag

SEQ ID NO: 18087 - protein, 322 aa, Sorghum bicolor
  misc_feature: Useful for making plants with modulated flowering time
  misc_feature: Functional homolog of the protein sequence given in SEQ ID NO 14597
  misc_feature: Ceres ANNOT ID no. 8692723
  misc_feature (106)..(296): SWISSPROT Homolog: EC 2.3.1.48 Histone acetyltransferase
  misc_feature (234)..(272): Pfam ID: WD40 Pfam Description: WD domain, G-beta repeat
  misc_feature (191)..(230): Pfam ID: WD40 Pfam Description: WD domain, G-beta repeat
  misc_feature (149)..(187): Pfam ID: WD40 Pfam Description: WD domain, G-beta repeat
  misc_feature (276)..(320): Pfam ID: WD40 Pfam Description: WD domain, G-beta repeat
  misc_feature (94)..(133): Pfam ID: WD40 Pfam Description: WD domain, G-beta repeat
MKLAGLKSVDGAHEESIWAAAWAPAADHRPTAVLLTGALDETVRAWLPDDLAALGSPARGHALGVVSLAAHPAGALAAAVSLDSFIRVFDVDTGASVATLEAPPSEVWGVQFHPMGNALAAAGGGSGSVKLWDTERWQPITSLTVPRPEGARPDRTGSGKFVLSVAWSPDGKLLACGSMDGTIAIYDAVRMKFLHHLEGHHMPVRSMVFSPVDPHVLFTACDDCHIHIYDAKEKSLIGAMSGHASWVLSIDVSPDGLAVATGSSDRTVRLWDINMRTSVQTMSNHSDQVWAVAFRPPGGAGIRAGRLASASDDKSISLYDYS

SEQ ID NO: 18088 - DNA, 1266 bp, Sorghum bicolor
  misc_feature: Ceres ANNOT ID no. 8692931
  misc_feature: Encodes the peptide sequence at SEQ ID NO 18089
atggcaatttcttggcgagtgtgcttgttcgcgctcgtcgtggctctagggtttctcttcttcttggacggtgcagcggcggcgagaagtgcagggacgtcgtcggcggcagcgcagcgccggcgagaggttcgaagcctcctcacgcggctcaacaagcctcctctcgcgaccattgagagcccagatggagatatcattgactgtgtccacatctcgaagcagccagcattcgatcatcctctcctcaagaatcatagtatccagatgatgccctcttgccacccagaaggactcaataacaattcaaatattgcaccaaatcctttcacccaaacatggcatcaaaatggcaagtgcccagagaataccataccgatccgaaggaccaaagaagaggatgtcctgagggtgagctccattgagagatatggcaagaagtcgccttggagcatcccaaaccgtttttccattgatgaccctgactcggtgaacgtattaagaggccaccagcatgccatagcatctgcgccggaggatgacaactactatggtacccaagcaaccttcaatttgtgggaaccaattgttgagatggacgaaggattcagtttgacccagttctggattagtagtgggtcctactcaaacaacgacctgaatactatagaagcaggatggcaggtttacccaggtctgtataaggatagacacacaagactcttcatctactggactcgggatgcatacaacaaaacaggatgctacaatctactatgctcagggtttatacagacaagcaaccagattgccatcggtgctagcaactcctacctgtcccctgtctccgtctatggtggctcacaatatgacttcactattttagtttggaaggacccaaaggatggcaattggtggttgcaagtgggaggccatgatctaggctactggccaacttcgatcttcactaggttggcaggtagtgctgcctctgtcgagtggggaggcgaggtggcatcgtcacctgatgctggccaaacatccacacagatgggtagtggacactttcctgaggaagggttcagcaaggccagttacgtcaagaacatccaattggtagattcgaccaacaatctcaaatcgcctagtgctgtgagcttggtagctaagtggcccaagtgctacaacgtgcagaatggtactagtgctgattggggtacttacatcttctatggaggacccgggaagaaccctaactgccaatag

SEQ ID NO: 18089 - protein, 421 aa, Sorghum bicolor
  misc_feature: Useful for biocontainment applications
  misc_feature: Functional homolog of the protein sequence given in SEQ ID NO 14085
  misc_feature: Ceres ANNOT ID no. 8692931
MAISWRVCLFALVVALGFLFFLDGAAAARSAGTSSAAAQRRREVRSLLTRLNKPPLATIESPDGDIIDCVHISKQPAFDHPLLKNHSIQMMPSCHPEGLNNNSNIAPNPFTQTWHQNGKCPENTIPIRRTKEEDVLRVSSIERYGKKSPWSIPNRFSIDDPDSVNVLRGHQHAIASAPEDDNYYGTQATFNLWEPIVEMDEGFSLTQFWISSGSYSNNDLNTIEAGWQVYPGLYKDRHTRLFIYWTRDAYNKTGCYNLLCSGFIQTSNQIAIGASNSYLSPVSVYGGSQYDFTILVWKDPKDGNWWLQVGGHDLGYWPTSIFTRLAGSAASVEWGGEVASSPDAGQTSTQMGSGHFPEEGFSKASYVKNIQLVDSTNNLKSPSAVSLVAKWPKCYNVQNGTSADWGTYIFYGGPGKNPNCQ

SEQ ID NO: 18090 - DNA, 468 bp, Sorghum bicolor
  misc_feature: Ceres ANNOT ID no. 8692918
  misc_feature: Encodes the peptide sequence at SEQ ID NO 18091
atgacggacgacgcctcgtcacggggcgccaccgccttcttcatcggggtgcggccgcggccgtggggcacgttcgccgccgagatccgggactccacgcgcaggggcgcccgcgtgtggctcggcaccttcgacaccgccgaggccgccgcgctcgcctacgaccaggccgccttcgcggcgcccggcgccgccgccgtcttcaacttccccgtcgactgcgtgcgggagtcgctggcgccgctcgagctcgccgcgacgctggggtcccctgtcctcgcgctgaagcggcggcactgcaagcggaagcacaggcgcaggcgcagcagctccaacgtgtccatggcagcgccgccgcagcagcaggtcatcagccagtgctgcagtagcatcattgagctcgaggacctcggcgctgattacttggacgagctgctgcgggtatcatgcgagtccacaacaggttga

SEQ ID NO: 18091 - protein, 155 aa, Sorghum bicolor
  misc_feature: The sequence is a functional homolog of SEQ ID NO 106 in the 11/375,241 US patent application
  misc_feature: The sequence is a functional homolog of SEQ ID NO 2876 in the 10/374,780 US patent application
  misc_feature: The sequence is a functional homolog of SEQ ID NO 44 in the 10/903,236 US patent application
  misc_feature: The sequence is a functional homolog of SEQ ID NO 474 in the 10/225,066 US patent application
  misc_feature: The sequence is a functional homolog of SEQ ID NO 560 in the 11/435,388 US patent application
  misc_feature: Useful for making plants with modulated flowering time
  misc_feature: Functional homolog of the protein sequence given in SEQ ID NO 14280
  misc_feature: The sequence is a functional homolog of SEQ ID NO 2700 in the 10/374,780 US patent application
  misc_feature: The sequence is a functional homolog of SEQ ID NO 3 in US patent 7317139
  misc_feature: The sequence is a functional homolog of SEQ ID NO 350 in the 10/225,066 US patent application
  misc_feature: The sequence is a functional homolog of SEQ ID NO 42 in the 10/903,236 US patent application
  misc_feature: The sequence is a functional homolog of SEQ ID NO 668 in the 11/435,388 US patent application
  misc_feature: Ceres ANNOT ID no. 8692918
  misc_feature (12)..(64): Pfam ID: AP2 Pfam Description: AP2 domain
MTDDASSRGATAFFIGVRPRPWGTFAAEIRDSTRRGARVWLGTFDTAEAAALAYDQAAFAAPGAAAVFNFPVDCVRESLAPLELAATLGSPVLALKRRHCKRKHRRRRSSSNVSMAAPPQQQVISQCCSSIIELEDLGADYLDELLRVSCESTTG

SEQ ID NO: 18092 - DNA, 1110 bp, Sorghum bicolor
  misc_feature: Ceres ANNOT ID no. 8692951
  misc_feature: Encodes the peptide sequence at SEQ ID NO 18093
atggaatccaacacagtgctcatggcgctcccgccagcgcagcagggaagggttctcactgtgttgagcatcgatggcggaggcatccgtgggatcatccctgcaaccatcctagctcgcctcgagactctgctccaaaggatagacgggcaggacgccaggattgctgactacttcgatttcatcgctggtaccagcaccggcgggctgataacggcgatgctgtcggcgcctggcaaggacaagaggccactgtttgcagccaaggagatcaaccacggctggtggttcgacaacatacgggaaaaggttatggacatgtggaaaaagatcaagggaggcccgcagtacaacggcgagttcctgcatgacaagatcaacaaactgatcaaggacaccaagctggcggacacgctgagcaacgtcgtgatcccggcgttcgacgtgagccggatgcagcctgtcgtcttcaactcgctggaggccgagcgggacgccgggaagaacgcgcgcctcgccgacgtctgcatcgccacgtcggcggcaccgacgtacctgccggcgcacagcttccggaccatagacgccaatggctgcccgcaccagtacgaggtcgtcgacggtggcgtggtggccaataaccctaccatggtcgccatcaacatcctcgtcctgtccatcgggacgggcactgcgaatcccaacaaggcggagaagtacaccgcagcggaatgtaacaagtggggtcctttgggatgggttatgaacgatggtgcccacccaatcatcgacttctactctcaaggcagcgacgacatggtcgatgtttgtgctgaaatgctcttcgatgtcctcggttgccagaacaatttcctgcgcatccaggctgacatgctggagggagacctgttgttgatggactgtgcgactgatgacaacatgaaggcgctgattgaagttggaagtaaggttcttgagcagaaggtggcgaaggtgaacctcgagacgggcttgtacgagcatgtccctgacgggccaaccaacgacaaggcactcgaggaattcgccaagaagctgtcccaggaacgcaagatgcgggcatgcaagtga

SEQ ID NO: 18093 - protein, 369 aa, Sorghum bicolor
  misc_feature: Useful for making plants with modulated heat sensitivity
  misc_feature: Functional homolog of the protein sequence given in SEQ ID NO 13256
  misc_feature: Ceres ANNOT ID no. 8692951
  misc_feature (15)..(221): SWISSPROT Homolog: EC 3.1.1.5 Lysophospholipase
  misc_feature (22)..(220): Pfam ID: Patatin Pfam Description: Patatin-like phospholipase
MESNTVLMALPPAQQGRVLTVLSIDGGGIRGIIPATILARLETLLQRIDGQDARIADYFDFIAGTSTGGLITAMLSAPGKDKRPLFAAKEINHGWWFDNIREKVMDMWKKIKGGPQYNGEFLHDKINKLIKDTKLADTLSNVVIPAFDVSRMQPVVFNSLEAERDAGKNARLADVCIATSAAPTYLPAHSFRTIDANGCPHQYEVVDGGVVANNPTMVAINILVLSIGTGTANPNKAEKYTAAECNKWGPLGWVMNDGAHPIIDFYSQGSDDMVDVCAEMLFDVLGCQNNFLRIQADMLEGDLLLMDCATDDNMKALIEVGSKVLEQKVAKVNLETGLYEHVPDGPTNDKALEEFAKKLSQERKMRACK

SEQ ID NO: 18094 - DNA, 1167 bp, Sorghum bicolor
  misc_feature: Ceres ANNOT ID no. 8692926
  misc_feature: Encodes the peptide sequence at SEQ ID NO 18095
atggcagccatgcgaacgtgcttggtcgccattgttgtggctctagggtttctcttcctcgagaagccagaagtcacagcggcggcgacggagacgactactgggatgtccacgtactgtgtgcacgtctccaaacaacccgcatttgatcatccactactcaagaatcatactatccagatgcggccttcttaccacccaagaagcctaaatcaaaactacaacattacctcccatccaatcacccaaacatggcatcaaaatggcaagtgccctgagaacaccgtaccgatacgaagaaccatggtacaggatgtcctaagggcaagttctatcagcaggtatggcaagaagaggcccaggagtattccgaacctcaattccataaatggccctgacacaccaaatgtattgaatggccaccagcatgctgtagtagctgcacaggataataagtgctatggaaccaaagcctccttcaatttgtgggatccaacaattgctcgggcaaatgatttcagcttgtcacagctctgggtcactgcaggttcctacaacggaaatgacctcaataccattgaagctggatggcagaggtttaccccagctatgtatggagatagcaatactagactcttcatctactggactcgggatgcatatcaacacacaggatgttacaacctaggatgcgcagggtttgtccagacaaacaatcagatcgccatcgctggtagcttgtccccaatctccacctatggtggcacacaatatgacttcgatattttggtttggaaggatccacagagtggcaattggtggctacaagtgggaggcactgacgtgggttattggccatcctcgatcttcacatacttgaaagatagtgcctcctctgttgagtggggtggcgaggtattctcgccagatgctggccaaacttcgacacaaatgggcagtggacacttccctaatgaaggatttggcaaggcttgtcacatcaagaacatgctagtggtagattcgtcgaacaccctcagatcgccaagtagtgtaaacccgataactgagcagagcaactgctataatgtgcagagtggtaccagtggcgactggggcacgtacatctactttggcggacctgggaaaaatcctaactgctcatag

SEQ ID NO: 18095 - protein, 388 aa, Sorghum bicolor
  misc_feature: Useful for biocontainment applications
  misc_feature: Functional homolog of the protein sequence given in SEQ ID NO 14085
  misc_feature: Ceres ANNOT ID no. 8692926
MAAMRTCLVAIVVALGFLFLEKPEVTAAATETTTGMSTYCVHVSKQPAFDHPLLKNHTIQMRPSYHPRSLNQNYNITSHPITQTWHQNGKCPENTVPIRRTMVQDVLRASSISRYGKKRPRSIPNLNSINGPDTPNVLNGHQHAVVAAQDNKCYGTKASFNLWDPTIARANDFSLSQLWVTAGSYNGNDLNTIEAGWQRFTPAMYGDSNTRLFIYWTRDAYQHTGCYNLGCAGFVQTNNQIAIAGSLSPISTYGGTQYDFDILVWKDPQSGNWWLQVGGTDVGYWPSSIFTYLKDSASSVEWGGEVFSPDAGQTSTQMGSGHFPNEGFGKACHIKNMLVVDSSNTLRSPSSVNPITEQSNCYNVQSGTSGDWGTYIYFGGPGKNPNCS

SEQ ID NO: 18096 - DNA, 1404 bp, Sorghum bicolor
  misc_feature: Ceres ANNOT ID no. 8693146
  misc_feature: Encodes the peptide sequence at SEQ ID NO 18097
atgctcccgctcctcctcctcctcctcctcgccgccttcctccatgggacggcggcggcgcaggggcagcagggcctgccctctctgcccatcggagtcaactacggcgcgaacgccgacaacctgcccacccccgccgccgtcgcctccttcctcgccaagagcacgaccatcgaccgcgtgaagctcttcgacgcgaacccagccttcctggacgcgttcgccgccaacgcgccgtccatctcgctggccgtctccatccccaacgccgtcctcccgaccttcgccgacagatccagcggcctggacgcggcgcggggctgggtccgcgacaacctctccccacacatctccgcgggcgccaacgtgacgctcctcctggccgggaacgaggtgctgggccccaccgtggtcccggacctcgtcgtcgccctcctccccgcgatgcgtcgtctcgcccaggcgctccagctcgagagcctccccgacgtccgcgtcaccacgccgcactacctggggatcctcgccccctccgacgggatcccgtccaacgcgcggttccgcccggggctcgacgccaaggtcctcgcgcccatgctcaggttccacaacgacaccgggtcgccgttcatggtcaacgcctacccttacttcagctacaacgcggccaacctcaactacgccgtgttccggcccaacgccggggtgtacgaccccgggacgaagctcaactacaccagcatgttcgacgcgcagatggacgccatctacacggcgatgaagaagctcgggtttggagatggagtggagatcgccgtcggggaggccgggtggccgaccaaggcggaggcggcgcaggtcggggtgggggtcgaggaggcgaaagattttaatgccgggatgatccgggtgtgtagcggagggaaggggacgccgttgatgcccgggaggaagttcgagacgtacgtgttctcgctgtttgatgagaatcagaagcctgggccggtggcggagaggaattttggcatctttaacacggatttcacgcccaagtatgatctcggactgcttcgccaaggatcctccggatctccaaacccatctccgaagccaagcccaaacccgtcgccgtcaggaggaggcaagtggtgtgtggccaagtccggcgcgagcgcaaccgacctgcagaacaacatcaactacgcctgtggctacatcgactgtaagccgatccagagtggcggcgcgtgctttgaccccaacaacgtgcagtcgcatgcttcgtacgtgatgaacgcgtactaccaggccaatggcctgcacgactacgactgcaacttcaagggcaccggcgtggtcacctccagtgaccccagttacgggagttgcaaatacgtctcctga

SEQ ID NO: 18097 - protein, 467 aa, Sorghum bicolor
  misc_feature: Useful for making plants with altered carbohydrate content
  misc_feature: Functional homolog of the protein sequence given in SEQ ID NO 14283
  misc_feature: Ceres ANNOT ID no. 8693146
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature (23)..(467): SWISSPROT Homolog: EC 3.2.1.39 Glucan endo-1,3-beta-D-glucosidase
  misc_feature (31)..(356): Pfam ID: Glyco_hydro_17 Pfam Description: Glycosyl hydrolases family 17
  misc_feature (382)..(465): Pfam ID: X8 Pfam Description: X8 domain
MLPLLLLLLLAAFLHGTAAAQGQQGLPSLPIGVNYGANADNLPTPAAVASFLAKSTTIDRVKLFDANPAFLDAFAANAPSISLAVSIPNAVLPTFADRSSGLDAARGWVRDNLSPHISAGANVTLLLAGNEVLGPTVVPDLVVALLPAMRRLAQALQLESLPDVRVTTPHYLGILAPSDGIPSNARFRPGLDAKVLAPMLRFHNDTGSPFMVNAYPYFSYNAANLNYAVFRPNAGVYDPGTKLNYTSMFDAQMDAIYTAMKKLGFGDGVEIAVGEAGWPTKAEAAQVGVGVEEAKDFNAGMIRVCSGGKGTPLMPGRKFETYVFSLFDENQKPGPVAERNFGIFNTDFTPKYDLGLLRQGSSGSPNPSPKPSPNPSPSGGGKWCVAKSGASATDLQNNINYACGYIDCKPIQSGGACFDPNNVQSHASYVMNAYYQANGLHDYDCNFKGTGVVTSSDPSYGSCKYVS

SEQ ID NO: 18098 - DNA, 2070 bp, Sorghum bicolor
  misc_feature: Ceres ANNOT ID no. 8693152
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Encodes the peptide sequence at SEQ ID NO 18099
atggccgcctcgccggagggcgagggcctcttcgttgaccccgagcccttctccccgtccatcttcctcgacctgtccccgacgccccgccccgatggcaacggcgaggccccggcctcatcagacgacctcgtcctccccttcatctcgcggatcctcatggaggaggacatcgacgaccaattcttctaccagtttcccgaccaccccgtgctcctccaagcccaggaaccgtacgcgcagatcctctctgacgcagccgcggctcgcaccaacagcgctgcctcgggctcgggctcccccgccaccgtctcgccgtcctcctcctccgacccagcccagctcctcctgtccccgccgtaccccgatgcgggactgcacgacttcaccaacgaccatgtcggcaccttcttcttgcccgcacaaggtggtggcagcccggagttcgagcagagtccggcgcaattgaggaccacaaccttgcccgccggcgacggcgaccacgcggcgctggcctcggtcttcttcaagagggaagacgcggacgcggagatgctcaacaaggcattcctcaagggtatggaggaggccaagaagttcttgcccaccaccaacagcctcctaatcgatcgtggggcagaggaggtggaggagggaattaatggcaggtgccgtaaggatagggacaggctcagttgggatgacttggaggctgagacgtgcaggaagagcaagctgatggtgcctgagcctgaggaaactggcgagatggtagatgaaatgattgtcaatggactgaaattgtgcctcaaagaaatggaggccctgcgaatcaccatgggcagtgaggctaagaagaaggcaaggaagggcaaagggaagtcggcacagggaaggtctagctccaacgaggcggtggagctgagcaccttgctcatccactgtgcacaggccgtggccacggacaaccgcaggagtgcgaccgaattgctgagacagatcaagcagcactcgtcgccgaagggtgatgccacacagaggttggcacattgttttgcagagggattggaggcgcggctggcagggtcagggagccagctctacagatctctcatggctgagcgtgtctcggtcgtggagtacctcaaggcctactggttgtacctggcagcttgctgtttcaaaatgacggcattcaggttctccaacatgacaatcctcaaggccatcgctgggaggaaaaaggttcacattgtgaattatggcatggattatggggttcagtggccaagtttgctataccatatggcgaacttggagggtgggccacctgaagtgaggatcaccggcattgacctcccccagcctggattccgcccagccatgcggattgaggagacagggcaccggctcagcaattatgctcgtcagctcggtgtgccattcaagttccatggcatcacagcgaagtgggatacagttcgtgttgatgacctgaacattgaccctgatgaggtactcattgtcaatagtatcatccagtttggaaatttgatggacgagggggtcaacatcgatagcccaagtcctagggatgttgtcctcagaaccattcgcaagatgcaacctgatgcgttcatcctttatgtcatgaatgtctcatacagtgctccattctttgtaacacgtttccgtgaggcgctgttcttttactccgcaatgtttgacatgctggatgccacggctccacgggatagtcaccagcgctttttggttgagcagcacctctttaggcagtgtgccctgagtgttgttgcctgtgagggcatggacagggtggagcgcgcggagacatataagcaatggcaggtgcggaaccaccgggcagggctaaggcagcttccattggatccagatcttgtaaagaccttgagggacaaagttagggatcagtatcacaaggacttcgtcattgatacggatcataattggctcctggaaggatggaagggacgcatactctatgccatgtcgacatgggttgcagataatcctgtctcagaactttag

SEQ ID NO: 18099 - protein, 689 aa, Sorghum bicolor
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
  misc_feature: Ceres ANNOT ID no. 8693152
  misc_feature (283)..(590): Pfam ID: GRAS Pfam Description: GRAS family transcription factor
MAASPEGEGLFVDPEPFSPSIFLDLSPTPRPDGNGEAPASSDDLVLPFISRILMEEDIDDQFFYQFPDHPVLLQAQEPYAQILSDAAAARTNSAASGSGSPATVSPSSSSDPAQLLLSPPYPDAGLHDFTNDHVGTFFLPAQGGGSPEFEQSPAQLRTTTLPAGDGDHAALASVFFKREDADAEMLNKAFLKGMEEAKKFLPTTNSLLIDRGAEEVEEGINGRCRKDRDRLSWDDLEAETCRKSKLMVPEPEETGEMVDEMIVNGLKLCLKEMEALRITMGSEAKKKARKGKGKSAQGRSSSNEAVELSTLLIHCAQAVATDNRRSATELLRQIKQHSSPKGDATQRLAHCFAEGLEARLAGSGSQLYRSLMAERVSVVEYLKAYWLYLAACCFKMTAFRFSNMTILKAIAGRKKVHIVNYGMDYGVQWPSLLYHMANLEGGPPEVRITGIDLPQPGFRPAMRIEETGHRLSNYARQLGVPFKFHGITAKWDTVRVDDLNIDPDEVLIVNSIIQFGNLMDEGVNIDSPSPRDVVLRTIRKMQPDAFILYVMNVSYSAPFFVTRFREALFFYSAMFDMLDATAPRDSHQRFLVEQHLFRQCALSVVACEGMDRVERAETYKQWQVRNHRAGLRQLPLDPDLVKTLRDKVRDQYHKDFVIDTDHNWLLEGWKGRILYAMSTWVADNPVSEL

SEQ ID NO: 18100 - DNA, 2064 bp, Sorghum bicolor
  misc_feature: Ceres ANNOT ID no. 8693153
  misc_feature: Encodes the peptide sequence at SEQ ID NO 18101
atggcagcctcgccggaggttttcttgcctgacctcgaagagcccttctccccctccgtcttccttgacctgcccccgacgcctcgctctgatggcaatggcgacggcaaggacccggcctccgacgatatcgtcctccccttcatcgagcgcatgctcatggaggaggggatcgacgaagagttcttgtaccagtacccgtgccaccccgcgcttctccaagcccaggaatcgtacgcgcaggtcctctccgagcccaccgcggattcgtcttcggacggcaggctgtccgtgtcggtgtcctccggctccgacgcgggagtgggggccgacgacctcaccgcggacgccatcacggcgtccgagcagagtccggcgcgattgggggatgctggcgtccggagtgacgagaggccggcgcaattggggtacgccggcaccgccgcccggagtgacgccgccgccgaggaggaggtggagaaaaaggccaacagcactatgcttgcagtcgtcgatgggctgaactccgcattcttcagtgcccagcaggatgggggaggcaaggccatgttcctcaagggcatggaagaggccaacaagttcctgcctagggacatcgacctgctgcgcggcggctctgccaccgtcatccaagtgaatgaagaggaaagtgccaatggcaggggccgcgagaaccggcacaaccgggatggtgtcctagaggccaatttgggcagggagagcaaaatgatggcgccggagccggaggaatctggtgtggtagttgacgaaatggttgccaatgggttccaattgttcttcagagagatggagggcctccgcatcagtatgggcagcgaggctgagaagaagagcaggaaagggagtgtgcggagtgccaaaggagtggtggacttgtgcaccttgctcatgcattgtgcacaggctgtggcagtggatgaccgccggagcgcagccgaactgctttggaagattaagcagcactcttctccacggggagatgcgacacaaaggctggcacattatttcgcagaggggttggaggcgcgtctggctggttcaggtagcaaactgtacaattcgctcatggcaaagcgcacctcggctgtggacttcctcaaagcctaccggctgtacgcggcagcctgctgcttccgagtggtggcgttcaagttttccaacatgaccatctgcaagtctattgcagggaggaaaagggtacacattgtggattacggcatacagtatggatcccagtggccaggtttgctgaaatgtttatctatatgcccgggagggccaccggaagtgaggatcactggcattgatcttccccagcctgggttccgtccagcttctcaggtcaaggagacagggcggcggcttagcaattatgcctctcaggtcggcatgccgttcaagtaccgtggcattgcggctaagtgggagacggtaggcgttgatgatttagacatcgaccctgatgaggtactcattgtcaatagcatcctccattttggaaacttgatggacgaaggtatcgacactagtagcccaagcccgagggatgttgttctcagcaacatcaggaagatgcgacctgatgcgttcatccttttcgtcacgaatggcacatatagctcaccgtattttgtacaaaggttccgggaagcgctattccactactctgcaatgtttgacatgatggatgccacgaccccacgggacaatgatctacgcgttctggttgagcgtgatctttttggccagtgtgcccaaaatgtcattgcttgtgaaggcttggacagggtggagcgccctgagacatataagaagtggcaattgcggaaccaccgggcagggctgagacagctgccgttggatccagatattgtcaaggctgtgcaggagagtgtcagggacaagtttcatgaggactttgtcattgatgtggatcgtcagtggctcctgggagggtggaagggacgcatactctatgcaatgtcaacatgggctgctgctgattccatgtcggattcttag

SEQ ID NO: 18101 - protein, 687 aa, Sorghum bicolor
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
  misc_feature: Ceres ANNOT ID no. 8693153
  misc_feature (280)..(588): Pfam ID: GRAS Pfam Description: GRAS family transcription factor
MAASPEVFLPDLEEPFSPSVFLDLPPTPRSDGNGDGKDPASDDIVLPFIERMLMEEGIDEEFLYQYPCHPALLQAQESYAQVLSEPTADSSSDGRLSVSVSSGSDAGVGADDLTADAITASEQSPARLGDAGVRSDERPAQLGYAGTAARSDAAAEEEVEKKANSTMLAVVDGLNSAFFSAQQDGGGKAMFLKGMEEANKFLPRDIDLLRGGSATVIQVNEEESANGRGRENRHNRDGVLEANLGRESKMMAPEPEESGVVVDEMVANGFQLFFREMEGLRISMGSEAEKKSRKGSVRSAKGVVDLCTLLMHCAQAVAVDDRRSAAELLWKIKQHSSPRGDATQRLAHYFAEGLEARLAGSGSKLYNSLMAKRTSAVDFLKAYRLYAAACCFRVVAFKFSNMTICKSIAGRKRVHIVDYGIQYGSQWPGLLKCLSICPGGPPEVRITGIDLPQPGFRPASQVKETGRRLSNYASQVGMPFKYRGIAAKWETVGVDDLDIDPDEVLIVNSILHFGNLMDEGIDTSSPSPRDVVLSNIRKMRPDAFILFVTNGTYSSPYFVQRFREALFHYSAMFDMMDATTPRDNDLRVLVERDLFGQCAQNVIACEGLDRVERPETYKKWQLRNHRAGLRQLPLDPDIVKAVQESVRDKFHEDFVIDVDRQWLLGGWKGRILYAMSTWAAADSMSDS

SEQ ID NO: 18102 - DNA, 2025 bp, Sorghum bicolor
  misc_feature: Ceres ANNOT ID no. 8693157
  misc_feature: Encodes the peptide sequence at SEQ ID NO 18103
atggccgccgcgccggaggacggcgaaccggagcccttctccccgtctgtgttcctcgacctgccaccgactccccgcgtcgaaggggatgacgacgacccgccgttgttgacggacgacctggtgctcccctacatctcgcgcatgctcatggaggaggacatggacgacgacaggttcttctaccactaccccgaccacccggcgctgctccaggcccaacagccctttgccgacatcctctccggctccggctccggctccgccaacgggagcggtacgaccttcacgccatcatcgccatcttcgtcctcctcctatgtcaacgtcgtcgtccccgcgttcgccaccgccacctggccctacgatccgctcgagctcacccagcggctcacggccggtgctgctcaagaagcaggatcccaattctttcagagcacggacaaaggcagtcagagtcgtcatgtccagaacagagtgagcatggaggacatgatcaatcaggccttcctcaagggcatggaagaggccaacaagttgttgcctggcaccagcagcagtagcagcaacaaggatggagcgttactgttcggagaaactaatcatggtcatggtaatagcagaggccgccgcaagaacaggcggcatgatgacttcttggaggaggggggcgagacgggcaggaagagcaagctgatggcgccggagccggaggagaccggcgagatggtcgacaagatggtcatcgacgggtacaacctgtgtgtaaacaaaatgaagaccctgagcatcactacgcccaccaccaaggaggttaataataagaacagcagcaacctcagtacgctgctcatccactgcgcggaggcggtgtccatggacgaccatgccacggcagcccagctgctcgcgcagatcaagaagctgtcgtcgccgagaggggacgcgaaccagaggctggcgtcctgcttcgccgaggggctggaggcacggctagccgggacggggagcacgctgtacagttcgctggtggcgaagcgcagcacctccgtgacggagttcctcaaggcgtaccagctctacctggccgtctcctgcttcaagatgacagcctacaggttctccaacatgaccatcagcaaggccatcgccggcaagaagaagctgcacatcgtcgactacggcgtgctctacggctgccagtggccgaatctgctgcactacctggcgaaccggagaggcgggccgccggaggtgaggatgacctgcatcgacctccccgagcccgggtttcgcccaaccgcgcgagtcgacgagacggggcgtcgactgagcaaattcgcccgccagtgtggtctgccgttcaagttccacggcatcgcagccaagtgggagacggtacgtgccgatgacctcgacattgacgccgacgaggtgctcgtcgtcaacagcatcaacaagtttgagaacctgatggatgaggctggcattgacgacgacatacaccgcccgagccctagggacgtggtgcttcgtaacatccggaagatgatgaggccgccggcggcggcggcggacgtgttcatccactccgtcgtcaattgctcgtacgccacgccattcttcgtagcacggttccgagaggcgctgttccactactcggccatgtttgacatgctggatgcgacggtgtcgcgggacagtgacctgcgcgtggcggtggagcgtgacctcgtcggctggtgcgccctgaatgtcgtcgcctgtgaaggagccgacagggtggagcggccggagacgtatcggcagtggcaggcgcggaaccgcaaggcagggctcaggcagctgccgtttttcccgaatgctgagaagatcctgagggagaagatgaggaacgagtaccacaaggacttcgtcattgacgttgaaaacaattggcttctacaaggctggaagggtcgcatactttatgccatgtccacgtgggctgctgcagatgacaacactatctcatcagaattgtag

SEQ ID NO: 18103 - protein, 674 aa, Sorghum bicolor
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
  misc_feature: Ceres ANNOT ID no. 8693157
  misc_feature (258)..(572): Pfam ID: GRAS Pfam Description: GRAS family transcription factor
MAAAPEDGEPEPFSPSVFLDLPPTPRVEGDDDDPPLLTDDLVLPYISRMLMEEDMDDDRFFYHYPDHPALLQAQQPFADILSGSGSGSANGSGTTFTPSSPSSSSSYVNVVVPAFATATWPYDPLELTQRLTAGAAQEAGSQFFQSTDKGSQSRHVQNRVSMEDMINQAFLKGMEEANKLLPGTSSSSSNKDGALLFGETNHGHGNSRGRRKNRRHDDFLEEGGETGRKSKLMAPEPEETGEMVDKMVIDGYNLCVNKMKTLSITTPTTKEVNNKNSSNLSTLLIHCAEAVSMDDHATAAQLLAQIKKLSSPRGDANQRLASCFAEGLEARLAGTGSTLYSSLVAKRSTSVTEFLKAYQLYLAVSCFKMTAYRFSNMTISKAIAGKKKLHIVDYGVLYGCQWPNLLHYLANRRGGPPEVRMTCIDLPEPGFRPTARVDETGRRLSKFARQCGLPFKFHGIAAKWETVRADDLDIDADEVLVVNSINKFENLMDEAGIDDDIHRPSPRDVVLRNIRKMMRPPAAAADVFIHSVVNCSYATPFFVARFREALFHYSAMFDMLDATVSRDSDLRVAVERDLVGWCALNVVACEGADRVERPETYRQWQARNRKAGLRQLPFFPNAEKILREKMRNEYHKDFVIDVENNWLLQGWKGRILYAMSTWAAADDNTISSEL

SEQ ID NO: 18104 - DNA, 903 bp, Sorghum bicolor
  misc_feature: Ceres ANNOT ID no. 8693184
  misc_feature: Encodes the peptide sequence at SEQ ID NO 18105
atggatcaaacaggcaagtactggggcatgtggggagcaagcagcagcagcagcaccagcaccgcgagccccatctctgcttgggcagcggcgtacggcggcagcagcgaaccgtcgtgggaggagcaggcctttgcgcgtgatgcggcggcgcacctcggcggctgcgtgtggccgccgcgctcttactcgtgcaccttctgccagcgcgagttccggtcggcgcaggcgctcggtggccacatgaacgtccaccgccgtgaccgggctcttctccggcaggggggctcgtcgtcccctgatgacgtgcacgcccccaacgacgatcagtcacacccacagcaaggtgctctcctgtacagggcagcagcagcctctaaccctagcaccactaccacgccgactactactactgcagctgcaggtactactactgccggctcagcagcagccatgggccaggatggggatgccaacaccaccactcctacttcctacttatcaacaattatcaaggagagcaagaacaagctcttcatgcccataccagatcactctgtggcggagatgagagaagatcaggcggccatagatgatcatcagtgtgatcgtcatgacgatggcgacagcgtgcagtcagccaggaaaaagaggaggcgtttggatcatccattggcagcggcggcggcacttctgatctttgtgcagccaacggcaaaggccgctaccgatgtttcacaagaaggaagagctgatcatgagacaaaggtaccacaaatgacaaccccaacaagccctagctctatttcccctcttctggatcaacgacaggaattagatctagagttaaggcttgggactactccaaaagttacatatatggcgatacacaaagctagctag

SEQ ID NO: 18105 - protein, 300 aa, Sorghum bicolor
  misc_feature: Useful for making plants with modulated biomass
  misc_feature: Functional homolog of the protein sequence given in SEQ ID NO 13138
  misc_feature: Ceres ANNOT ID no. 8693184
MDQTGKYWGMWGASSSSSTSTASPISAWAAAYGGSSEPSWEEQAFARDAAAHLGGCVWPPRSYSCTFCQREFRSAQALGGHMNVHRRDRALLRQGGSSSPDDVHAPNDDQSHPQQGALLYRAAAASNPSTTTTPTTTTAAAGTTTAGSAAAMGQDGDANTTTPTSYLSTIIKESKNKLFMPIPDHSVAEMREDQAAIDDHQCDRHDDGDSVQSARKKRRRLDHPLAAAAALLIFVQPTAKAATDVSQEGRADHETKVPQMTTPTSPSSISPLLDQRQELDLELRLGTTPKVTYMAIHKAS

SEQ ID NO: 18106 - DNA, 1422 bp, Sorghum bicolor
  misc_feature: Ceres ANNOT ID no. 8693180
  misc_feature: Encodes the peptide sequence at SEQ ID NO 18107
atggctgctgctttctcctccacctccgtcgtcgtcgctgtgccggtaactacttccacggcggcgaacagcttcctcgggagtaataataataacaagcagaagctcactgtcagcagcatcaggaagaagaagcagcatcagcagggcggcagggggctcatcatcatcagagccatggcggcggtgaacaagcaggaggtggacgagacgaagcagacggagcaggacaggtggaggggcctggcctacgacacgtcggacgaccagcaggacatcaccaggggaaagggcatgatcgactccctcttccaggcgcccatgggggacggcacccacgtcgccgtgctcagctcctacgactacatcagccagggactgaggcaatacaacaccatggatggctactacatcgcccccgcattcatggacaagctcgtccttcacattgccaagaacttcatgaccctgcccaacatcaaggtgcctctgatcctgggtatctggggaggcaagggccaagggaagtccttccaatgtgagcttgtcttcgccaaaatgggcatcaaccccatcgtgatgagcgccggcgagctagagagcggcaacgccggtgagccggcgaagctgatccgtcagcgctaccgtgaggccgcggacctgatctccaagggcaagatgtcctgcctgttcatcaacgatctcgacgccggcgcaggccgcatgggcggcaccacccagtacacggtgaacaaccagatggtgaacgccaccctgatgaacatcgccgacaaccccaccaacgtgcagctcccggggatgtacagcaaggtggacaacccgcgtgtgcccatcatcgtcaccggcaacgacttctccacgctgtacgcgccgctcatccgcgacgggcgcatggacaagttctactgggcgcccacccgcgacgaccgcatcggcgtgtgcaagggcatcttccgcaccgacggcgtccccgacgagcacgtcgtccagctcgtcgacgccttcccgggccagtccatcgacttcttcggcgccctccgcgccagggtatacgacgacgaggtgcgacggtgggtggccgagaccggcgtcgagaacatcgccaggaggctcgtcaactccaaggaggccccgccgacgttcgagcagccgaggatgacgctggacaagctcatggagtacggccgcatgctggaggaggagcaggagaacgtcaagcgcgtgcagctggccgacaagtacctcaccgaggcggcgctcggcgacgccaacgacttctacggcaaggcggcgcagcaggtgcacgtgcccgtgcccgtgccggaggggtgcactgatcccagggccggcaacttcgaccctgtcgccagaagcgacgacggcagctgcgtctataactga

SEQ ID NO: 18107 - protein, 473 aa, Sorghum bicolor
  misc_feature: Useful for making plants with modulated biomass
  misc_feature: Functional homolog of the protein sequence given in SEQ ID NO 13781
  misc_feature: Ceres ANNOT ID no. 8693180
  misc_feature (165)..(363): Pfam ID: AAA Pfam Description: ATPase family associated with various cellular activities (AAA)
MAAAFSSTSVVVAVPVTTSTAANSFLGSNNNNKQKLTVSSIRKKKQHQQGGRGLIIIRAMAAVNKQEVDETKQTEQDRWRGLAYDTSDDQQDITRGKGMIDSLFQAPMGDGTHVAVLSSYDYISQGLRQYNTMDGYYIAPAFMDKLVLHIAKNFMTLPNIKVPLILGIWGGKGQGKSFQCELVFAKMGINPIVMSAGELESGNAGEPAKLIRQRYREAADLISKGKMSCLFINDLDAGAGRMGGTTQYTVNNQMVNATLMNIADNPTNVQLPGMYSKVDNPRVPIIVTGNDFSTLYAPLIRDGRMDKFYWAPTRDDRIGVCKGIFRTDGVPDEHVVQLVDAFPGQSIDFFGALRARVYDDEVRRWVAETGVENIARRLVNSKEAPPTFEQPRMTLDKLMEYGRMLEEEQENVKRVQLADKYLTEAALGDANDFYGKAAQQVHVPVPVPEGCTDPRAGNFDPVARSDDGSCVYN

SEQ ID NO: 18108 - DNA, 2013 bp, Sorghum bicolor
  misc_feature: Ceres ANNOT ID no. 8693300
  misc_feature: Encodes the peptide sequence at SEQ ID NO 18109
atgggtgtgtttttgaaatcatgcaattgctacaagaacttggccggatttccagcgggtctcaggtttaatccgtcagaccaggagctcatagaacacctagagtccatggtgttggcgaaagaaggaggaggctccagagcacacgctctcataaatcacttcataccaaccattgaagaagacattggcatttgctacacccatcctgagaatctccctggtgtgacaagagacggccaaagcaagcatttcttccacaagacatcaaaagcctatccaactagcacaaggacgaggagaaagatcatgtcagagcgcagccagcgcggcagtgaagatgttggggaggcgcgttggcaccggaccggcaatacgcgtccgttgatcgtgggcggtaggcagaaggggttcaaaaagatcctggtattgcacaatgtgaatcatgggaagcgagagaagaccaactgggttatgcaccaataccacctcggcatgagtgaggaggagaaggatggggagctggtcctatccaaggtcttttatcgttgtcctaatacgacaatgatagaacaaaacgatgaaaaggtagagcagcaccaagtgcataggcatgctcaaagtcacagccagtgcaagtttgtacctacaaagatgtttcacgaggctggtgtaggtgacccagtatcaggtgatcacggagtacaagtgcatggcaataatcaccacataccatcgcaacatcatgagcaatcagtgtacatggaacaagatactaccttgtcagtacaggttggtgtaggtgacccagtatcaggtgatcaaggacaagtgcatggcaataatcatcatgacataccatcacaacattatcatgcggaatcagtggacatggaaccagatactaccttgtctttagctctgagtacagtcatggaatatccaaatatgaatcgaagttgtagtgtcctgatgtttgctaatagatttcgtagatatctgattagtggtaaagatgccatgacctcaattggtgatcatggcgtggtagacattgattcctctatttcattagaaacaacatgttatgcaatggcttgtttccatgggactggtgcgcagcattggaatcagctaatagatgaaggaatctcacgcactcacagctgcgcactagtcatcaaggatttccagccggtgtcaagtttgctccatcggaccaggccggagctcatagagcacctagagtccatggtgttggtgaaggaacaaggaggctccagagcacacgctctcataaatcacttcataccaaccattgaaggagacattggcatttgctacacctatcctaagaatctccctggtgtgacaagagatggccatagcaggcatttcttccacaggacaacaaaagcctatccaactagcacaaggacgaggagaaagatcatgtcagagcatggccagtgcagcagtgaagatgttggggaagcgcattggcaccggaccggcaatacgcgtccggtgaatgtgggctgtaagcagaaggggttcataaagattctggtattgcacaatgtgaagcatgtcttctatcattgtcctgatacgacaatgatagaacataacgatgaaaaggtagaggtaacctcagaggcaacaccaaatatcctccctatctctggtgctgcagcagtcactacagctactatcaccatggtgcaaatgcagcagcaccaagtgcagaggcggcatgctcacagtcacggccagtgcaagtttgcacctgccaagatgtttcaggagtataacaacagtataaacatatgtgtcaggatttgttctatatcatgtgcgacaagaggtggcctcagcaagcatttcttccacaagacatccaaggcctatccaactggcacaaggaagaggagaaagatccagtcagagcgcggccagcacagaagtgaagatgttggggaggcgcattggcatttgcaaaaacattattaa

SEQ ID NO: 18109 - protein, 670 aa, Sorghum bicolor
  misc_feature: Useful for making plants with altered carbohydrate content
  misc_feature: Functional homolog of the protein sequence given in SEQ ID NO 14394
  misc_feature: The sequence is a functional homolog of SEQ ID NO 562 in the 11/435,388 US patent application
  misc_feature: Ceres ANNOT ID no. 8693300
  misc_feature (17)..(165): Pfam ID: NAM Pfam Description: No apical meristem (NAM) protein
  misc_feature (403)..(536): Pfam ID: NAM Pfam Description: No apical meristem (NAM) protein
MGVFLKSCNCYKNLAGFPAGLRFNPSDQELIEHLESMVLAKEGGGSRAHALINHFIPTIEEDIGICYTHPENLPGVTRDGQSKHFFHKTSKAYPTSTRTRRKIMSERSQRGSEDVGEARWHRTGNTRPLIVGGRQKGFKKILVLHNVNHGKREKTNWVMHQYHLGMSEEEKDGELVLSKVFYRCPNTTMIEQNDEKVEQHQVHRHAQSHSQCKFVPTKMFHEAGVGDPVSGDHGVQVHGNNHHIPSQHHEQSVYMEQDTTLSVQVGVGDPVSGDQGQVHGNNHHDIPSQHYHAESVDMEPDTTLSLALSTVMEYPNMNRSCSVLMFANRFRRYLISGKDAMTSIGDHGVVDIDSSISLETTCYAMACFHGTGAQHWNQLIDEGISRTHSCALVIKDFQPVSSLLHRTRPELIEHLESMVLVKEQGGSRAHALINHFIPTIEGDIGICYTYPKNLPGVTRDGHSRHFFHRTTKAYPTSTRTRRKIMSEHGQCSSEDVGEAHWHRTGNTRPVNVGCKQKGFIKILVLHNVKHVFYHCPDTTMIEHNDEKVEVTSEATPNILPISGAAAVTTATITMVQMQQHQVQRRHAHSHGQCKFAPAKMFQEYNNSINICVRICSISCATRGGLSKHFFHKTSKAYPTGTRKRRKIQSERGQHRSEDVGEAHWHLQKHY

SEQ ID NO: 18110 - DNA, 1110 bp, Sorghum bicolor
  misc_feature: Ceres ANNOT ID no. 8693299
  misc_feature: Encodes the peptide sequence at SEQ ID NO 18111
atgtcttctcatcatcaatatcctttcttgttcaggggagattcaagcgccacgaacggcagcaacgacaccgaagccacagcttccctcgcctgccctaactgcaatctgaatttggctggatttccagccggtgtcaagtttgctccatcggaccaggagctcatagagcacctagagtccatggtgttggtgaaggaaggaggaggctccagagcacaccctctcttaagtcacttcatatcaaccattgaaggaggcaatgacatttgctacacccatcctgaaaatctccccggtgtggcaaaagatggcctcagcaagcatttcttccacaagacatccaaggcctatccaactggcacaagaaagaggagaaagatccagtcagagcgcggccagcgcagcagtgaagatgctggggaggcgcattggcacaaaactggcaggacacatgctgtgattgtgggcggtaggcagaaggggtgcaaaaagattctggtgttgcacaatatcaagcaagggatgcgggagaagaccaactggattatgcaccaataccacctcggcatgagcgatgccgatgacgagaaggatggggagctggtcctgtccaaggtcttttatcgttgccctgatgcaacaatggtagaagtagaacataacaatgaaaaggtagaggtgacctcagaggcgacatcaaatatccttcgtgtctctggtgctgcggcggtcactgcagctactgtcaacatggtgcaacagcagcagcaccgaccgcagaggcaggctcatggtcaggatcagtgcaagtttgcacctccaaacatgtttcaggaggctggtgtaggtgagctggtttcaggtgatcaaggacaagtgcatgacaataatcaccacataccatcacaacatcttgtccaatcagtgcacatggaaccagatactaccttgtcgttacaggttggtgtaggtgacccggtatcaggtgatcaaggacaagtgcatggaaataatcaccacataccatcgcaaaatcatgtccaatcagtggacacggaaccagttactacattatctttagctctcagtgcaggttggtgtaagtga

SEQ ID NO: 18111 - protein, 369 aa, Sorghum bicolor
  misc_feature: Useful for making plants with altered carbohydrate content
  misc_feature: Functional homolog of the protein sequence given in SEQ ID NO 14394
  misc_feature: The sequence is a functional homolog of SEQ ID NO 210 in the 10/666,642 US patent application
  misc_feature: The sequence is a functional homolog of SEQ ID NO 562 in the 11/435,388 US patent application
  misc_feature: Ceres ANNOT ID no. 8693299
  misc_feature (42)..(190): Pfam ID: NAM Pfam Description: No apical meristem (NAM) protein
MSSHHQYPFLFRGDSSATNGSNDTEATASLACPNCNLNLAGFPAGVKFAPSDQELIEHLESMVLVKEGGGSRAHPLLSHFISTIEGGNDICYTHPENLPGVAKDGLSKHFFHKTSKAYPTGTRKRRKIQSERGQRSSEDAGEAHWHKTGRTHAVIVGGRQKGCKKILVLHNIKQGMREKTNWIMHQYHLGMSDADDEKDGELVLSKVFYRCPDATMVEVEHNNEKVEVTSEATSNILRVSGAAAVTAATVNMVQQQQHRPQRQAHGQDQCKFAPPNMFQEAGVGELVSGDQGQVHDNNHHIPSQHLVQSVHMEPDTTLSLQVGVGDPVSGDQGQVHGNNHHIPSQNHVQSVDTEPVTTLSLALSAGWCK

SEQ ID NO: 18112 - DNA, 2052 bp, Sorghum bicolor
  misc_feature: Ceres ANNOT ID no. 8693422
  misc_feature: Encodes the peptide sequence at SEQ ID NO 18113
atggcgtcgttctgggatatgctagggaaggcggcaagcgtgatgcagctgacaggcgttgatgcgttcggtatggtgtcgatgattatccaggcggcacgcaccgcgcggcgcaacagggatctttgccagcagctggcgaagaaggtggagatcgtcagcggcctgctcgaggagctcaatatcccggagctgcggcggcaccgcaagacgcggcggccgctggacgagctgcgctccgcgctcttccgtgggtacgtgctcgtgtggtcctgcagccagcaacaacagggcgcgagccagttctggcagatgttcatggccggcgacatggcagccatgcttcggcaggccaaagacgagatcgacagctacatcatcctcatccccttgataaccaccgttgcctccatcagagcacgggacagcaagatcaatgaggcagccccagcccgaagaaggcctcagttatccattcaagaagctacttattctccttcatcttccagtcaagaagtgtcacattcgagtgaacttgaggagaaactgtcatggcccaatggtgtttttccccaaaacgacgaaccctcacagagtcaatccagtcatgcctcagttagctactgggaacaagatcgtttgtcggagctggtgtcgatgatggtgcaaagcgcagacaccgcacgccacaacagggatccgtgccagcagctggctcgtcaagccctcatcgtcagcaaccagctccaggggccgctgggggcaccacagaggctgcggctggagcagctggaagacctgctcttccgtggatacatgctcatatgcttctgcagccagtacagcagaagccaactccagctcatgttcacaggagccgatgtggcctctgtgtttcagctagcgcaacaggagattggccgtcaaatctaccacctcaccagccgtgttcctgcccagcaggaggaacacgacgacgtgagcaataattctgaccaatggcggacaacattaagcatatatggggaactgccgtcaacaggtgctgcgcatcaatccatgtccaggctggcacctcatggctatcgaattccttttgttgtgctacaagaggcaacaaataacttcgatgagaagatggtcattggagttggagggtttggaaaggtctacagaggagtgatgcaggatggcaccaaaatcgcagtaaagcagggcaaggctaaccagatgtctggacaagggttgacgctcctgggttactgcaacgagcacaacgagatgatcttggtgtatgagtacatggagaacggcactctgaggtgccatctttatggcacaagtctgccacctcttagctggaggcaaagactggaaatatgcataggagctgcaagaggcctccactatcttcacaccggtgctaaaaacacaatcatccatcgtgatgtcaagtcaacaaacattcttcttggtgaccatctgttggccaaagtttctgacttcggcctctcaaaggttggcgctgatactgatcaaacgcacgtaagcacgacagtcaaagggacctttggttatcttgatccagagtacttcaggactcagcagctgacagacaagtcagatgtatactcatttggtgtagttctgcttgaggtgatctgtgcaaggccagccatagtacaaactcttccaagagaaaaggttaaccttgtagagtggggtatggcgtgtcataagagaggagaacttcatcagatcattgatccacatcttgtcgggaaaatcatgcccatagcattgagcaagtatggtgagacggttggtaaatgcctctctgattatggagtggaccgtcctacaatggcagatgtactatggaacctggaattcgtgctgcagctgcaggagtcaggggaagaaaactccaacattcacatggataacgagacaggccaagacgacaactccaacatgaccatgactaacgacaactccaacacgaccatgactaacacctcaatacagacaatggaagatgaactgccttga

SEQ ID NO: 18113 - protein, 683 aa, Sorghum bicolor
  misc_feature: Useful for making plants with modulated biotic stress sensitivity
  misc_feature: Functional homolog of the protein sequence given in SEQ ID NO 14099
  misc_feature: Ceres ANNOT ID no. 8693422
  misc_feature (418)..(641): SWISSPROT Homolog: EC 2.7.11.1 Non-specific serine/threonine protein kinase
  misc_feature (376)..(632): Pfam ID: Pkinase Pfam Description: Protein kinase domain
MASFWDMLGKAASVMQLTGVDAFGMVSMIIQAARTARRNRDLCQQLAKKVEIVSGLLEELNIPELRRHRKTRRPLDELRSALFRGYVLVWSCSQQQQGASQFWQMFMAGDMAAMLRQAKDEIDSYIILIPLITTVASIRARDSKINEAAPARRRPQLSIQEATYSPSSSSQEVSHSSELEEKLSWPNGVFPQNDEPSQSQSSHASVSYWEQDRLSELVSMMVQSADTARHNRDPCQQLARQALIVSNQLQGPLGAPQRLRLEQLEDLLFRGYMLICFCSQYSRSQLQLMFTGADVASVFQLAQQEIGRQIYHLTSRVPAQQEEHDDVSNNSDQWRTTLSIYGELPSTGAAHQSMSRLAPHGYRIPFVVLQEATNNFDEKMVIGVGGFGKVYRGVMQDGTKIAVKQGKANQMSGQGLTLLGYCNEHNEMILVYEYMENGTLRCHLYGTSLPPLSWRQRLEICIGAARGLHYLHTGAKNTIIHRDVKSTNILLGDHLLAKVSDFGLSKVGADTDQTHVSTTVKGTFGYLDPEYFRTQQLTDKSDVYSFGVVLLEVICARPAIVQTLPREKVNLVEWGMACHKRGELHQIIDPHLVGKIMPIALSKYGETVGKCLSDYGVDRPTMADVLWNLEFVLQLQESGEENSNIHMDNETGQDDNSNMTMTNDNSNTTMTNTSIQTMEDELP

SEQ ID NO: 18114 - DNA, 915 bp, Sorghum bicolor
  misc_feature: Ceres ANNOT ID no. 8693431
  misc_feature: Encodes the peptide sequence at SEQ ID NO 18115
atggagagcagaaggcagtgggggaaggcgcaccaggaggcggtgggcggaggcggaggcggcggtcaccgagtggatctagatgaagaggatgacctggaggagttccggctgcccatgagccaccgccctactgagaacctcgacacggaggggcttgagcaggcctctgtccacacccagctcaccgcgtccaacgtcggctttaggctcctgcagaagatgggctggaagaccggcaaggggctcggcaagaacgaacaaggtatactagagccaataagagctgacatcagagatgcaaaattaggtgttgggaagcaagaggaagatgacttcttcacatctgaagagaacgtgcaacgaaagaaattgaatattgaacttgaggagactgaggaacatataaagaaacgtgaggtcatagcagagcgtgagcacaaaatccgcagtgaagtcaaggagatacagaaggtgttcttttgcaacctctgcaataagcagtacaagctggctcatgaatttgagagtcacttgagctcatatgaccacaatcataggaagaggttcaaagaaatgagagaaatgcagagcagcagtggtagccgtgatgacaggcagaaacgtgaacaacagcgagaagagaaggagctggcaaaaattgcgcaacttgcggatgctcataggaagcagcagcagcagcagcatcaggagaaacaagaaaagtcagagacagaagttgttgcaccaaaaaacatggcagcccctagaaaccaggatcagcgaggaaccttgaagtttggattctccaaaatggctccttccaaggttcaagttggcaatgccagcaagaagccaaaggtggctacaaaagtttcttcggtcttcggcaatgagagtgacgaggactcgtga

SEQ ID NO: 18115 - protein, 304 aa, Sorghum bicolor
  misc_feature: Useful for making plants with altered lignin content
  misc_feature: Useful for making plants with altered terpenoid content
  misc_feature: Functional homolog of the protein sequence given in SEQ ID NO 14598
  misc_feature: Ceres ANNOT ID no. 8693431
  misc_feature (64)..(108): Pfam ID: G-patch Pfam Description: G-patch domain
MESRRQWGKAHQEAVGGGGGGGHRVDLDEEDDLEEFRLPMSHRPTENLDTEGLEQASVHTQLTASNVGFRLLQKMGWKTGKGLGKNEQGILEPIRADIRDAKLGVGKQEEDDFFTSEENVQRKKLNIELEETEEHIKKREVIAEREHKIRSEVKEIQKVFFCNLCNKQYKLAHEFESHLSSYDHNHRKRFKEMREMQSSSGSRDDRQKREQQREEKELAKIAQLADAHRKQQQQQHQEKQEKSETEVVAPKNMAAPRNQDQRGTLKFGFSKMAPSKVQVGNASKKPKVATKVSSVFGNESDEDS

SEQ ID NO: 18116 - DNA, 978 bp, Sorghum bicolor
  misc_feature: Ceres ANNOT ID no. 8693466
  misc_feature: Encodes the peptide sequence at SEQ ID NO 18117
atggttgggaagcatgtgggctcaaaggtaaaagcaagcccagcccatccgaatttctcgaaaaaaaaaggtaaagcccaccgaaccgacctaataactgctctcgtcgcccccaaactgcagaggagaggagagaagagaagagaagagaagcaccgcgtcgccgaaaccctagccgcctgtctcgctctccgggttttctgtgggtgtgggggaatttgttcgtcgccgactcgccggcagcacaagatgaggccggtcttcgtggggaacctggactatgacacccgccactcggagctcgaccaactcttctaccgctacggcagggtcgagcgcatcgacatgaagtcaggcttcgcttttgtctactttgaggatgaacgtgatggcaatgatgccatacgggctcttgatggttatccatttggccctggcagacgcaggctttcagtagagtggtcacggggtgatcgagctgctagacgtgatggtaacaaaccagaagcaaatactaagccaactaggacattgtttgtcatcaactttgatccaatcaacacaagggtcagtgacattgaaaggcacttcgcaccatttgggaacttatcaagtgtaaggataaggaagaactttgctttcgtccagtttgaaacactggaagaagccagaaaggctcttgatgctactcatgctaccacgcttttggacagggtgatttctgttgagtacgcctttagggatgatagtgaacggagtgataggtacgacagcccaagaagaggtggtggctatggtaggcgtggtgatagcccagtgtacaggtcacggcctagtccagactatggtcgcccagcaagtcctgtatatggttcatatgacagaagtcctgttcgtgatcgctatcggaggctgcagttttcagcttactgctgccctttagtatttttacttgttagggcttgtcttgttatctaa

SEQ ID NO: 18117 - protein, 325 aa, Sorghum bicolor
  misc_feature: Useful for making plants with modulated biomass
  misc_feature: Functional homolog of the protein sequence given in SEQ ID NO 12876
  misc_feature: Ceres ANNOT ID no. 8693466
  misc_feature (87)..(152): Pfam ID: RRM_1 Pfam Description: RNA recognition motif. (a.k.a. RRM, RBD, or RNP domain)
  misc_feature (178)..(242): Pfam ID: RRM_1 Pfam Description: RNA recognition motif. (a.k.a. RRM, RBD, or RNP domain)
MVGKHVGSKVKASPAHPNFSKKKGKAHRTDLITALVAPKLQRRGEKRREEKHRVAETLAACLALRVFCGCGGICSSPTRRQHKMRPVFVGNLDYDTRHSELDQLFYRYGRVERIDMKSGFAFVYFEDERDGNDAIRALDGYPFGPGRRRLSVEWSRGDRAARRDGNKPEANTKPTRTLFVINFDPINTRVSDIERHFAPFGNLSSVRIRKNFAFVQFETLEEARKALDATHATTLLDRVISVEYAFRDDSERSDRYDSPRRGGGYGRRGDSPVYRSRPSPDYGRPASPVYGSYDRSPVRDRYRRLQFSAYCCPLVFLLVRACLVI

SEQ ID NO: 18118 - DNA, 588 bp, Sorghum bicolor
  misc_feature: Ceres ANNOT ID no. 8693479
  misc_feature: Encodes the peptide sequence at SEQ ID NO 18119
atggcctcctatcaatcaatagcacccgtgctttgcatgctagctctcctcttttatggaggaaatgcactccaccatgacagtgtgttgaaaaccaccctatacataaaacagtcttttgccaaagatcaaagaactttgggcgatggtaccgtcattattaactggcccataaaggatgggccaggtgctgctgccaataccattgggcatgcagagggcttgacaacactagcaaatgaacccagtcatttctgggtaaccataatggacatggtcttcgaccgagggagccatgcgggatcctcacttcaagtgatggggcttcatggttccaaaaaggatctgccacagagtcagtggagtgttatggggggcactggacaacttaccatggcgcggggtattatcaagtacaacataacccaagaagatagttctagtaggaccttcgaattatacatatacgtgtactacactaccattctggtctttgccgagggtcaggctagccctcgacaaagatttttttattatttttttattttttgcctagtttttttttggggctacaatacattattttaa

SEQ ID NO: 18119 - protein, 195 aa, Sorghum bicolor
  misc_feature: Useful for making plants with modulated flowering time
  misc_feature: Functional homolog of the protein sequence given in SEQ ID NO 14599
  misc_feature: Ceres ANNOT ID no. 8693479
  misc_feature (12)..(157): Pfam ID: Dirigent Pfam Description: Dirigent-like protein
MASYQSIAPVLCMLALLFYGGNALHHDSVLKTTLYIKQSFAKDQRTLGDGTVIINWPIKDGPGAAANTIGHAEGLTTLANEPSHFWVTIMDMVFDRGSHAGSSLQVMGLHGSKKDLPQSQWSVMGGTGQLTMARGIIKYNITQEDSSSRTFELYIYVYYTTILVFAEGQASPRQRFFYYFFIFCLVFFWGYNTLF

SEQ ID NO: 18120 - DNA, 444 bp, Sorghum bicolor
  misc_feature: Ceres ANNOT ID no. 8693478
  misc_feature: Encodes the peptide sequence at SEQ ID NO 18121
atggcctcctgtcactcaatagcacctgtgctttgcatgctagctttcctgttttatgggggaaatgcactccatgatagtgtgttgaaaaccaccttatacataaaacagtcttttgtccaagatcaaaggcctttgagcaatggtaccgtcattattaactggcccataaagaatgggccagctgctgctgccaataccattgggcatgcagagggcttgacaacactagcaaatgaacccagtcatttctgggtaaccataatggacatggtcttcgaccaagggagccatgctggatcctcacttcaagtgatggggcttcatggttccaaaaaggatctgccacagagccagtggagcgttatgggggggcactggacaacataccatggcacggggtattatcaactacaacataacccaagaggacagttctcgtag

SEQ ID NO: 18121 - protein, 147 aa, Sorghum bicolor
  misc_feature: Useful for making plants with modulated flowering time
  misc_feature: Functional homolog of the protein sequence given in SEQ ID NO 14599
  misc_feature: Ceres ANNOT ID no. 8693478
MASCHSIAPVLCMLAFLFYGGNALHDSVLKTTLYIKQSFVQDQRPLSNGTVIINWPIKNGPAAAANTIGHAEGLTTLANEPSHFWVTIMDMVFDQGSHAGSSLQVMGLHGSKKDLPQSQWSVMGGHWTTYHGTGYYQLQHNPRGQFS

SEQ ID NO: 18122 - DNA, 477 bp, Sorghum bicolor
  misc_feature: Ceres ANNOT ID no. 8693490
  misc_feature: Encodes the peptide sequence at SEQ ID NO 18123
atggcctcctatcaggcaatagtagctctgctttgcatgctagctttctccttttttgggggaaataatgcactcgatgaatgtgtgttggaaaccaccctatacataatacaatcacctgcccaagatcaaagacctttaggcactgataccgtcattattaattggcctataaaggatggtccaggtgctgctgccaataccattgggcatgcagagggcttgacgacctttgcaaatcacgctagtggttcgtgggtaaccataatggacttggtgtttgagggaggcagccttgctggatcgtcacttcaagttatggggcttcatggttccaaaaatgatcaatggagcgttatggggggcactagacaacttaccatggcacggggtattatcaactacaatataacccaatctaccagtgctagtaggaccttcgaagtatacatatatgtgtactacacttccctgtga

SEQ ID NO: 18123 - protein, 158 aa, Sorghum bicolor
  misc_feature: Useful for making plants with modulated flowering time
  misc_feature: Functional homolog of the protein sequence given in SEQ ID NO 14599
  misc_feature: Ceres ANNOT ID no. 8693490
  misc_feature (5)..(153): Pfam ID: Dirigent Pfam Description: Dirigent-like protein
MASYQAIVALLCMLAFSFFGGNNALDECVLETTLYIIQSPAQDQRPLGTDTVIINWPIKDGPGAAANTIGHAEGLTTFANHASGSWVTIMDLVFEGGSLAGSSLQVMGLHGSKNDQWSVMGGTRQLTMARGIINYNITQSTSASRTFEVYIYVYYTSL

SEQ ID NO: 18124 - DNA, 1089 bp, Sorghum bicolor
  misc_feature: Ceres ANNOT ID no. 8693554
  misc_feature: Encodes the peptide sequence at SEQ ID NO 18125
atggaggtgacaccaaaccacacgcagaccgtcgccggatgggccgccatgaacgagtccggcaagctcgagcccttcatcttcaagagaagggagaacggcgtggacgacgtgacgatcaaggtggagtactgcggcatgtgccacacggacctgcacttcatccaaaacgactggggcatcaccatgtacccactggtgccaggccacgagatcacgggcgtggtcaccaaggtgggcagcaacgtgaccggcttcggcgtcggcgaccgtgtcggcgtgggctgcatcgccgcctcctgcctcgactgcgaccactgccgccggtccgaggagaactactgcgacaaggtgacgctcacctacaacggcgtcttcccggacggcagcgtcacctacggcggctactcgaagatgctcgtggcgcacaagcggttcgtggtgcgcgttccggacacgctcccgctcgacgccgcggcgccgctgctgtgcgcggggatcaccgtgtacagccccatgaagcaccacggcatgctgcgatccgccggggcgagcctgggcgtggtagggctgggtggactcggccatgtcgccgtcaagttcgccaaggcgttcggtctccgcgtcaccgtcgtcagcacgtcgccggcgaaggagaaggaggcgagggagcggcttggcgccgacgacttcgtcgtcagcagcgaccagaagcagatgcaggccatggcgagaagcctcgactacgtcatcgacaccgtctcggcgaagcattccttgggacctatcttggagctgctcaaggtgaacggcaagctcgtgctcgtcgcggcgccggaccagcccgtcgagctgccgtcgttcccgctcatctttgggaagaggacggtgagtgggagcatgacgggagggatgaaggagacgcaggagatgctggacctgtgtggacagcacggcatcacctgtgatatcgagctcgtctccaccgacgggatcaatgacgcgctccagcgcctcgcaagcaacgacgtccgctaccgcttcgtcatcgacatcgccggcggcgactcgtcaaactcgaagctctag

SEQ ID NO: 18125 - protein, 362 aa, Sorghum bicolor
  misc_feature: Useful for making plants with altered cell wall content and/or composition
  misc_feature: Functional homolog of the protein sequence given in SEQ ID NO 14307
  misc_feature: The sequence is a functional homolog of SEQ ID NO 2 in US patent 7288696
  misc_feature: Ceres ANNOT ID no. 8693554
  misc_feature (7)..(353): SWISSPROT Homolog: EC 1.1.1.255 Mannitol dehydrogenase
  misc_feature (182)..(317): Pfam ID: ADH_zinc_N Pfam Description: Zinc-binding dehydrogenase
  misc_feature (35)..(150): Pfam ID: ADH_N Pfam Description: Alcohol dehydrogenase GroES-like domain
MEVTPNHTQTVAGWAAMNESGKLEPFIFKRRENGVDDVTIKVEYCGMCHTDLHFIQNDWGITMYPLVPGHEITGVVTKVGSNVTGFGVGDRVGVGCIAASCLDCDHCRRSEENYCDKVTLTYNGVFPDGSVTYGGYSKMLVAHKRFVVRVPDTLPLDAAAPLLCAGITVYSPMKHHGMLRSAGASLGVVGLGGLGHVAVKFAKAFGLRVTVVSTSPAKEKEARERLGADDFVVSSDQKQMQAMARSLDYVIDTVSAKHSLGPILELLKVNGKLVLVAAPDQPVELPSFPLIFGKRTVSGSMTGGMKETQEMLDLCGQHGITCDIELVSTDGINDALQRLASNDVRYRFVIDIAGGDSSNSKL

SEQ ID NO: 18126 - DNA, 474 bp, Sorghum bicolor
  misc_feature: Ceres ANNOT ID no. 8693684
  misc_feature: Encodes the peptide sequence at SEQ ID NO 18127
atggcgcagtgcccgtgtttcggctggtcggcgcaggcggcggaggcggagcggtgtgagtcacaggacgcccgcgccaaggccgcgaagcggaggttcgggcttggggaagacactactgctgcaaccatgagcaccatgaagttttgccgtgagtgcaacaacatcctgtaccccaaggaggacagggacaggcgcaccctatacttcgcatgtcgcaactgcgagcaccaggaggtctctgacaataactgtgtctatcggaacgaagtgcaccacacggccggcgagcgtacacaggtcttgcaggatgtagcttctgacccaactcttcccagaaccaagactgtccgctgcaatgcctgtgggcatggagaggctgttttcttccaggccacggcaagaggggaggaggggatgaccctgttctttgtgtgctgcagccctgattgtggtaatcggtggagggaatga

SEQ ID NO: 18127 - protein, 157 aa, Sorghum bicolor
  misc_feature: Useful for making plants with altered lignin content
  misc_feature: Functional homolog of the protein sequence given in SEQ ID NO 12917
  misc_feature: Ceres ANNOT ID no. 8693684
  misc_feature (47)..(156): SWISSPROT Homolog: EC 2.7.7.6 DNA-directed RNA polymerase
  misc_feature (47)..(101): Pfam ID: RNA_POL_M_15KD Pfam Description: RNA polymerases M/15 Kd subunit
MAQCPCFGWSAQAAEAERCESQDARAKAAKRRFGLGEDTTAATMSTMKFCRECNNILYPKEDRDRRTLYFACRNCEHQEVSDNNCVYRNEVHHTAGERTQVLQDVASDPTLPRTKTVRCNACGHGEAVFFQATARGEEGMTLFFVCCSPDCGNRWRE

SEQ ID NO: 18128 - DNA, 690 bp, Sorghum bicolor
  misc_feature: Ceres ANNOT ID no. 8693699
  misc_feature: Encodes the peptide sequence at SEQ ID NO 18129
atggcctcctcgtcttcctccttgctcctccttgcagcggccctccttgcgctagtagcctcttggcagcaggccatcgcctacgatcctagccctctccaggacttctgtgttgcagacaagaactcgcctgttcgtgtcaatgggtttccttgcaaggacccaatggccgtgaccccggacgacttcttcaacccagccatgatcatcgacaagcgcagggacaccaacaacaaggtgggatccaacgtcaccaacatcaacgtggagagcttcccgggcctcaacaccctgggcatctcgctagcgcgcatcgactacgcgcccctaggcgtgaacccaccccacatccacccccgcgccaccgagcttctcaccgtgctcgagggaaccctttaccttggcttcgtcacgtccaaccccaataggctcttctccaaggtggttaagaagggtgatgtctttgtcttccccaaagccatgatccacttccagatgaacctcgaccatgagaagccagcgacggccttgtcatcgctcagcagccaaaaccctggtgttattacgatcgctagcgcggtgtttggatcaaaaccaccgatctcagatgatgttttggccaaggctttccaggtggaaaagaaactcatagactggctccagtctcagttctgggataccaactactag

SEQ ID NO: 18129 - protein, 229 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8693699
  misc_feature (27)..(224): SWISSPROT Homolog: EC 1.15.1.1 Superoxide dismutase
  misc_feature (68)..(218): Pfam ID: Cupin_1 Pfam Description: Cupin
MASSSSSLLLLAAALLALVASWQQAIAYDPSPLQDFCVADKNSPVRVNGFPCKDPMAVTPDDFFNPAMIIDKRRDTNNKVGSNVTNINVESFPGLNTLGISLARIDYAPLGVNPPHIHPRATELLTVLEGTLYLGFVTSNPNRLFSKVVKKGDVFVFPKAMIHFQMNLDHEKPATALSSLSSQNPGVITIASAVFGSKPPISDDVLAKAFQVEKKLIDWLQSQFWDTNY

SEQ ID NO: 18130 - DNA, 411 bp, Sorghum bicolor
  misc_feature: Ceres ANNOT ID no. 8693758
  misc_feature: Encodes the peptide sequence at SEQ ID NO 18131
atggccatgagctacttccgggcgccgagacggctctacgggaggaagcagcaccagcagcagaagcgggagagtgcagccctgctggtggacgaggacggcggcgacgaccaaggcgaggcggcggcggcggcgggcgcggtgcccaagggctacttcgccgtgtacgtgggcgccgagtcccggcggttcgtggtgcccacgagctacctcagcgagccggcgttccgggagctcatggagcgcgccgcggaggagttcggcttcaaccaggccggcggcctccgcatcccctgccgcgaggaggacttccaggccaccgtcgccgctctcgagcagtccaggcgtcgcggcgccggctgggcgcgagggtcggccgccggaacaacgcgatgggctcgtgccagctag

SEQ ID NO: 18131 - protein, 136 aa, Sorghum bicolor
  misc_feature: Useful for making plants with modulated cold sensitivity
  misc_feature: Useful for making plants with modulated salt sensitivity
  misc_feature: Functional homolog of the protein sequence given in SEQ ID NO 13813
  misc_feature: Ceres ANNOT ID no. 8693758
  misc_feature (8)..(112): Pfam ID: Auxin_inducible Pfam Description: Auxin responsive protein
MAMSYFRAPRRLYGRKQHQQQKRESAALLVDEDGGDDQGEAAAAAGAVPKGYFAVYVGAESRRFVVPTSYLSEPAFRELMERAAEEFGFNQAGGLRIPCREEDFQATVAALEQSRRRGAGWARGSAAGTTRWARAS

SEQ ID NO: 18132 - DNA, 135 bp, Sorghum bicolor
  misc_feature: Ceres ANNOT ID no. 8693782
  misc_feature: Encodes the peptide sequence at SEQ ID NO 18133
atggagcgcatggtggtgccaggctgcatcctgtgtgggaggaaagacaaggccgagggtgtcgctgctatggcgctctgcgtcaagcaggagcacgcggaggccttccatgcggagctgcgaagcctcaagtga

SEQ ID NO: 18133 - protein, 44 aa, Sorghum bicolor
  misc_feature: Useful for making plants with altered carbohydrate content
  misc_feature: Functional homolog of the protein sequence given in SEQ ID NO 13775
  misc_feature: Ceres ANNOT ID no. 8693782
MERMVVPGCILCGRKDKAEGVAAMALCVKQEHAEAFHAELRSLK

SEQ ID NO: 18134 - DNA, 1287 bp, Sorghum bicolor
  misc_feature: Ceres ANNOT ID no. 8693787
  misc_feature: Encodes the peptide sequence at SEQ ID NO 18135
atgagctcgcgcgtcaccaagtcgctgccttttctcgtcgtcccgtcggaggccacgcccgccggcgtcctccccctcaccgccatggacagagctcttgcttccctgcccatggcagccctgcttgtcttcgagaaccccatcgatcagccagccgagagcatcaggagagctctgtcccgagcgcttgttctctactacccaatggccggccgcctcaccatcaccggcgaccagctgaaaatcgcgtgcaccggcgagggcgtggcgttcgttggggcgtccgcgagctgcacgctgcagcagggcagactcttcggcccgcatccggtggtcaccgtcgaggacctcactatgaactacaccgcccagtacagtacggacccgccgttgctgctggtgcaggtgaccgagttctcctgtggtggcttcgtcgtcggggtgacgtggaaccacgtcgtcaccgacggcgccgggatggcgcagttcttgcaggccgtcggcgagtatgcccgcggcttccgttccccttccatcttgccggtgagggtggaccacgccctccctgagcttcccccgccgataaccaccatgaccaaggcactcgtctgcagccagcacagcgacttcccgtcctcctacatcactgttccccttagcttcatcgaccgcgtcaaggacgagttccgtcgtcgtcgtcacagcagcagcggcggcggacagatggcgccggcgtcttgcaccgcgttcgacgtcttcaccgccaccctatggaagtgtcgtacgcgcgcgacgatcgccagcgccgccagccaggacgcgcccacggcgctcgccttcacagtgaacgtgaggaagccggcgaaggccaaggatggctactacggcaacgtcttcgccttcggccttgctgcctcgacgctgcgtgaggtcgccgacggcgacatcctggacctcgtgaggctggtaaaggacgccaaggcaagggtcccatacatgtttgctgatggagcggcgtacatcgccgacgagatgagcggccggctaaatggcctcgacggttatgacaccctgtacgtgaccagctggtggaatctcggcttggacgacgtcgacttcggcagcggcggcgctgaacgtgtcatcgggaacatggagcgcaaggtggtgccaggctgcatcctgtgtgggaggaaggacaaggccgagggtgtcgccgccatggcgctctgtgtcaagcaggagcacgcggagaccttccatgcggagctgcaaagcctcaagtga

SEQ ID NO: 18135 - protein, 428 aa, Sorghum bicolor
  misc_feature: Useful for making plants with altered carbohydrate content
  misc_feature: Functional homolog of the protein sequence given in SEQ ID NO 13775
  misc_feature: Ceres ANNOT ID no. 8693787
  misc_feature (5)..(427): SWISSPROT Homolog: EC 2.3.1.167 10-deacetylbaccatin III 10-O-acetyltransferase
  misc_feature (3)..(427): Pfam ID: Transferase Pfam Description: Transferase family
MSSRVTKSLPFLVVPSEATPAGVLPLTAMDRALASLPMAALLVFENPIDQPAESIRRALSRALVLYYPMAGRLTITGDQLKIACTGEGVAFVGASASCTLQQGRLFGPHPVVTVEDLTMNYTAQYSTDPPLLLVQVTEFSCGGFVVGVTWNHVVTDGAGMAQFLQAVGEYARGFRSPSILPVRVDHALPELPPPITTMTKALVCSQHSDFPSSYITVPLSFIDRVKDEFRRRRHSSSGGGQMAPASCTAFDVFTATLWKCRTRATIASAASQDAPTALAFTVNVRKPAKAKDGYYGNVFAFGLAASTLREVADGDILDLVRLVKDAKARVPYMFADGAAYIADEMSGRLNGLDGYDTLYVTSWWNLGLDDVDFGSGGAERVIGNMERKVVPGCILCGRKDKAEGVAAMALCVKQEHAETFHAELQSLK

SEQ ID NO: 18136 - DNA, 873 bp, Sorghum bicolor
  misc_feature: Ceres ANNOT ID no. 8693820
  misc_feature: Encodes the peptide sequence at SEQ ID NO 18137
atgtctgcacccatggtggacgccgattacatggccgagatcgagagggcgcggcgggacctccgcgccctcatctccagcaagaactgcgcgcccatcatactccgcctcgcatggcatgacgccggcacttacgacgccaagaccaacaccggaggccccaacgggtccataaggctcccacaggagtacagccactcttcaaatgcagggctcaagattgccattgacctgctagagccaataaaacagaagcacaccaagatcacatatgcagacctgtatcagctcaccggagttgtcgccgtcgaagttactggtggaccaaccattgatttcgttcctggcagaaaggattcgtcggcttgtccagaagaaggacgcttgccagatgctagaaaaggtgcttcgcatcttagagaagtcttctaccggatgggtttatctgacaaggacattgtggcactctccggcggtcatactctgggaagagcacatccagagaggacaggatttgatggcccatggaccaaggaacctctgaaatttgacaactcttattttgttgagcttctgaaaggcgattctgaagggctcttgaaactccctactgacaaggttcttgtggaagatcctgaattccgtcagtacgtcgaactatatgccaaggatgaagaagctttctttagggactacgcggagtcacacaagaaactctcagagctaggcttcacaccgcctcgctcttctttcacatgcaaatccggaaataaacaaaagtccctgctggtgcaagctgcagctggggtcgcagttgctgctgcagttgtcgcattggcgtacctgtgcgaatccaacaagaagttcatctaa

SEQ ID NO: 18137 - protein, 290 aa, Sorghum bicolor
  misc_feature: Useful for making plants with altered carbohydrate content
  misc_feature: Functional homolog of the protein sequence given in SEQ ID NO 14384
  misc_feature: Useful for making plants with altered cell wall content and/or composition
  misc_feature: Functional homolog of the protein sequence given in SEQ ID NO 13796
  misc_feature: Useful for making plants with modulated water use efficiency
  misc_feature: Functional homolog of the protein sequence given in SEQ ID NO 13794
  misc_feature: Useful for making plants with modulated heat sensitivity
  misc_feature: Functional homolog of the protein sequence given in SEQ ID NO 13793
  misc_feature: Ceres ANNOT ID no. 8693820
  misc_feature (1)..(250): SWISSPROT Homolog: EC 1.11.1.11 L-ascorbate peroxidase
  misc_feature (17)..(224): Pfam ID: peroxidase Pfam Description: Peroxidase
MSAPMVDADYMAEIERARRDLRALISSKNCAPIILRLAWHDAGTYDAKTNTGGPNGSIRLPQEYSHSSNAGLKIAIDLLEPIKQKHTKITYADLYQLTGVVAVEVTGGPTIDFVPGRKDSSACPEEGRLPDARKGASHLREVFYRMGLSDKDIVALSGGHTLGRAHPERTGFDGPWTKEPLKFDNSYFVELLKGDSEGLLKLPTDKVLVEDPEFRQYVELYAKDEEAFFRDYAESHKKLSELGFTPPRSSFTCKSGNKQKSLLVQAAAGVAVAAAVVALAYLCESNKKFI

SEQ ID NO: 18138 - DNA, 1533 bp, Sorghum bicolor
  misc_feature: Ceres ANNOT ID no. 8694043
  misc_feature: Encodes the peptide sequence at SEQ ID NO 18139
atggttcgcaggcagctgagagtgctgtccattctggatgtggccaggacacagctctaccacttcatggcgatcgtgatcgccggcatgggcttcttcaccgacgcctacgacctcttctccgtctccctcgtcatcgacctcatctcgtaccagtactacaaaggacagatgggtagcggcgtcaaagccgccatcagcagcatcgccttgtgcggcgccgtgccggggcagctcgtcttcggctggctcggcgacaagatgggccgcaagcgcatctacggcgtcacgctggtcctcatggtggtcacctccctcgcctccggcctctccttcagcaagcgcctcggcaagaacgtggtcaccgtactctgcttcttccgattctggctcggcgtcagcatcggcggcgattacccgctctcggcgactatcatgtctgagtacgccaacaagcggaggcgcggcgccttcatcgccgccgtctttgccatgcagggttttggcaatcttgcagcggggatcgtagggatggtggtgtcggccgcttttatgaacagtagaaaatccaacgctgacttcgtctggcgaattgttctcatgttcggcgccgttccggctaccctgacctactactggcgcatgaagatgccggagacggcgcggtacactgccctagtcgccaaggacgccaagaaggtagcctcggacatgtcctcggtcctccacatgcacatcgtcccagagaacgaagccgtcgacgagctcgcccggcaggaccagtatggtctgttctcggtggaattcctgcgccgccatggcgtccacctcctcggcacaagcgcgtgctggctcgctctcgacatcaccttctactcgctcaacctgttcatgaaggactttttcaccacggttgggctgcttaagctacacgagggcgaggacgagccgttcaagagaatgattcgtataactgcacaacacacgaccctcgcgctcggcttttcattaccagggtacttcttctccgtcgcgttcgtcgaccgcatcggccgtgtcaggatccagctgctagggtttgccatgatgtctgccttcatactctgcctggctatcccttatgatcaatggaggactggtgaacacaacaagtatggcttcgctgtcatctatggactgatcaccttctttgccaatttcggtcccaacaccacgacattcataattccggcggagatcttcccggcacgactacgttcgacatgccatggcatatcaggggcattcggtaagatcggcgcaattattggcgtgtttgccttcgtgtacgcccaaagacatagccacacccgaagcatgctgttcgcgctcgttgggtgcaaccttgttggccttgtgtttacactgctcttgccggagtccaaggggaaggcactggaggaggtcaccggagagatggaagaaccaccgcagccagaacaggcggcggcagctgttgctgcggccgagtgtgtacatgtggtgcctgtttaa

SEQ ID NO: 18139 - protein, 510 aa, Sorghum bicolor
  misc_feature: Useful for making plants with modulated phosphate use efficiency
  misc_feature: Functional homolog of the protein sequence given in SEQ ID NO 14600
  misc_feature: Useful for making plants with modulated carbohydrate content
  misc_feature: Functional homolog of the protein sequence given in SEQ ID NO 13407
  misc_feature: Ceres ANNOT ID no. 8694043
  misc_feature (28)..(438): Pfam ID: MFS_1 Pfam Description: Major Facilitator Superfamily
MVRRQLRVLSILDVARTQLYHFMAIVIAGMGFFTDAYDLFSVSLVIDLISYQYYKGQMGSGVKAAISSIALCGAVPGQLVFGWLGDKMGRKRIYGVTLVLMVVTSLASGLSFSKRLGKNVVTVLCFFRFWLGVSIGGDYPLSATIMSEYANKRRRGAFIAAVFAMQGFGNLAAGIVGMVVSAAFMNSRKSNADFVWRIVLMFGAVPATLTYYWRMKMPETARYTALVAKDAKKVASDMSSVLHMHIVPENEAVDELARQDQYGLFSVEFLRRHGVHLLGTSACWLALDITFYSLNLFMKDFFTTVGLLKLHEGEDEPFKRMIRITAQHTTLALGFSLPGYFFSVAFVDRIGRVRIQLLGFAMMSAFILCLAIPYDQWRTGEHNKYGFAVIYGLITFFANFGPNTTTFIIPAEIFPARLRSTCHGISGAFGKIGAIIGVFAFVYAQRHSHTRSMLFALVGCNLVGLVFTLLLPESKGKALEEVTGEMEEPPQPEQAAAAVAAAECVHVVPV

SEQ ID NO: 18140 - DNA, 1638 bp, Sorghum bicolor
  misc_feature: Ceres ANNOT ID no. 8694030
  misc_feature: Encodes the peptide sequence at SEQ ID NO 18141
atgttctaccgcatgctcaacgtggtgacatcgtcgtcggcgacgggcagcggcggcgagaccacgacgacacggagggcgcgcaagcagcagatcaccgtgctcaacgcgctcgacgtcgccaggacgcagttgtaccacttcatcaccatcgtgatcgccgggatgggcttcttcaccgacgcctacgacctcttctccatctccctcatcactgacctcctcggacgcatctactaccctgacggcaagggcaagggaagtctccccgaagacgctgccgttgccgtgaacggcattgctcttgtgggcaccgtgctggggcagatcttctttggttggctcggtgacaggatgggacgcaaacgaatctacggcgtcacgctgaagctcatggtgatttgctcactcgcatccggcctctccttcagccgcaagtccaaggacgtgatagctacgctctgcttcttccgtttctggctaggcgtcggcgtcggtggcgactacccgctctctgccaccatcatgtcggagtacgcaaaccgcaggactcgtggtgccttcattgctgctgtcttcgccatgcagggcctagggaatcttgctgctggaactatggtgctggccatttctgctaggttcaaaagcaccagggcctatgaaacagatccatatgggcaggcagactacgtgtggcgcatcgttctcatgctgggcgccgttccagccctcctcacatactactggcgcatgaagatgcccgagacagcgcgctacaccgcgttgattgcgaagaacctaaagcaggctgcatcagacatgacctctgttctcgagatcgacatcccattaggaaaagaagagatggacgcccttgccatacaagatgaatttggactcttctctatggaattcgtccaacgttatggccgtgagctgctcagcaccaccatgtgctggttacttctcgacatcgtcttctactctctcaacctgttcatgaaagaattcttcagtgacatcggttggtttgaagatgtcgaggggccacttgagcatacatacgctattgcacgtactcaggcgattatcgtactcgctggcactctccctgggtacttgttcacagtcatcttcattgacaaactcggacgcaccaggatacagattgtgggattcactatgatgactatattgatgctttgcctggctgggccttacaatttttggaagaacaataaaagcacgaaaattggcttcgccttcttgtacgcattggttttcttcttcgccaactttggaccaaactctaccacgttcatccttcccacggagatattcccgacgcggttacggtcaacatgtcatggcatatctggcgctggagggaagattggtgcaatttttggcgtgctttggttcctccggtgtccaataagcattcagaactcactactcatgctagctggttgtaacctagttggagtcatgttcaccctagcattaccggaatctaaaggcatgtcacttgaggacatcaccggtgagatagatgatcgggatgaggagcttcccttcgaatcaccacaaattaatgggggagagttcatccacagtgttgattttgatgagcattga

SEQ ID NO: 18141 - protein, 545 aa, Sorghum bicolor
  misc_feature: Useful for making plants with modulated carbohydrate content
  misc_feature: Useful for making plants with modulated phosphate use efficiency
  misc_feature: Functional homolog of the protein sequence given in SEQ ID NO 13406
  misc_feature: Ceres ANNOT ID no. 8694030
  misc_feature (52)..(471): Pfam ID: MFS_1 Pfam Description: Major Facilitator Superfamily
MFYRMLNVVTSSSATGSGGETTTTRRARKQQITVLNALDVARTQLYHFITIVIAGMGFFTDAYDLFSISLITDLLGRIYYPDGKGKGSLPEDAAVAVNGIALVGTVLGQIFFGWLGDRMGRKRIYGVTLKLMVICSLASGLSFSRKSKDVIATLCFFRFWLGVGVGGDYPLSATIMSEYANRRTRGAFIAAVFAMQGLGNLAAGTMVLAISARFKSTRAYETDPYGQADYVWRIVLMLGAVPALLTYYWRMKMPETARYTALIAKNLKQAASDMTSVLEIDIPLGKEEMDALAIQDEFGLFSMEFVQRYGRELLSTTMCWLLLDIVFYSLNLFMKEFFSDIGWFEDVEGPLEHTYAIARTQAIIVLAGTLPGYLFTVIFIDKLGRTRIQIVGFTMMTILMLCLAGPYNFWKNNKSTKIGFAFLYALVFFFANFGPNSTTFILPTEIFPTRLRSTCHGISGAGGKIGAIFGVLWFLRCPISIQNSLLMLAGCNLVGVMFTLALPESKGMSLEDITGEIDDRDEELPFESPQINGGEFIHSVDFDEH

SEQ ID NO: 18142 - DNA, 207 bp, Sorghum bicolor
  misc_feature: Ceres ANNOT ID no. 8694388
  misc_feature: Encodes the peptide sequence at SEQ ID NO 18143
atgctcgagccagattctctggtcagggagatcgtgaggaagaataacacctttcttatcaaacaatttggcaatgacaatggcaaggtccagttcagtaaggatcccaataatctatataatgttcactgttgctttttgggccttgcaaacaagatcatgacattgcacccagccagtggtagggagattgtagtggtcctctaa

SEQ ID NO: 18143 - protein, 68 aa, Sorghum bicolor
  misc_feature: Useful for making plants with altered oil content
  misc_feature: Useful for making plants with modulated cold sensitivity
  misc_feature: Functional homolog of the protein sequence given in SEQ ID NO 14601
  misc_feature: Ceres ANNOT ID no. 8694388
MLEPDSLVREIVRKNNTFLIKQFGNDNGKVQFSKDPNNLYNVHCCFLGLANKIMTLHPASGREIVVVL

SEQ ID NO: 18144 - DNA, 792 bp, Sorghum bicolor
  misc_feature: Ceres ANNOT ID no. 8694393
  misc_feature: Encodes the peptide sequence at SEQ ID NO 18145
atgaaggcaacaactgggtcatcatcagtagctcgcgttcttgttttgcttgcgacgacggcatgcctcctgtggaaagaagccgcgtgcttctcggcgtccggcatgaacaaggcgttcgccactttctacggcggtagcgacgcttcaggaacgatgggtggagcttgtgggtatgggaacctgtactcgacggggtacggcacgaacacggcggcgctgagcacggcgctgttcaacgacggcgcctcgtgcgggcagtgctaccggatctcgtgcgactaccaggcggacccgcggttctgcatccgcggcacgtcggtgaccatcacggccaccaacctttgccctcccaactacgcgctgcccaacgacgacggcggctggtgcaacccgccccggcagcacttcgacatggccgagcctgcttggctcaagatcggcatctaccgcggcggcattgttcccgtcaactaccaaagggtgccatgtgtgaagcaaggaggggtgaggttcaccatcaacgggcgcgactacttcgagctggtgctcatctccaacgtcggcggctgcggctccatccagtcggcgtcgatcaaaggatcgaggaccgggtggatggccatgtcgaggaactggggagtcaactggcagtctaacgcgtacctcgacgggcagagcctgtcgttccaggtcaccagcagcgacggccagaccaagaccttcctcaacgtcgcgcccgccggctgggggttcggccaaacgttcgcgacctcgcagcagttctcttag

SEQ ID NO: 18145 - protein, 263 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 14001
  misc_feature: Useful for making plants with altered lignin content
  misc_feature: Functional homolog of the protein sequence given in SEQ ID NO 12888
  misc_feature: Ceres ANNOT ID no. 8694393
  misc_feature: Up-regulated in root tissues in response to methyl jasmonate treatment
  misc_feature: Up-regulated in shoot tissues in response to methyl jasmonate treatment
  misc_feature (38)..(130): SWISSPROT Homolog: EC 3.2.1.4 Cellulase
  misc_feature (170)..(247): Pfam ID: Pollen_allerg_1 Pfam Description: Pollen allergen
  misc_feature (71)..(159): Pfam ID: DPBB_1 Pfam Description: Rare lipoprotein A (RlpA)-like double-psi beta-barrel
MKATTGSSSVARVLVLLATTACLLWKEAACFSASGMNKAFATFYGGSDASGTMGGACGYGNLYSTGYGTNTAALSTALFNDGASCGQCYRISCDYQADPRFCIRGTSVTITATNLCPPNYALPNDDGGWCNPPRQHFDMAEPAWLKIGIYRGGIVPVNYQRVPCVKQGGVRFTINGRDYFELVLISNVGGCGSIQSASIKGSRTGWMAMSRNWGVNWQSNAYLDGQSLSFQVTSSDGQTKTFLNVAPAGWGFGQTFATSQQFS

SEQ ID NO: 18146 - DNA, 207 bp, Sorghum bicolor; identical to SEQ ID NO: 18142
  misc_feature: Ceres ANNOT ID no. 8694391
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 18147

SEQ ID NO: 18147 - protein, 68 aa, Sorghum bicolor; identical to SEQ ID NO: 18143
  misc_feature: Useful for making plants with altered oil content
  misc_feature: Useful for making plants with modulated cold sensitivity
  misc_feature: Functional homolog of the protein sequence given in SEQ ID NO 14601
  misc_feature: Ceres ANNOT ID no. 8694391

SEQ ID NO: 18148 - DNA, 792 bp, Sorghum bicolor; identical to SEQ ID NO: 18144
  misc_feature: Ceres ANNOT ID no. 8694390
  misc_feature: Encodes the peptide sequence at SEQ ID NO 18149

SEQ ID NO: 18149 - protein, 263 aa, Sorghum bicolor; identical to SEQ ID NO: 18145
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 14001
  misc_feature: Useful for making plants with altered lignin content
  misc_feature: Functional homolog of the protein sequence given in SEQ ID NO 12888
  misc_feature: Ceres ANNOT ID no. 8694390
  misc_feature: Up-regulated in root tissues in response to methyl jasmonate treatment
  misc_feature: Up-regulated in shoot tissues in response to methyl jasmonate treatment
  misc_feature (38)..(130): SWISSPROT Homolog: EC 3.2.1.4 Cellulase
  misc_feature (170)..(247): Pfam ID: Pollen_allerg_1 Pfam Description: Pollen allergen
  misc_feature (71)..(159): Pfam ID: DPBB_1 Pfam Description: Rare lipoprotein A (RlpA)-like double-psi beta-barrel

SEQ ID NO: 18150 - DNA, 834 bp, Sorghum bicolor
  misc_feature: Ceres ANNOT ID no. 8694444
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 18151
atgagcccccgcgtggtcctcctcttcctcgccgccgccctccgcccctgcgccgccctcgtccgccttcactccgccactttctccttcactttcctcgacgccccagcgcgatttgggccccgagtgggcggcgatgggatctgcggctcgctgcgcgccgctgagccggccgaggcgtgtgagcccatcaaagaccgcggcggccgccgcggcactggccggaaggctttcgtgctgatcgcgaggggcaactgcagctttgaggagaaggtgcgggcggcgcagcaagcggggttcgacgccgccgtcgtgtacgacgatgaggagaaatccagcctctactccatggttggtgaatctgagggcatacacatacctgcgatattcgtttccaagatggctggcgaaacactaaagaagtttgccaggggtgaagatgatgagtgctgtattaactcatcaatggatgagactgcagggacagtgttggtaatgtcattcgtgtcacttgttgtcatcatatcagttcttgcttcttttctgtttgctcgaaactgccgacttctacgccatggagttgataatcacccaacttacgtcaagaaatatgtggtggaaaagcttccctgctcagcatacatcgctccctgttctagtgaagataattttctggaagcttgtgcaatttgcttagaagactacaataatggtgatatgcttagacatctcccatgcaaacatggatttcacaagatctgcattgattcctggctcacaaaatggggcaccttctgccctatatgcaagcttgaagtaacgtcgggcgaatag

SEQ ID NO: 18151 - protein, 277 aa, Sorghum bicolor
  misc_feature: Useful for making plants with altered alkaloid content
  misc_feature: Functional homolog of the protein sequence given in SEQ ID NO 14602
  misc_feature: Ceres ANNOT ID no. 8694444
  misc_feature (43)..(143): Pfam ID: PA Pfam Description: PA domain
  misc_feature (228)..(269): Pfam ID: zf-C3HC4 Pfam Description: Zinc finger, C3HC4 type (RING finger)
MSPRVVLLFLAAALRPCAALVRLHSATFSFTFLDAPARFGPRVGGDGICGSLRAAEPAEACEPIKDRGGRRGTGRKAFVLIARGNCSFEEKVRAAQQAGFDAAVVYDDEEKSSLYSMVGESEGIHIPAIFVSKMAGETLKKFARGEDDECCINSSMDETAGTVLVMSFVSLVVIISVLASFLFARNCRLLRHGVDNHPTYVKKYVVEKLPCSAYIAPCSSEDNFLEACAICLEDYNNGDMLRHLPCKHGFHKICIDSWLTKWGTFCPICKLEVTSGE

SEQ ID NO: 18152 - DNA, 951 bp, Sorghum bicolor
  misc_feature: Ceres ANNOT ID no. 8694792
  misc_feature: Encodes the peptide sequence at SEQ ID NO 18153
atgtacagatcggcaggggtcgcgatggcgtggaacgtgttccggttctgcacggctctccgtgggctgggttccatcatgatcctgctcgttctcgccatcgtcggcgtcacctactacgctgtcgtcctctgcaactacggccccgccctcctcaccggcggcggcaccactctcgccgcgtttgccgtcctgctcctcttccacttcctgcttgctatgcttttatggagttatttttctgtcgtgttcaccgaccctggttctgttccaccaaattggaatcttgattttgatgtggagaggggagaaactgctcctctcgctacctcagagttcagtagccagatgaactcacaacaatcggtggctcttggcaatacggcaaatccaagggttaggtactgtaggaagtgcaaccagttgaagccacctcggtgccaccattgctctgtttgtggaagatgtgttcttaagatggatcatcattgtgtgtgggttgttaattgtgttggggcactgaactacaaatactttcttctcttcctgttttacaccttcctcgagacaactcttgtcacactctctttattgcctcacttcatagccttcttcagcgatgttgagatcccaggaagtcctgcagcacttgcaaccacatttctcacctttgtgttgaacctggccttttccttgagcgtttttggttttatgattatgcatatttcacttgtttctgctaatacaacaacaattgaggcatatgagaagaagacaactccacattggatatatgatcttggccggaagaggaattttgctcaggtttttggaaatgacaaaaaatattggttcatccctgcatactcagaagaggatttgagaagaattccagctctacagggtcttgattatcctgtgagaccagattttgatggtcaggaactgtaa

SEQ ID NO: 18153 - protein, 316 aa, Sorghum bicolor
  misc_feature: Useful for making plants with altered lignin content
  misc_feature: Useful for making plants with altered terpenoid content
  misc_feature: Functional homolog of the protein sequence given in SEQ ID NO 14603
  misc_feature: Ceres ANNOT ID no. 8694792
  misc_feature (125)..(189): Pfam ID: zf-DHHC Pfam Description: DHHC zinc finger domain
MYRSAGVAMAWNVFRFCTALRGLGSIMILLVLAIVGVTYYAVVLCNYGPALLTGGGTTLAAFAVLLLFHFLLAMLLWSYFSVVFTDPGSVPPNWNLDFDVERGETAPLATSEFSSQMNSQQSVALGNTANPRVRYCRKCNQLKPPRCHHCSVCGRCVLKMDHHCVWVVNCVGALNYKYFLLFLFYTFLETTLVTLSLLPHFIAFFSDVEIPGSPAALATTFLTFVLNLAFSLSVFGFMIMHISLVSANTTTIEAYEKKTTPHWIYDLGRKRNFAQVFGNDKKYWFIPAYSEEDLRRIPALQGLDYPVRPDFDGQEL

SEQ ID NO: 18154 - DNA, 639 bp, Sorghum bicolor
  misc_feature: Ceres ANNOT ID no. 8695914
  misc_feature: Encodes the peptide sequence at SEQ ID NO 18155
atggagcagagaggaggcaccggcagcgtaccaacagcggcaggtctgaaccacatgggctgggctgacagcagcggcacggtcggcggcgccgttgagagtaacatggccggccgtggcggcgtgcaccgccggcactgggacggcgtggtacccccggattgcgcgccggatccgtctatcctccgcctctccgcggcgctgcagtgggaggaagcccgcgagccgctccacgccgacatcgacaccaccaagacctgcggcatcgggcccgggatggccttcgcccgcgctgtgctcccgcgcctgcaggaggacacccccggcgcggggacccggaccgggatcgggctcgtgccgtgcgccgtcggtgggacggccatcagggaatggtctcgcggggaacacctgtacgagcagatggtatgccgggcgcgcgtcgcggccgggtacggcgagatcgaggccgtgttgtggtaccagggggagagcgacgccgagtccgatgccgacacgggtgcgtacttggagaacgtcgagagactcatcggtaatgtcagggctgatcttgggatgccgcagttaccctttattcaggtgatcgtcttgttcctgctcctaactttgttgttgaggtga

SEQ ID NO: 18155 - protein, 212 aa, Sorghum bicolor
  misc_feature: Useful for making plants with altered cell wall content and/or composition
  misc_feature: Functional homolog of the protein sequence given in SEQ ID NO 13862
  misc_feature: Ceres ANNOT ID no. 8695914
MEQRGGTGSVPTAAGLNHMGWADSSGTVGGAVESNMAGRGGVHRRHWDGVVPPDCAPDPSILRLSAALQWEEAREPLHADIDTTKTCGIGPGMAFARAVLPRLQEDTPGAGTRTGIGLVPCAVGGTAIREWSRGEHLYEQMVCRARVAAGYGEIEAVLWYQGESDAESDADTGAYLENVERLIGNVRADLGMPQLPFIQVIVLFLLLTLLLR

SEQ ID NO: 18156 - DNA, 540 bp, Sorghum bicolor
  misc_feature: Ceres ANNOT ID no. 8695980
  misc_feature: Encodes the peptide sequence at SEQ ID NO 18157
atggcggcgtcccccaccaactcgcgctccgtgacggagacggtgaacggctcccaccggttcgtgctccagggctactcgctcgcgaagggcatgggcgtgggcaagcacattgccagcgagaccttcaccgtgggcggctaccagtgggcggtctacttctaccccgatgggaagaaccccgaggacaactccgtctacgtctccgtcttcatcgccctcgcctccgatggcaccgacgtccgcgccctcttcgagctcacgctccttgaccagagcggcaagggcaagcacaaggtccactcccacttcgaccgctccctggagtccgggccgtacaccctcaagtaccgcggatccatgtggattgcaagaagagggaaggcaagaatgcagctagcacacctctcaagggcactacaggaagtgtggggcacaacaagtgtttggcttaagttcatggaaaatggttctccacaacctggtggacatgcttttgggtttttatttcctattaagtctgacgctatatgtttttag

SEQ ID NO: 18157 - protein, 179 aa, Sorghum bicolor
  misc_feature: Useful for making plants with modulated biomass
  misc_feature: Functional homolog of the protein sequence given in SEQ ID NO 12898
  misc_feature: Ceres ANNOT ID no. 8695980
MAASPTNSRSVTETVNGSHRFVLQGYSLAKGMGVGKHIASETFTVGGYQWAVYFYPDGKNPEDNSVYVSVFIALASDGTDVRALFELTLLDQSGKGKHKVHSHFDRSLESGPYTLKYRGSMWIARRGKARMQLAHLSRALQEVWGTTSVWLKFMENGSPQPGGHAFGFLFPIKSDAICF

SEQ ID NO: 18158 - DNA, 96 bp, Sorghum bicolor
  misc_feature: Ceres ANNOT ID no. 8696660
  misc_feature: Encodes the peptide sequence at SEQ ID NO 18159
atgtacaaagtccagtggaatcagtgcaccgaagaggaggctatttgtaatagagaagaggatctaagaaaagcatacccgcctgggttggagtaa

SEQ ID NO: 18159 - protein, 31 aa, Sorghum bicolor
  misc_feature: The sequence is a functional homolog of SEQ ID NO 1584 in the 10/374,780 US patent application
  misc_feature: The sequence is a functional homolog of SEQ ID NO 1586 in the 10/374,780 US patent application
  misc_feature: The sequence is a functional homolog of SEQ ID NO 1585 in the 10/374,780 US patent application
  misc_feature: The sequence is a functional homolog of SEQ ID NO 1583 in the 10/374,780 US patent application
  misc_feature: Ceres ANNOT ID no. 8696660
MYKVQWNQCTEEEAICNREEDLRKAYPPGLE

SEQ ID NO: 18160 - DNA, 333 bp, Sorghum bicolor
  misc_feature: Ceres ANNOT ID no. 8698205
  misc_feature: Encodes the peptide sequence at SEQ ID NO 18161
atggctaacccagcggcaccgggaggaatgaggtcgttcctgcaggccgtgtctacggtcaccgaggaggcgccgacgccgctccgcgtcgtccagatggagggcctggccgtactgaagatcattaagcactgtgaggagtttgcgcctgctctagttacaggtcaattgcttggtttggatgttggtagtgttctggaagtgaccaactgttttcccttccctatcagagaagaggatgatgaagcagatgcagatggtgcaaattatcagcttgaaatgatgaggtgtttgagggaagttaatgttgacaataatactattggatggtaa

SEQ ID NO: 18161 - protein, 110 aa, Sorghum bicolor
  misc_feature: Useful for making plants with altered alkaloid content
  misc_feature: Useful for making plants with modulated biomass
  misc_feature: Functional homolog of the protein sequence given in SEQ ID NO 14604
  misc_feature: Ceres ANNOT ID no. 8698205
MANPAAPGGMRSFLQAVSTVTEEAPTPLRVVQMEGLAVLKIIKHCEEFAPALVTGQLLGLDVGSVLEVTNCFPFPIREEDDEADADGANYQLEMMRCLREVNVDNNTIGW

SEQ ID NO: 18162 - DNA, 1098 bp, Sorghum bicolor
  misc_feature: Ceres ANNOT ID no. 8698395
  misc_feature: Encodes the peptide sequence at SEQ ID NO 18163
atggcggacgccctggaagacgtgcgctccatcctgctgaaaccgtcggagcgcctcgacgacaagcgcttcacgaggatcgccggcgccgacttcgacgacgcgagcctcggcctcgcggagctgctcgcctcgctcgcgtccacggggttccaggcctctaacctcggcgacgccatcgacgtcgtcaaccagatgttggactggaggttatcccacgagaagccaagcgatgattgtgctgaagctgaacttgatcctgcatatagagagtccgtcaagtgcaagatctttctgggcttcacatctaaccttgtgtcttctggtgttcgggagattatacggtttcttgctcagcatgccatggtggatgttattgttacaactgctgggggtatagaggaggatctcatcaaatgccttgcaccaacttacaaaggtgatttctctttacctggagcgctgctgcggtctaaaggacttaaccggataggaaacctgttggtgcccaatgataactactgcaagtttgagaactggatcatgccaatccttgacaagatgctgctggaacaatccactgaaaatgtttggacaccatcaaaggtgattgctcgtcttggcaaagaaataaatgatgaaagctcctacctttactgggcatacaagaacaacatccctgtgttctgcccagcattgactgacggatcaattggagacatgctattttgccactcggtcaacaatcctggtcttattgttgacattgtacaagatgtacggctgatgaatgcggaaaccatccacgcaaccccaaggaagacagggattataattcttggtggaggccttccaaagcatcatatatgcaatgccaatatgttgcgcaatggtgcagattatgcagtgtatgtcaacacggctcaggagtttgatggtagtgattctggggcacggcctgacgaagcagtttcatggggaaagatcaagagctcagcaaaaactataaaggtgcattgcgatgcaacgattgcttttccgcttcttgtggctgcaacatttgcgcgcaaggttcatggcactaaatcagcaaactga

SEQ ID NO: 18163 - protein, 365 aa, Sorghum bicolor
  misc_feature: The sequence is a functional homolog of SEQ ID NO 2 in the 6,538,182 US patent
  misc_feature: The sequence is a functional homolog of SEQ ID NO 6 in US patent 7217866
  misc_feature: Ceres ANNOT ID no. 8698395
  misc_feature (3)..(357): SWISSPROT Homolog: EC 2.5.1.46 Deoxyhypusine synthase
  misc_feature (39)..(355): Pfam ID: DS Pfam Description: Deoxyhypusine synthase
MADALEDVRSILLKPSERLDDKRFTRIAGADFDDASLGLAELLASLASTGFQASNLGDAIDVVNQMLDWRLSHEKPSDDCAEAELDPAYRESVKCKIFLGFTSNLVSSGVREIIRFLAQHAMVDVIVTTAGGIEEDLIKCLAPTYKGDFSLPGALLRSKGLNRIGNLLVPNDNYCKFENWIMPILDKMLLEQSTENVWTPSKVIARLGKEINDESSYLYWAYKNNIPVFCPALTDGSIGDMLFCHSVNNPGLIVDIVQDVRLMNAETIHATPRKTGIIILGGGLPKHHICNANMLRNGADYAVYVNTAQEFDGSDSGARPDEAVSWGKIKSSAKTIKVHCDATIAFPLLVAATFARKVHGTKSAN

SEQ ID NO: 18164 - DNA, 306 bp, Sorghum bicolor
  misc_feature: Ceres ANNOT ID no. 8698502
  misc_feature: Encodes the peptide sequence at SEQ ID NO 18165
atgtgtagtttggagcagttgctacctcagacgaagcgcaccaagaaggccggaattgttggcaaatatggaaccaggtatggtgctagcttgcgtaagcaaatcaagaagatggaggtatctcagcactccaagtacttctgtgagttctgtgggaagtttgctgtgaagaggaaagcagttggtatttggggatgcaaggactgtgggaaggtcaaggctggtggtgcttacaccatgaacactgctagtgcggtcactgtcaggagcacgatccgtcgtttgagggagcagactgaagcatga

SEQ ID NO: 18165 - protein, 101 aa, Sorghum bicolor
  misc_feature: Useful for making plants with modulated cold sensitivity
  misc_feature: Functional homolog of the protein sequence given in SEQ ID NO 14605
  misc_feature: Ceres ANNOT ID no. 8698502
  misc_feature (11)..(100): Pfam ID: Ribosomal_L37ae Pfam Description: Ribosomal L37ae protein family
MCSLEQLLPQTKRTKKAGIVGKYGTRYGASLRKQIKKMEVSQHSKYFCEFCGKFAVKRKAVGIWGCKDCGKVKAGGAYTMNTASAVTVRSTIRRLREQTEA

SEQ ID NO: 18166 - DNA, 96 bp, Sorghum bicolor
  misc_feature: Ceres ANNOT ID no. 8698535
  misc_feature: Encodes the peptide sequence at SEQ ID NO 18167
atgtacaaagtccagtggaatcactgcaccgaagaggagactgtttgtaatagagaagaggatctaagaaaaacatacccgcagttgttggagtaa

SEQ ID NO: 18167 - protein, 31 aa, Sorghum bicolor
  misc_feature: The sequence is a functional homolog of SEQ ID NO 1584 in the 10/374,780 US patent application
  misc_feature: The sequence is a functional homolog of SEQ ID NO 1586 in the 10/374,780 US patent application
  misc_feature: The sequence is a functional homolog of SEQ ID NO 1585 in the 10/374,780 US patent application
  misc_feature: The sequence is a functional homolog of SEQ ID NO 1583 in the 10/374,780 US patent application
  misc_feature: Ceres ANNOT ID no. 8698535
MYKVQWNHCTEEETVCNREEDLRKTYPQLLE

SEQ ID NO: 18168 - DNA, 1407 bp, Sorghum bicolor
  misc_feature: Ceres ANNOT ID no. 8698678
  misc_feature: Encodes the peptide sequence at SEQ ID NO 18169
atggagtcggttgtcgtcgtggcggtgccgttcccggcgcagggccacctgaacgcactgctgcacctgtcgctgcagctcgcggcgcgcgggttgcccgtgcactacgcggcgcccgtggagcacgtccgccaggcccggtcgcgcgtccacggctggggcgacggcaccctccgccgcgtccacttccacgagctccccatctccgcgtacgcctccccgcctccagaccccgccgccgaatcggccttcccctcccacctcgtgcccctgtgggaggccttcgtcgccgacgcgcccgccgcgctcgcggcgctcctcagcggggtctccgcctcctgccaccgcgtcgtcgtcctgtacgacgtcgccaacgggttcgccgctgaagaggccgcgcggctgcccaacggcgaggggtacgggctggtatgcaccgcggtgtcgtgcatggtcgggtcgacggacgccggcagccgctacgtccgcgaccgcgggctccacttcatccccgtcaactcctttgtgacggacgagtttctgacttccgttggcaagcgcgcgagatgggagcagtccgtaccgtgcagcgttggcatcctcgccaacacgtgccgcgctctcgagggcgacttcatcgatgttctcgcacagcagctcgccgacgccggcaagaaactctttgccgtcggcccattgaacccactgctgcacgacgcgaagagcgcgccacagcaggcgggaagcaaggagcggcacgagtgcctagactggctcgacaagcagccgccggcatcggtgctctacgtgtcgttcggctccatgtcgtcgctgcgagacgagcaagtcgaggagctcgccgcggcgctacgcgacagcaagcagaggttcatctgggtgctgcgcgacgccgaccgggccaacatattcgcggaccacggcgagagccggcacgccaagttcctgcccgagttcgctgggcacacccaagacaggggcatggtgatcaccgggtgggcgccgcagctggagatcctggcgcacggcgccacggcgtcgttcctgagccactgcggctggaactcgatcatggagagcatgggacacgggaagcccatcctcgcatggcccatgcactcggaccagccatgggacgctgagctggtgtgcaagcacctcaaggtgggcatcctagtccgcccgatggagaagcaaagggaggtgatttcggcagcggccatacaggaggccatcgagaagatgatggtctctgatgaaggacacaagatccagcagcgtgcaatggtgctgggcgaggctatccgtgcgtcgtcagcagaagtaagcggtgggtcagactcagagagcaaggatcttgacaagttcattgctcacatctcaaggtga

SEQ ID NO: 18169 - protein, 468 aa, Sorghum bicolor
  misc_feature: The sequence is a functional homolog of SEQ ID NO 8 in US patent 7148405
  misc_feature: Ceres ANNOT ID no. 8698678
  misc_feature (1)..(468): SWISSPROT Homolog: EC 2.4.1.215 Cis-zeatin O-beta-D-glucosyltransferase
  misc_feature (2)..(468): Pfam ID: UDPGT Pfam Description: UDP-glucoronosyl and UDP-glucosyl transferase
MESVVVVAVPFPAQGHLNALLHLSLQLAARGLPVHYAAPVEHVRQARSRVHGWGDGTLRRVHFHELPISAYASPPPDPAAESAFPSHLVPLWEAFVADAPAALAALLSGVSASCHRVVVLYDVANGFAAEEAARLPNGEGYGLVCTAVSCMVGSTDAGSRYVRDRGLHFIPVNSFVTDEFLTSVGKRARWEQSVPCSVGILANTCRALEGDFIDVLAQQLADAGKKLFAVGPLNPLLHDAKSAPQQAGSKERHECLDWLDKQPPASVLYVSFGSMSSLRDEQVEELAAALRDSKQRFIWVLRDADRANIFADHGESRHAKFLPEFAGHTQDRGMVITGWAPQLEILAHGATASFLSHCGWNSIMESMGHGKPILAWPMHSDQPWDAELVCKHLKVGILVRPMEKQREVISAAAIQEAIEKMMVSDEGHKIQQRAMVLGEAIRASSAEVSGGSDSESKDLDKFIAHISR

SEQ ID NO: 18170 - DNA, 1341 bp, Sorghum bicolor
  misc_feature: Ceres ANNOT ID no. 8699030
  misc_feature: Encodes the peptide sequence at SEQ ID NO 18171
atgatgatgtcgcgacagtgcacaaaccgcatctttctaagtggaggttccagcttcctccatggcctcaaatctagagtttcatccagtgggagtcgtggcaccgtcagacttaactggtgctgcatgagagccaatctctggaggaccaagcgccctggtttcaaggctactccgtctgagatgattgcagtactgcaagcgtcagatattttcagtagcatcaggaaatggagcaagttgcaattggttgccatgacaggggtgatggcatgtgtagttctggtagtcccttctgctgatgcaatcgatgctctcaagacatgcacttgcctactaaaggaatgcagaatagagctggccaaatgcatagcgaacccgtcctgtgcagcaaacgtagcatgcttgaacacatgcaataatcgacctgatgaaactgaatgccagatcaaatgtggagacctgtttgagaacagtgtagtcgatgaattcaatgaatgtgctgtttcacgcaagaaatgtgttccaagaaaatccgatgtcggagagttcccagtccctgatccatctgccctggttaaggacttcaatatggcagattttgatggcaaatggtacatttcaagtggcttaaacccgacatttgacacatttgattgccagcttcacgagtttcatgtccagggagacaaactaatcgcaaacataacatggagaatccgcaccccagactctggtttctttaccaggtcaaccattcaacgtttcgtgcaggacccctcacagcctggcatactctataaccatgacaatgagttcctgcactatcaagatgactggtacattatctcatccaaggttgagaacaaggatgatgactacatatttgtatactaccgtggtcgaaatgacgcatgggatggttatggtggttctgttttgtacacaagaagtaaaactgtacctgaaacaataatacctgagctagaaagagctgcaaaaagcataggtcgggacttctcgacgttcatcaggactgataacacctgtggtcctgagccacctcttgtggagagaatcgagaagactgtggaggaaggagagaagaccatcgtcagggaggtgaaggagattgaggaggaggttgaggagctggagaaggaggaggcatcattgtttcaaaagctggcagaaggtctcatggaggtgaaacaggatttgatgaacttcttgcaggggctgagcaaggaggagatggagctgttggatcagctgaacatggaagcgactgaagttgagaaagtcttcagccgtgcactgccattgaggaagctaaggtag

SEQ ID NO: 18171 - protein, 446 aa, Sorghum bicolor
  misc_feature: Useful for making plants with modulated nitrogen use efficiency
  misc_feature: Functional homolog of the protein sequence given in SEQ ID NO 13943
  misc_feature: Ceres ANNOT ID no. 8699030
  misc_feature (43)..(446): SWISSPROT Homolog: EC 1.10.99.3 Violaxanthin de-epoxidase
  misc_feature (163)..(360): Pfam ID: VDE Pfam Description: Violaxanthin de-epoxidase (VDE)
MMMSRQCTNRIFLSGGSSFLHGLKSRVSSSGSRGTVRLNWCCMRANLWRTKRPGFKATPSEMIAVLQASDIFSSIRKWSKLQLVAMTGVMACVVLVVPSADAIDALKTCTCLLKECRIELAKCIANPSCAANVACLNTCNNRPDETECQIKCGDLFENSVVDEFNECAVSRKKCVPRKSDVGEFPVPDPSALVKDFNMADFDGKWYISSGLNPTFDTFDCQLHEFHVQGDKLIANITWRIRTPDSGFFTRSTIQRFVQDPSQPGILYNHDNEFLHYQDDWYIISSKVENKDDDYIFVYYRGRNDAWDGYGGSVLYTRSKTVPETIIPELERAAKSIGRDFSTFIRTDNTCGPEPPLVERIEKTVEEGEKTIVREVKEIEEEVEELEKEEASLFQKLAEGLMEVKQDLMNFLQGLSKEEMELLDQLNMEATEVEKVFSRALPLRKLR

SEQ ID NO: 18172 - DNA, 1455 bp, Sorghum bicolor
  misc_feature: Ceres ANNOT ID no. 8699724
  misc_feature: Encodes the peptide sequence at SEQ ID NO 18173
atgggctgcttcccgtgcttcggctccacgagcgacgaggagctcaagtactacggcgcccttggaggcaatggcggcggcgtcggccgggcggccgcgtcctcgtcctcgtcctcgtccgctgccggtggcggcggccgggcggaggaggccgtggtggcaccgccgcgcgtcgcgagggaccacgcaggggctgacaaggcacgggccaaaggcaatgctggctcgaagaaggagctttcagttctcagggatgccagtggcaatgtcatctctgctcagaccttcaccttccgccagcttgccgccgcaacaaagaacttcagggatgaatgcttcatcggggagggagggtttgggcgcgtttacaagggccgccttgacatgggccaggttgttgctatcaaacagctgaacagggatggtaatcaaggaaacaaagagtttctagtggaagttcttatgcttagtttgctgcatcatcaaaacctggtcaatttggttggttattgtgctgatggagatcaacgccttctcgtgtatgagtacatgccacttggatcattggaggaccatttgcatgatctccctcctgacaaggagcccttggattggaacactaggatgaaaattgctgcaggtgctgctaaagggctggagtacctgcatgacaaggcacagccaccagttatttacagggatttcaagtcatcaaatattctattgggtgagggcttccatccaaagctatcagacttcggtcttgctaagttgggtcctgttggtgacaagtctcatgtctcaacacgagttatgggaacatatggttattgtgctccagaatatgctatgacaggacaacttacagttaagtcagatgtttacagctttggagttgtcttgcttgagttgattactggccggaaggccattgacagcaccagaccagcgtcagagcaaaaccttgtgtcatgggcacggccccttttcaatgacaggcggaagctcccaaagatggctgacccaggcctggaggggcgattccctacacgggggctttaccaggcacttgctgtggcatcaatgtgcatccagtcagaggctgcgtcacgcccactcatcgccgacgttgtgaccgctctgtcataccttgcaaaccagatttatgatcctagcttggcgcacacatccaagaaagcaggtggcagtgaccagcggaaccgggttggtgacagtggaagggtgctttccaagaatgacgatgcaggcagctctggccacaggtcaccgagcaaggaccgggccgactcccccagagagcagttcccgggggccgcgaacaggggccaggacagggagcgaatggtggccgaggcaaagatgtggggtgaaaactggcgggagaagcggcgagctgctcaggggagcctggattctccaaccggaggtgggtag

SEQ ID NO: 18173 - protein, 484 aa, Sorghum bicolor
  misc_feature: Useful for making plants with modulated drought sensitivity
  misc_feature: Functional homolog of the protein sequence given in SEQ ID NO 14078
  misc_feature: Ceres ANNOT ID no. 8699724
  misc_feature (63)..(483): SWISSPROT Homolog: EC 2.7.11.1 Non-specific serine/threonine protein kinase
  misc_feature (108)..(381): Pfam ID: Pkinase Pfam Description: Protein kinase domain
MGCFPCFGSTSDEELKYYGALGGNGGGVGRAAASSSSSSSAAGGGGRAEEAVVAPPRVARDHAGADKARAKGNAGSKKELSVLRDASGNVISAQTFTFRQLAAATKNFRDECFIGEGGFGRVYKGRLDMGQVVAIKQLNRDGNQGNKEFLVEVLMLSLLHHQNLVNLVGYCADGDQRLLVYEYMPLGSLEDHLHDLPPDKEPLDWNTRMKIAAGAAKGLEYLHDKAQPPVIYRDFKSSNILLGEGFHPKLSDFGLAKLGPVGDKSHVSTRVMGTYGYCAPEYAMTGQLTVKSDVYSFGVVLLELITGRKAIDSTRPASEQNLVSWARPLFNDRRKLPKMADPGLEGRFPTRGLYQALAVASMCIQSEAASRPLIADVVTALSYLANQIYDPSLAHTSKKAGGSDQRNRVGDSGRVLSKNDDAGSSGHRSPSKDRADSPREQFPGAANRGQDRERMVAEAKMWGENWREKRRAAQGSLDSPTGGG

SEQ ID NO: 18174 - DNA, 1851 bp, Sorghum bicolor
  misc_feature: Ceres ANNOT ID no. 8699775
  misc_feature: Encodes the peptide sequence at SEQ ID NO 18175
atggccaagggcgagggtccggcgatcaggatcgatctcggcaccacccacgaccgggtggagatcatcgccaacgaccagggcaaccgcaccacgccgtcctatgtcgccttcaccgacaccgagcggctcatcggcgatgccgccaagaaccaggtcgccatgaaccccaccaacaccgtcttcgatgccaagcgattgattggcaggaggttctctgacccgtcggtgcaaagtgacatgaagctatggccgttcaaggtcattccaggccctggtgacaagcctatgattgtggtcaactacaagggcgaggagaagcagttttctgctgaggagatctcctccatgaacgccgttgtgacagtgccggcctacttcaacgactcgcagaggcaggccaccaaggatgccggtgtcattgcgggccttaatgtgatgcgcatcatcaacgagcccaccgcagctgccatcgcctacggtctcgacaagaaggccagcagctccggcgagaagaatgtgctcatcttcgaccttggcggtggcacgttcgacgtgtcactcctgaccatcgaggaaggcatctttgaggtgaaggccacagctggtgacactcaccttggcggcgaggacttcgacaaccgcctggtgaaccacttcgtccaagagttcaagcgcaagcacaagaaagacatgagtggcaacccccgggcactgcgcaggctgcgcacggcgtgcgagcgcgccaagcgcacgctgtcgtcgaccgcgcagaccaccattgagattgactccctgttcgagggcatcgacttctactcgaccatcaccagggctcgctttgaggagctgaacatggacttgttccgcaagtgcatggagcccgtggagaagtgcctgcgcgacgccaagatggacaagagcagcgtgcacgacgtcgtgctcgttggcggctccacccgtatccccaaggtgcagcagctgctgcaggacttcttcaacggcaaggagctgtgcaagagcatcaaccctgatgaggccgtggcgtacggagccgccgtccaggccgccatcctcagcggggagggcaacgagaaggtacaggacctgctcctgctggacgtgacgcctctgtcccttggcctggagaccgctggtggtgtcatgaccgtgctcatcccgaggaacaccaccatcccgaccaagaaggagcaggtcttctccacctactccgacaaccagccgggcgtcctgatccaggtgtacgagggcgagcgcgccaggaccaaggacaacaacctcctcgggaagttcgagctctccggcatccctccagctccccgtggtgtgccccagatcaccgtgaccttggacatgggcgccaacggcatcctcaacgtctctgctgaggacaagacgaccgggcagaagaacaagatcacgatcacaaacgacaagggccggctgagcaaggaggagatcgagaagatggtgcaggaagctgagaggtacaaggcagaggacgaggaggtgaagaagaaggtggacgccaagaacgcgctcgagaactatgcctacaacatgaggaataccatcaaggacgacaagatcgcctccgagctccctgcggaggacaagaagaagatcgaggacgctgtcgatggagccatcagctggctggacagcaaccagctcgctgaggccgacgagttcgaagacaagatgaaggagctggagggcatctgcaaccccatcattgcgaagatgtaccagggagctggcgtgggcatggatgaggatgccccagccagcgggggcgctgccggtcccaagattgaggaggtcgactaa

SEQ ID NO: 18175 - protein, 616 aa, Sorghum bicolor
  misc_feature: Useful for making plants with modulated drought sensitivity
  misc_feature: Useful for making plants with modulated heat sensitivity
  misc_feature: Functional homolog of the protein sequence given in SEQ ID NO 14080
  misc_feature: Ceres ANNOT ID no. 8699775
  misc_feature (8)..(591): Pfam ID: HSP70 Pfam Description: Hsp70 protein
MAKGEGPAIRIDLGTTHDRVEIIANDQGNRTTPSYVAFTDTERLIGDAAKNQVAMNPTNTVFDAKRLIGRRFSDPSVQSDMKLWPFKVIPGPGDKPMIVVNYKGEEKQFSAEEISSMNAVVTVPAYFNDSQRQATKDAGVIAGLNVMRIINEPTAAAIAYGLDKKASSSGEKNVLIFDLGGGTFDVSLLTIEEGIFEVKATAGDTHLGGEDFDNRLVNHFVQEFKRKHKKDMSGNPRALRRLRTACERAKRTLSSTAQTTIEIDSLFEGIDFYSTITRARFEELNMDLFRKCMEPVEKCLRDAKMDKSSVHDVVLVGGSTRIPKVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERARTKDNNLLGKFELSGIPPAPRGVPQITVTLDMGANGILNVSAEDKTTGQKNKITITNDKGRLSKEEIEKMVQEAERYKAEDEEVKKKVDAKNALENYAYNMRNTIKDDKIASELPAEDKKKIEDAVDGAISWLDSNQLAEADEFEDKMKELEGICNPIIAKMYQGAGVGMDEDAPASGGAAGPKIEEVD

SEQ ID NO: 18176 - DNA, 675 bp, Sorghum bicolor
  misc_feature: Ceres ANNOT ID no. 8700267
  misc_feature: Encodes the peptide sequence at SEQ ID NO 18177
atgaagtttgttgctgcctatctgctggctgtcctcgctggcaacaatgacccctctgtggaggatctaaaaacaattctggagtcagttggtgctgagactgacagtgagaagatggaacacctgctgtcccaagtgagtggcaaggacatcactgagctcattgctgccggtagggagaagtttgcttctgtcccatgcggtggtggtggtgttgctgttgcagcagctgcccctgctgctgctggtggtgctgctcctgcagctgagaagaaggaagagaaggtggaagagaaggaagagagtgatgattgggagggggaacagcaggagtgccgagagcgtgcgccttgtccgcatccacgggccaccgccatccatcatccacgcacgcagccgccgccgctggctcgttgctctccttgccgccgccgtgtggcgtcgaatcagaacatgcacaagagaagttgcagggggcttcgctgcagagtacgacgagatcgcaccccgggcggggcggcggcggcaggtgcctcgaggccgccacgccaagcagcagcagacgaaacgccacgcaagagcgcgatacgatcactggccgtggctgccactgcatgccggcctcgttccgtgcgcgcactttccggtcataggacaactggacaagggttttag

SEQ ID NO: 18177 - protein, 224 aa, Sorghum bicolor
  misc_feature: Useful for making plants with altered oil content
  misc_feature: Useful for making plants with modulated biomass
  misc_feature: Functional homolog of the protein sequence given in SEQ ID NO 13447
  misc_feature: Ceres ANNOT ID no. 8700267
  misc_feature (17)..(107): Pfam ID: Ribosomal_60s Pfam Description: 60s Acidic ribosomal protein
MKFVAAYLLAVLAGNNDPSVEDLKTILESVGAETDSEKMEHLLSQVSGKDITELIAAGREKFASVPCGGGGVAVAAAAPAAAGGAAPAAEKKEEKVEEKEESDDWEGEQQECRERAPCPHPRATAIHHPRTQPPPLARCSPCRRRVASNQNMHKRSCRGLRCRVRRDRTPGGAAAAGASRPPRQAAADETPRKSAIRSLAVAATACRPRSVRALSGHRTTGQGF

SEQ ID NO: 18178 - DNA, 1242 bp, Sorghum bicolor
  misc_feature: Ceres ANNOT ID no. 8700345
  misc_feature: Encodes the peptide sequence at SEQ ID NO 18179
atggccgtggcggagcggttcggagctccgtggccgccgtctcgcttcttcttcttcttcgtcgcggtgctcctcgtcctgctgctgacagatggcggagtgtcatggatcaggagagctgaagccctgtcgatcggcatcaactacgggcagatcggggacaacctcccttccccgtcccgggtgtcgtacctgctgcagtcgatgcaggtgagcaaggtgaagctgtacgacgcggacccctacgtcctctccgcgttcctcgacacggacgtcgagttcgtggtgggcatcggcaacgagaacgtctcggcgatggcggccgacccgtccgcggcgcgggcgtgggtccagcgccacgtgcagccgtacctcctcgccaccggcgacggcggcacgcgccgccgccgcatcacctgcatcaccgtcggcaacgaggtgctcaagggcaacgacacgtcgctgaaggccgcgctcctccccgccatggagtccgtgtacgccgccctgtccgcgctgggcctgcagggccgcgtgaacgtcacgacggcgcactccctggacatcatgggcaccacctacccgccgtccgcgggggcgttcgcgcccgacgtcgtgccgtacgtgcagccgctgctgagcttcctgtccatggcgaggtcgccgttcctcatcaactgctacccgtacttcgcctacaaggcggaccccgggaacgtgccgctggagtacgtcctgttccagcccaacgccggcgtcacggacgccaacaccaggctcaactacgacaacatgctgtacgcgcaggtggactcggtgtacgccgcgatccaggcgctggggcacgccgccgacgacatcgacgtcaagatctccgagaccgggtggccgtcgaggggagaccccgacgaggccggcgccacgccggagtacgcggggacgtacatcggcaacctcctgcggaggatcgagatgaagcagggcacgccgctgcggccggcggtgcccatcgacgtctacgtcttcgcgctcttcaacgagaacctcaagcccgggccggcctccgagcggaactacggcctcttctaccctgacggcacgccggtgtacaacgtcggcctgaggggataccttccacccatggatttttcacaaggaacccgccgaaaggtacgaatccattgcattgcattgcatggtcgagttcggcaaattggttacaagctttctgcatgtatgtga

SEQ ID NO: 18179 - protein, 413 aa, Sorghum bicolor
  misc_feature: Useful for making plants with altered carbohydrate content
  misc_feature: Functional homolog of the protein sequence given in SEQ ID NO 14606
  misc_feature: Useful for making plants with altered cell wall content and/or composition
  misc_feature: Functional homolog of the protein sequence given in SEQ ID NO 14472
  misc_feature: Ceres ANNOT ID no. 8700345
  misc_feature (42)..(374): SWISSPROT Homolog: EC 3.2.1.39 Glucan endo-1,3-beta-D-glucosidase
  misc_feature (45)..(374): Pfam ID: Glyco_hydro_17 Pfam Description: Glycosyl hydrolases family 17
MAVAERFGAPWPPSRFFFFFVAVLLVLLLTDGGVSWIRRAEALSIGINYGQIGDNLPSPSRVSYLLQSMQVSKVKLYDADPYVLSAFLDTDVEFVVGIGNENVSAMAADPSAARAWVQRHVQPYLLATGDGGTRRRRITCITVGNEVLKGNDTSLKAALLPAMESVYAALSALGLQGRVNVTTAHSLDIMGTTYPPSAGAFAPDVVPYVQPLLSFLSMARSPFLINCYPYFAYKADPGNVPLEYVLFQPNAGVTDANTRLNYDNMLYAQVDSVYAAIQALGHAADDIDVKISETGWPSRGDPDEAGATPEYAGTYIGNLLRRIEMKQGTPLRPAVPIDVYVFALFNENLKPGPASERNYGLFYPDGTPVYNVGLRGYLPPMDFSQGTRRKVRIHCIALHGRVRQIGYKLSACM

SEQ ID NO: 18180 - DNA, 219 bp, Sorghum bicolor
  misc_feature: Ceres ANNOT ID no. 8700396
  misc_feature: Encodes the peptide sequence at SEQ ID NO 18181
atggtgaatggtaggtcgaccaaaggtaggcaaaggattgagatgaagagcatcaaaggtgaggaggcacggcaggtatgcttctccaagcgccgcccatgcttattcaagaaggcctgtgagctttccaccctatgcggtgcggaggttgctgttgtcaccactaccggattcggtgggttcgccatgtgtctcggacacatgtcaaagtcaatgtag

SEQ ID NO: 18181 - protein, 72 aa, Sorghum bicolor
  misc_feature: The sequence is a functional homolog of SEQ ID NO 2822 in the 10/374,780 US patent application
  misc_feature: The sequence is a functional homolog of SEQ ID NO 82 in the 11/375,241 US patent application
  misc_feature: Useful for making plants with modulated biomass
  misc_feature: Functional homolog of the protein sequence given in SEQ ID NO 12997
  misc_feature: The sequence is a functional homolog of SEQ ID NO 215 in the 11/479,226 US patent application
  misc_feature: The sequence is a functional homolog of SEQ ID NO 470 in the 11/435,388 US patent application
  misc_feature: Useful for making plants with altered alkaloid content
  misc_feature: Useful for making plants with altered terpenoid content
  misc_feature: Useful for making plants with modulated flowering time
  misc_feature: Functional homolog of the protein sequence given in SEQ ID NO 13021
  misc_feature: Useful for making plants with altered tocopherol content
  misc_feature: Functional homolog of the protein sequence given in SEQ ID NO 14261
  misc_feature: The sequence is a functional homolog of SEQ ID NO 42 in the 10/666,642 US patent application
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 2195 in the 10/666,642 US patent application
  misc_feature: The sequence is a functional homolog of SEQ ID NO 1453 in the 10/374,780 US patent application
  misc_feature: The sequence is a functional homolog of SEQ ID NO 707 in the 10/666,642 US patent application
  misc_feature: The sequence is a functional homolog of SEQ ID NO 1470 in the 10/666,642 US patent application
  misc_feature: The sequence is a functional homolog of SEQ ID NO 284 in the 10/666,642 US patent application
  misc_feature: The sequence is a functional homolog of SEQ ID NO 4 in US patent 7303918
  misc_feature: The sequence is a functional homolog of SEQ ID NO 46 in the 10/666,642 US patent application
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: The sequence is a functional homolog of SEQ ID NO 122 in the 10/225,066 US patent application
  misc_feature: The sequence is a functional homolog of SEQ ID NO 234 in the 10/374,780 US patent application
  misc_feature: The sequence is a functional homolog of SEQ ID NO 1454 in the 10/374,780 US patent application
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 2 in US patent 7273968
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 6 in US patent 7279615
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 919 in the 10/666,642 US patent application
  misc_feature: The sequence is a functional homolog of SEQ ID NO 729 in the 10/666,642 US patent application
  misc_feature: The sequence is a functional homolog of SEQ ID NO 1701 in the 10/412,699 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 2189 in the 10/666,642 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 731 in the 10/666,642 US patent application
  misc_feature: The sequence is a functional homolog of SEQ ID NO 2197 in the 10/666,642 US patent application
  misc_feature: The sequence is a functional homolog of SEQ ID NO 2199 in the 10/666,642 US patent application
  misc_feature: The sequence is a functional homolog of SEQ ID NO 2191 in the 10/666,642 US patent application
  misc_feature: Useful for making plants with altered lignin content
  misc_feature: Functional homolog of the protein sequence given in SEQ ID NO 13115
  misc_feature: The sequence is a functional homolog of SEQ ID NO 2193 in the 10/666,642 US patent application
  misc_feature: The sequence is a functional homolog of SEQ ID NO 1366 in the 10/666,642 US patent application
  misc_feature: The sequence is a functional homolog of SEQ ID NO 1730 in the 10/412,699 US patent application
  misc_feature: The sequence is a functional homolog of SEQ ID NO 207 in the 11/479,226 US patent application
  misc_feature: The sequence is a functional homolog of SEQ ID NO 64 in the 10/412,699 US patent application
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: Ceres ANNOT ID no. 8700396
  misc_feature (16)..(63): Pfam ID: SRF-TF Pfam Description: SRF-type transcription factor (DNA-binding and dimerisation domain)
MVNGRSTKGRQRIEMKSIKGEEARQVCFSKRRPCLFKKACELSTLCGAEVAVVTTTGFGGFAMCLGHMSKSM

SEQ ID NO: 18182 - DNA, 843 bp, Sorghum bicolor
  misc_feature: Ceres ANNOT ID no. 8700489
  misc_feature: Encodes the peptide sequence at SEQ ID NO 18183
atggcgcggcggtctctggcccttctgctcgcgtcgtcgctggccctcgtgatgatggcggccgtcgcgtcggcggactcgtggctctacgagaagttcagcacggacggcaccgtccgcaccaactacgacgagtccggcgcgcaggtggcgatgctcaacctcgaccgcagctccggcgccggcttcaactccaaggagcagtacctctacggccagttcagcgtccagatgaagctcatccccggcaactccgccggcaccgtctcctgcttctacctttcttctggcgacggcgacgggcatgacgagatcgacatggagttcatgggcaacgccacggggcagccggtggtgctcaacacaaacgtgtgggccaacggcgacggcaagaaggagcaccagttcgacctgtggttcgacccggccgccgactaccacacctacaccatcatctggaacccgaccaacatcctcttcaaggtggacgacaacgtgatccgcgtcttcaagcgctacgccgacctggcctacccgagctccaagcccatgacgctgcacgccacgctgtgggacggcagctactgggccaccgagaagggcaaggtgcccatcgactggtccggcgcgcccttcgtcgtctcctacaaaggctactccgccgacgcctgcgtcagcggcggcgcctgcgccgccggcagcggcgcgtggatgaacaagcagcctgacagcgccgagtggggcaccgtcaagtgggccgagagcaactacatgcgctacaactactgcgacgacggctggaggttcccgcaggggctgccggcggagtgcagccgcagctga

SEQ ID NO: 18183 - protein, 280 aa, Sorghum bicolor
  misc_feature: Useful for making plants with altered carbohydrate content
  misc_feature: Functional homolog of the protein sequence given in SEQ ID NO 14607
  misc_feature: Useful for making plants with altered cell wall content and/or composition
  misc_feature: Functional homolog of the protein sequence given in SEQ ID NO 14608
  misc_feature: Ceres ANNOT ID no. 8700489
  misc_feature (30)..(279): SWISSPROT Homolog: EC 2.4.1.207 Xyloglucan:xyloglucosyl transferase
  misc_feature (29)..(209): Pfam ID: Glyco_hydro_16 Pfam Description: Glycosyl hydrolases family 16
  misc_feature (230)..(277): Pfam ID: XET_C Pfam Description: Xyloglucan endo-transglycosylase (XET) C-terminus
MARRSLALLLASSLALVMMAAVASADSWLYEKFSTDGTVRTNYDESGAQVAMLNLDRSSGAGFNSKEQYLYGQFSVQMKLIPGNSAGTVSCFYLSSGDGDGHDEIDMEFMGNATGQPVVLNTNVWANGDGKKEHQFDLWFDPAADYHTYTIIWNPTNILFKVDDNVIRVFKRYADLAYPSSKPMTLHATLWDGSYWATEKGKVPIDWSGAPFVVSYKGYSADACVSGGACAAGSGAWMNKQPDSAEWGTVKWAESNYMRYNYCDDGWRFPQGLPAECSRS

SEQ ID NO: 18184 - DNA, 864 bp, Sorghum bicolor
  misc_feature: Ceres ANNOT ID no. 8700521
  misc_feature: Encodes the peptide sequence at SEQ ID NO 18185
atggcgcgccgtgccgtgtccgtggccgtcgtggccctggctctcctggccgcggccacggcggcgtcggcggactcgtggctgtacgagaagttcacgacggacggcaacgtgcgtgcggactacaacgcggagggccagcaggtgacgtcgctgatcctgaaccagcagtccggcggcgccttcaggtcccgccagaggtacctctacggcgagttcagcatccagatgaagctcatccccggcaactccgccggcaccgtcacctccttctacctcacctccggcgacggcgacgggcacgacgagatcgacatggagttcatgggcaactccagcggcgaccccgtcgtgctcaacaccaacgtgtgggccaacggcgacggcaagaaggagcaccagttctacctctggttcgacccggccgccgacttccacacctacaccatcatctggaacgacaagaacgtcatcttcaaggtcgacgacctcttcatccggagcttcaagcgctaccgtgatctgccgtaccccggcgggaagcccatgtcggtgcacgccacgctgtgggacggcagctactgggcaacgcagcaggggaaggtgaaggtggactggtccaattcgccgttcgtcgtctcgtaccgaggctacaccgccgacgcctgtgtccccaccggcggcggcgacgtcggcgcgccgctgtcgtgccccgccgggacggaccggtggatgaaccgccagctcgacgccgccgagtggggcaccgtcgcgtgggcaaagaagaactacatgcactacaactactgcgacgatgggtggaggttcccgcagggattccccgccgagtgctcccgaaactga

SEQ ID NO: 18185 - protein, 287 aa, Sorghum bicolor
  misc_feature: Useful for making plants with altered carbohydrate content
  misc_feature: Functional homolog of the protein sequence given in SEQ ID NO 14609
  misc_feature: Useful for making plants with altered cell wall content and/or composition
  misc_feature: Functional homolog of the protein sequence given in SEQ ID NO 14610
  misc_feature: Ceres ANNOT ID no. 8700521
  misc_feature (29)..(286): SWISSPROT Homolog: EC 2.4.1.207 Xyloglucan:xyloglucosyl transferase
  misc_feature (28)..(208): Pfam ID: Glyco_hydro_16 Pfam Description: Glycosyl hydrolases family 16
  misc_feature (237)..(284): Pfam ID: XET_C Pfam Description: Xyloglucan endo-transglycosylase (XET) C-terminus
MARRAVSVAVVALALLAAATAASADSWLYEKFTTDGNVRADYNAEGQQVTSLILNQQSGGAFRSRQRYLYGEFSIQMKLIPGNSAGTVTSFYLTSGDGDGHDEIDMEFMGNSSGDPVVLNTNVWANGDGKKEHQFYLWFDPAADFHTYTIIWNDKNVIFKVDDLFIRSFKRYRDLPYPGGKPMSVHATLWDGSYWATQQGKVKVDWSNSPFVVSYRGYTADACVPTGGGDVGAPLSCPAGTDRWMNRQLDAAEWGTVAWAKKNYMHYNYCDDGWRFPQGFPAECSRN

SEQ ID NO: 18186 - DNA, 2622 bp, Sorghum bicolor
  misc_feature: Ceres ANNOT ID no. 8700541
  misc_feature: Encodes the peptide sequence at SEQ ID NO 18187
atggcagctccggcgaggtcgcggggaagccaaaccagccatggatcgacaccaagaaatgaagctgaggctgcatcgtgccgctgcgaacccaacggagtggaaagcgaggcggaagagggacggagtggggagatcggtagctcaatgcctcgaccttggatccgtaatggcggcgggcagtgcttggtggaggcattagggtggcagaaggagcacggggaggggagaggcggcaaggcgagggctcggcggttctgtgctgaactggtcgtggctgcttgttggtgttggggtccgcgtggcgaagggctgcggcggcggccttcatgtcggcgagtcgagggctcgacagcgcgatataagacaacgatgaaggcgtggattccagcgcacgcgaggagggtggcaggcgaaggcgaggatgggtccctctccctcggagcgcccttgtgggacacgggaatctccgggtggtcccgatgtcgagggaagccttggactctgcgagtgcccgacgctaatttgtcgcaaggtaaaatgtgtactctactgcagtatgcaaaacataaacatcttcaggtggatcctccacccgccaagctcgcagaaaatgaagaagtcacagaggacatcatattagcggcattgaggcgagcactcgctcaacattcaagtctgcaagcggatgatgggtgctggccagcagactatagtggtcttttgttcattatgcctctcctggtattcgctttatataccactggatcactcaatactgtcctatctaaagaacaccaacgcgagatacgtcgctatatttacaatcatcagaatgaagatggtggttggggtaaacaagtgttggggccgagcaccatgtttggctcatgcttgaactatgttgcattaagacttattggtgaagattgcacgaatgttgcattgaccaatggacgtgagtggattttgtctcatggaagtgcaactgcaattccacaatggggaaagatatggttctcggtgatgggtttgtatgattggtctggaaacaatccagtaattcccgagttatggcttctcccatactttctgccaattcatccaggacgattttggatactttgccgtatggtgtatctgcctatggcttatctgtttggtaaaaagtttgtgggagaagttacaccaactatattggaattaaggagtgagctctattctgtgccatacagtgaggttgattggaaaaaagctcgtgatacatgtgccaaggtggaccttatatatccaaggacaatggcacaaaatcttgtatggacattccttaataaggttatagagccaatgctgaattggtggccagtaaataagttaagggatatagcattgcaaaacatcatggaacatatccactatgaagatgaaactagcaaatacatatgtatatgtccgataaacaaggcactagatatgatttgttgttgggcagaaaatccaaattcagatgcgttcaaacaacatcttccaaggatatatgatatgctatggcttgctgaagatggaatgaaggcacaggtctacgatggttgtacaacatgggagactgctttcattgttcaagccttttgctcgacaggtcttgttaatgagattagttcaacacttcgtaaagctcatgaattcattaaatgttcacagataagtgaaaaccatttggactacaaatcttactaccggcatgcatcaaaaggttcatggacactttcaacagcagataatgggtgttcaatatctgactgtactgccgaggcgttgaaggcattgctattgttatcaaagatctctcccgatcttgtgggggaacccataaaaggagaaagtctgtatgatgcagttgattgcttactttcttttgtgaacaatgatggaagcttctctgcatacgagtgtaagagaaccacacctttgttggaggttctcaacccttctgagagctttcggaatattattgttgattatccatgtgttgaatgcacatcatctgtgctacaagctctgattatgtttagagacctggatcatgtgtaccgcaaagaagagataggaaattgcattgaaagggcgtccaggtttattgagaaggaacaacgaaaagatggctcctggtttggcagctggggtatatgtttcacttatgggactttctttgcgataaaagggctagctctttcaggaagaacttatgaaaatagtgatgccatcaggaaagcttgtagctttttgttgtcaaagcagctacatacaggtggatggggagaaacttatctttctagtgaaactgcggaatatgtggaggctagtagacctcatgcagtgaacactgcttgggcaatgttaaccttagtttatggtgggcaggtggaacgtgatccaacaccgttatataaagctgcaaaagagttgatcaatatgcaactagattctggagactttccccaacaagaacacgttgggtgcttcaatagttccatattcttcaattacggaaattaccgcaacttgtacccgatatgggctcttggggaatttcgtcgtcggcttcttgaaaggaagaagtga

SEQ ID NO: 18187 - protein, 873 aa, Sorghum bicolor
  misc_feature: The sequence is a functional homolog of SEQ ID NO 15 in US patent 7186884
  misc_feature: The sequence is a functional homolog of SEQ ID NO 6 in US patent 7122717
  misc_feature: Ceres ANNOT ID no. 8700541
  misc_feature (185)..(869): SWISSPROT Homolog: EC 5.4.99.8 Cycloartenol synthase
  misc_feature (265)..(308): Pfam ID: Prenyltrans Pfam Description: Prenyltransferase and squalene oxidase repeat
  misc_feature (704)..(746): Pfam ID: Prenyltrans Pfam Description: Prenyltransferase and squalene oxidase repeat
  misc_feature (753)..(806): Pfam ID: Prenyltrans Pfam Description: Prenyltransferase and squalene oxidase repeat
MAAPARSRGSQTSHGSTPRNEAEAASCRCEPNGVESEAEEGRSGEIGSSMPRPWIRNGGGQCLVEALGWQKEHGEGRGGKARARRFCAELVVAACWCWGPRGEGLRRRPSCRRVEGSTARYKTTMKAWIPAHARRVAGEGEDGSLSLGAPLWDTGISGWSRCRGKPWTLRVPDANLSQGKMCTLLQYAKHKHLQVDPPPAKLAENEEVTEDIILAALRRALAQHSSLQADDGCWPADYSGLLFIMPLLVFALYTTGSLNTVLSKEHQREIRRYIYNHQNEDGGWGKQVLGPSTMFGSCLNYVALRLIGEDCTNVALTNGREWILSHGSATAIPQWGKIWFSVMGLYDWSGNNPVIPELWLLPYFLPIHPGRFWILCRMVYLPMAYLFGKKFVGEVTPTILELRSELYSVPYSEVDWKKARDTCAKVDLIYPRTMAQNLVWTFLNKVIEPMLNWWPVNKLRDIALQNIMEHIHYEDETSKYICICPINKALDMICCWAENPNSDAFKQHLPRIYDMLWLAEDGMKAQVYDGCTTWETAFIVQAFCSTGLVNEISSTLRKAHEFIKCSQISENHLDYKSYYRHASKGSWTLSTADNGCSISDCTAEALKALLLLSKISPDLVGEPIKGESLYDAVDCLLSFVNNDGSFSAYECKRTTPLLEVLNPSESFRNIIVDYPCVECTSSVLQALIMFRDLDHVYRKEEIGNCIERASRFIEKEQRKDGSWFGSWGICFTYGTFFAIKGLALSGRTYENSDAIRKACSFLLSKQLHTGGWGETYLSSETAEYVEASRPHAVNTAWAMLTLVYGGQVERDPTPLYKAAKELINMQLDSGDFPQQEHVGCFNSSIFFNYGNYRNLYPIWALGEFRRRLLERKK

SEQ ID NO: 18188 - DNA, 834 bp, Sorghum bicolor
  misc_feature: Ceres ANNOT ID no. 8700516
  misc_feature: Encodes the peptide sequence at SEQ ID NO 18189
atggcaccgcgttctctgggagtgctcgccgtcgccctcgcgctcttgcaggccgcctcggcgaagtcctggcttggcgccaagttcaccacggacggcaccgtccgcgagggatacgacagttccggccagcaggtggtgatgctcagcctcgaccagcactccggcgccgccggcttcaactccaaggagcagtacctctacggcgagttcagcatcgagatgaagctcatccgcgggaactccgccggcaccgtctcatgcttctacctttcttccggcgacggcgacgggcacgacgagatcgacatggagttcatgggcaacgccaccggtcagccggtggtgctcaacaccaacgtgtgggccaacggcgacggcaagaaggagcaccagttcgacctgtggttcgacccggccgccgactaccacacctacaccatcatctggaaccctacgaacatcctgttcaaggtggacaacctcttcatccggtccttcaagcgctacgccgacctggcctacccgagctccaagcccatgacgctgcacgccacgctgtgggacggcagctactgggcgacggagaagggcaagatgcccatcgactggtccggcgcgcccttcgtcgtctcctaccgcagctacgccgccaacgcctgcgtcagcggcggcgcgtgccgtaccggcagggacgggtggatgcacaggcagctcgacaacgccgagtggggcaccgtcaggtgggcggagaagaacttcatgcgctacaactactgccaggatgggtggaggttcccgcaaggactccccgccgagtgcagccgccactga

SEQ ID NO: 18189 - protein, 277 aa, Sorghum bicolor
  misc_feature: Useful for making plants with altered carbohydrate content
  misc_feature: Functional homolog of the protein sequence given in SEQ ID NO 14607
  misc_feature: Ceres ANNOT ID no. 8700516
  misc_feature (35)..(276): SWISSPROT Homolog: EC 2.4.1.207 Xyloglucan:xyloglucosyl transferase
  misc_feature (25)..(206): Pfam ID: Glyco_hydro_16 Pfam Description: Glycosyl hydrolases family 16
  misc_feature (227)..(274): Pfam ID: XET_C Pfam Description: Xyloglucan endo-transglycosylase (XET) C-terminus
MAPRSLGVLAVALALLQAASAKSWLGAKFTTDGTVREGYDSSGQQVVMLSLDQHSGAAGFNSKEQYLYGEFSIEMKLIRGNSAGTVSCFYLSSGDGDGHDEIDMEFMGNATGQPVVLNTNVWANGDGKKEHQFDLWFDPAADYHTYTIIWNPTNILFKVDNLFIRSFKRYADLAYPSSKPMTLHATLWDGSYWATEKGKMPIDWSGAPFVVSYRSYAANACVSGGACRTGRDGWMHRQLDNAEWGTVRWAEKNFMRYNYCQDGWRFPQGLPAECSRH

SEQ ID NO: 18190 - DNA, 282 bp, Sorghum bicolor
  misc_feature: Ceres ANNOT ID no. 8700520
  misc_feature: Encodes the peptide sequence at SEQ ID NO 18191
atggccggcccccatcacagctttcttgggccccttgcacagccgttcgtcttgacaagaccgtccgtccgtcgacggcaccggcgtcacaggcaaaaaaaaatttcgcgcttgaagaacacgcacctgagggcgctccccaatgcggcggagaggctggcgctgtgcaacgccgacctgctcgactacgacgttctgcgggccggctgccacggcgtcttccacaccgcgtcgtccgtcaccgacgatccggtacatatacgtgtaacctataatacttaa

SEQ ID NO: 18191 - protein, 93 aa, Sorghum bicolor
  misc_feature: Useful for making plants with altered carbohydrate content
  misc_feature: Functional homolog of the protein sequence given in SEQ ID NO 13817
  misc_feature: Ceres ANNOT ID no. 8700520
MAGPHHSFLGPLAQPFVLTRPSVRRRHRRHRQKKISRLKNTHLRALPNAAERLALCNADLLDYDVLRAGCHGVFHTASSVTDDPVHIRVTYNT

SEQ ID NO: 18192 - DNA, 123 bp, Sorghum bicolor
  misc_feature: Ceres ANNOT ID no. 8700531
  misc_feature: Encodes the peptide sequence at SEQ ID NO 18193
atggcggaatacgttgggtgctttaatagttctttatacttcaattacggaaactaccgcaacttgtaccccatatgggctctcggggaatttcaccagcggcttcttggaagaaagaagtga

SEQ ID NO: 18193 - protein, 40 aa, Sorghum bicolor
  misc_feature: The sequence is a functional homolog of SEQ ID NO 15 in US patent 7186884
  misc_feature: Ceres ANNOT ID no. 8700531
  misc_feature (6)..(31): SWISSPROT Homolog: EC 5.4.99.7 Lanosterol synthase
  misc_feature (3)..(36): SWISSPROT Homolog: EC 5.4.99.8 Cycloartenol synthase
MAEYVGCFNSSLYFNYGNYRNLYPIWALGEFHQRLLGRKK

SEQ ID NO: 18194 - DNA, 255 bp, Sorghum bicolor
  misc_feature: Ceres ANNOT ID no. 8700538
  misc_feature: Encodes the peptide sequence at SEQ ID NO 18195
atgtggaggctcaaggtcgccgagggggctgggccatggctaaagtcgtccaacaactttcgtgggcgggcggtttgggagttcgatcccgagcttggcaccccggaggagcgtgccgaggtggagagggcgcgccgtgagttcaccgagcgccggttccagaaaagggagtcctctgacctcctcctacggttgcaggcggttggcataacacaaccgtctgtggaaatcgatttccaaaggcggttgtcttaa

SEQ ID NO: 18195 - protein, 84 aa, Sorghum bicolor
  misc_feature: The sequence is a functional homolog of SEQ ID NO 15 in US patent 7186884
  misc_feature: Ceres ANNOT ID no. 8700538
  misc_feature (1)..(66): SWISSPROT Homolog: EC 5.4.99.8 Cycloartenol synthase
MWRLKVAEGAGPWLKSSNNFRGRAVWEFDPELGTPEERAEVERARREFTERRFQKRESSDLLLRLQAVGITQPSVEIDFQRRLS

SEQ ID NO: 18196 - DNA, 1977 bp, Sorghum bicolor
  misc_feature: Ceres ANNOT ID no. 8700529
  misc_feature: Encodes the peptide sequence at SEQ ID NO 18197
atgtatgcaaaacataaacatcttcaggtggatcctccaccggccacactcgcagaaaatgaagaagtcacagaggagatcatattagcagcattgaagcgagccctcgctcaacattcaagtctgcaagcagatgatgggtgctggccagcagattttagtggcattttattcattatgcctctcctggtattcgccctatataccactggatcactcaatactgtcctatctaaagaacatcgacgtgagatatgccgctatatttacaatcatcagaatgaagatggtggttggggtaaacaagtgttgggaccaagcaccatgtttggctcatgcttaaactatgttgccttaagacttattggtgaagagcgcaaaaatgttgcattgaccaaaggacgtgagtggattttgtcccatggaagtgcaactgcaattccgcagtggggaaagatatggttctcggtgatgggtttgtatgattggtctggcaataatccaataattccagagttatggcttgtcccacactttcttccaattcatccaggacgattttgggtttactgccgtatggtgtatctgcctatggcttacctctttgctaaaaaattcgttggaacaattacaccaactatactggaattaagggacgagctctatagtataccatacagtgagattgattggaaagaagctcgtgatacttgtgccaaggtggaccttgtatatccaaggacaatggcacaaaatcttgtatggacctgccttaataaagtcatagagccagtactgaattgttggccattcaacaagttaagagatatagcattgaaaaacattatggaacatatccactatgaagatgaaactagtaaatacatctgtgtatgtcccataaacaaggcactagatatgatttgttgttgggcagaaaatccagattcagatgcattcaagcagcatcttccaaggatatatgattttttatggcttgcagaagatggaatgaaggcacaggtctacgatggttgtgcaacatgggagatttctttcattgtccaagcctattgctcgagtggacttgttaatgagattggttctacccttcgtaaagctcatgaattcattaaaagttcacagattcacgaaaaccatcctaactacaaagcttactaccgtcatgcatcaaaaggttcatggacactttcaacaacagataatggttggtcagtatctgactgtactgctgaagcattgaaggcattgctattattatcaaagatctctcccgatcttgtgggggagcccatcaaaggagaaaggttgtatgatgcagtggattgcatactttcttatgtgaatgatgatggcaccttctctacatatgagtgtaagagaaccacacctttattggaggttctcaacccttcggaatgctttcagaacattgttgttgattatccgtctgttgaatgtacatcatcagcgttacaagctctgattatgttcagagaactggatcacaagtaccgcaaagaagagatagaaaactgcattgaaagtgcgttcaagtttattgagaaggaacaacaaaaagatggctcctggtttggcaattggggtatatgtttcacttatgggtcattctttgcgataaaaggcttagcagcttgtggaagaacttatgataatagtgctgccataaggaaagcttgtagttttttgttgtcaaagcagctaagcacaggtggatggggagaatcctatctttctagtgaaactgagaattatatggaagctagtacacctcatgcagtaaacactgcttgggcaatgttagccttaatttatggtgggcaggtggaccgaaatccaacaccattatacaaagctgcaaaagaattgatcaatatgcaactagtttccggtgacttcccgcaacaatattggttttcaaggactcggggatag

SEQ ID NO: 18197 - protein, 658 aa, Sorghum bicolor
  misc_feature: The sequence is a functional homolog of SEQ ID NO 15 in US patent 7186884
  misc_feature: The sequence is a functional homolog of SEQ ID NO 6 in US patent 7122717
  misc_feature: The sequence is a functional homolog of SEQ ID NO 4 in US patent 7135624
  misc_feature: Ceres ANNOT ID no. 8700529
  misc_feature (13)..(650): SWISSPROT Homolog: EC 5.4.99.8 Cycloartenol synthase
  misc_feature (80)..(123): Pfam ID: Prenyltrans Pfam Description: Prenyltransferase and squalene oxidase repeat
  misc_feature (519)..(561): Pfam ID: Prenyltrans Pfam Description: Prenyltransferase and squalene oxidase repeat
  misc_feature (568)..(621): Pfam ID: Prenyltrans Pfam Description: Prenyltransferase and squalene oxidase repeat
MYAKHKHLQVDPPPATLAENEEVTEEIILAALKRALAQHSSLQADDGCWPADFSGILFIMPLLVFALYTTGSLNTVLSKEHRREICRYIYNHQNEDGGWGKQVLGPSTMFGSCLNYVALRLIGEERKNVALTKGREWILSHGSATAIPQWGKIWFSVMGLYDWSGNNPIIPELWLVPHFLPIHPGRFWVYCRMVYLPMAYLFAKKFVGTITPTILELRDELYSIPYSEIDWKEARDTCAKVDLVYPRTMAQNLVWTCLNKVIEPVLNCWPFNKLRDIALKNIMEHIHYEDETSKYICVCPINKALDMICCWAENPDSDAFKQHLPRIYDFLWLAEDGMKAQVYDGCATWEISFIVQAYCSSGLVNEIGSTLRKAHEFIKSSQIHENHPNYKAYYRHASKGSWTLSTTDNGWSVSDCTAEALKALLLLSKISPDLVGEPIKGERLYDAVDCILSYVNDDGTFSTYECKRTTPLLEVLNPSECFQNIVVDYPSVECTSSALQALIMFRELDHKYRKEEIENCIESAFKFIEKEQQKDGSWFGNWGICFTYGSFFAIKGLAACGRTYDNSAAIRKACSFLLSKQLSTGGWGESYLSSETENYMEASTPHAVNTAWAMLALIYGGQVDRNPTPLYKAAKELINMQLVSGDFPQQYWFSRTRG

SEQ ID NO: 18198 - DNA, 1341 bp, Sorghum bicolor
  misc_feature: Ceres ANNOT ID no. 8700624
  misc_feature: Encodes the peptide sequence at SEQ ID NO 18199
atggagattgatcagatggagagcggcgccaatggaggaggcggcgggttccggcgccgggagaggtgctgggaggtgctctgctcggcggcgggcatgctgtgggccaaggtcgtcgggctcgccggcaagctggcgaggatcgcgagggacgacccgcggcgggtggcgcactcgttcaaggtcggcctggcgctcacgctggtgtccgtgctctactacgtcaggccgctcttcaacaactggggggtctccaccatgtgggccgtgctcaccaccgtcgtcgtcatggagtacaccgtcggtggcacgctgtgcaaaggcctgaacagagcgttcgggacgctggtcgccggcttcatcgccgtcggggctcacaaggtggcatacctgtgtggcgacaaggcagagcccgtgctgctcgccatcttcgtcttcctactatcgtcggcggcgaccttctcgcggttcatcccggaggtgaaggcgaggtacgactacggcgtgaccatcttcatcctcaccttcagcctggtggccgtgtcgagctaccgcgtggacgagctcatccgcctcgcgcaccagcgcttctccaccatcgtcgtcggcgtcgccacctgcctctgcaccaccatcttcatcttcccggtctgggcaggggaggacctccacaagctcgccatcggaaacctcaacaagctcgccgacttctttgaaggaatcgaatctgaatgcttcagagagaacgctacattcgagaatttggaagctaaaccctttctccaagtgtacaagagcgtcctcaattccaaggccaccgaggactctttgtgcaattttgccaagtgggagccttgccatggcaaattcatattccggcacccatggagccactaccagaagctcggtgctctttctcgccagtgcgcttcttcaatggaggctcttgcttcctacgtcatcaccctcacaagaactgagtatcctgaagcgcatccggagctatgcttggaggttcgaacagcatgccgtcagatgagcttgcactctgccaaggtgctccgagaactctcagcagcgatgcggatgatgactctaccatcccaagccaacgttcacatggctgcagcaatcaaagcagcaagaggcctcagagacgaactatcagaggatgcagatctggtgcaagcaatgcatgttgctgttattgcatcccttctctcagacttggttaccaagacaaaggaaatcacggaatctgtcgatatccttgcgcgacttgcccgcttcaaaaaccctgaaaacactcagaaggatgtggctgtcaatatagtgagttga

SEQ ID NO: 18199 - protein, 446 aa, Sorghum bicolor
  misc_feature: The sequence is a functional homolog of SEQ ID NO 1 in US patent 7138563
  misc_feature: Ceres ANNOT ID no. 8700624
MEIDQMESGANGGGGGFRRRERCWEVLCSAAGMLWAKVVGLAGKLARIARDDPRRVAHSFKVGLALTLVSVLYYVRPLFNNWGVSTMWAVLTTVVVMEYTVGGTLCKGLNRAFGTLVAGFIAVGAHKVAYLCGDKAEPVLLAIFVFLLSSAATFSRFIPEVKARYDYGVTIFILTFSLVAVSSYRVDELIRLAHQRFSTIVVGVATCLCTTIFIFPVWAGEDLHKLAIGNLNKLADFFEGIESECFRENATFENLEAKPFLQVYKSVLNSKATEDSLCNFAKWEPCHGKFIFRHPWSHYQKLGALSRQCASSMEALASYVITLTRTEYPEAHPELCLEVRTACRQMSLHSAKVLRELSAAMRMMTLPSQANVHMAAAIKAARGLRDELSEDADLVQAMHVAVIASLLSDLVTKTKEITESVDILARLARFKNPENTQKDVAVNIVS

SEQ ID NO: 18200 - DNA, 1353 bp, Sorghum bicolor
  misc_feature: Ceres ANNOT ID no. 8700628
  misc_feature: Encodes the peptide sequence at SEQ ID NO 18201
atggagtctttgacgacggaggagggcaacagcaatggcggtggcggtggcggaggtttcttggcaaactgccgggagcagctccgctgggcgctggacaggctcatcatcagcagcaggggcacggccgtcgggttcgtcggcaagctagccaagatcgcccgcgacgacccccggcgggtggcgcactcgctcaaggtcgggctggcgctcacgctggtgtccgtgctttactacgtgacaccactgttcaatggctggggagactccgtcatatgggccgtgatcactgtcgtcgtcgtcatggaattcacagttgggggcacgctgagtagaggcctgaacagaactattgcgacgttggtagccggtttcctcgccatcgcagcacatatggcggccaacctctgtggggaaaaaggggagccgatactgctcggcgtgttcgtcttcttagtagggtcggcagcgacgttctcgcggttcatcccggagctgaaggcgaggtacgactacggcgtgatgattttcatactgaccttcaccatggtggctgtgtcgagctaccgcgtggacgagctcctggagttcgcgcacgagcggctcaccaccgtcgccgtcggcgtcaccatctgcctcttcacgaccgtcttcgttttcccgatctgggccggggaggacctccacaatctcgccgccgacagcctcgaaaaactggcggagttccttgaaggaatggaatctgaatgcttcagagagaactctccatgtgaaaatttagaaggcaaagcctttcttcaggtgtacaagggtgtcctcaattccaaggtcagagaggactctttgtgcacttttgctaagtgggagcctattcacggaaaattccgcttccgccacccatggggccaatatcaaaagctcggcgctctatgtcgccagtgcgcttcttcaatggaggctcttgcttcgtgtgtcgtagtcctgaaaaagtctcagtatcctgaagccaatccagagctatgcctgaaacttagaggtacatgtggtgcaatgagcttgcactctgcaaaggcgctcagagggctctcgttggcagttcggactatgactctaccatgtcaaaccaacgacatgtctacagcggccaaagctgcaagtgacttcagaacccagttatcagaggatgcggctctgttgcaagtgatgcatgtggccgtcgttgcatctcttctctccgacgtagttattcagatcgagagaatcacagaatctactagcaagctagcacggcttgcccgcttcacaaaccctgaaaggcccccaagtgctgtggttatcaacgtagaggattga

SEQ ID NO: 18201 - protein, 450 aa, Sorghum bicolor
  misc_feature: The sequence is a functional homolog of SEQ ID NO 1 in US patent 7138563
  misc_feature: Ceres ANNOT ID no. 8700628
MESLTTEEGNSNGGGGGGGFLANCREQLRWALDRLIISSRGTAVGFVGKLAKIARDDPRRVAHSLKVGLALTLVSVLYYVTPLFNGWGDSVIWAVITVVVVMEFTVGGTLSRGLNRTIATLVAGFLAIAAHMAANLCGEKGEPILLGVFVFLVGSAATFSRFIPELKARYDYGVMIFILTFTMVAVSSYRVDELLEFAHERLTTVAVGVTICLFTTVFVFPIWAGEDLHNLAADSLEKLAEFLEGMESECFRENSPCENLEGKAFLQVYKGVLNSKVREDSLCTFAKWEPIHGKFRFRHPWGQYQKLGALCRQCASSMEALASCVVVLKKSQYPEANPELCLKLRGTCGAMSLHSAKALRGLSLAVRTMTLPCQTNDMSTAAKAASDFRTQLSEDAALLQVMHVAVVASLLSDVVIQIERITESTSKLARLARFTNPERPPSAVVINVED

SEQ ID NO: 18202 - DNA, 798 bp, Sorghum bicolor
  misc_feature: Ceres ANNOT ID no. 8700707
  misc_feature: Encodes the peptide sequence at SEQ ID NO 18203
atggccatggttgccatcttcgccatgtccacgagcaccgccggcggcagcgtggcgtccatcatctccgagtctctcttcaaccagatgctgctgcaccgcaacaagcccgcgtgccctgccagcggcttctacacctactcggccttcgtcgcggcagccaactcgttcccgggcttcggcaccacggggagccccgacgcccaaaagcgcgaggtggcggcgttcctggcgcagacatcgcacgagacgacgggcgggtgggcgtcggcgcccgacgggccctacgcctggggctactgctacaaggaggagaaggacgcggcggcgtcggcgccggaggcctactgcaggccgagcgcgctgtggccgtgcgccgccgggaagaagtactacggccgcgggcccatccagatctcctacaactacaactacgggcccgccggggaggccatcggcgccgccgggatcctcgacgacccggacctggtcgccacagacgccaccgtctcgttcgagaccgccgtctggttctggatgacgccgcagccgcccaagccgtcgtgccacgccgtcgtcacggggcagtgggcgccgtcgcctgccgacaccgccgccggcaggctgccggggtatggcgtcgtcaccaacatcatcaacggcggcctcgagtgcggccatggcgccgatagccgcgtcgccgaccggatcggcttctacaagcgctactgcgacttgcttggggttagctacggcaacaacgtggactgcgccaaccagaggccattcaacagctaa

SEQ ID NO: 18203 - protein, 265 aa, Sorghum bicolor
  misc_feature: Useful for biocontainment applications
  misc_feature: Useful for making plants with modulated biomass
  misc_feature: Functional homolog of the protein sequence given in SEQ ID NO 13042
  misc_feature: Ceres ANNOT ID no. 8700707
  misc_feature (1)..(263): SWISSPROT Homolog: EC 3.2.1.14 Chitinase
  misc_feature (21)..(257): Pfam ID: Glyco_hydro_19 Pfam Description: Chitinase class I
MAMVAIFAMSTSTAGGSVASIISESLFNQMLLHRNKPACPASGFYTYSAFVAAANSFPGFGTTGSPDAQKREVAAFLAQTSHETTGGWASAPDGPYAWGYCYKEEKDAAASAPEAYCRPSALWPCAAGKKYYGRGPIQISYNYNYGPAGEAIGAAGILDDPDLVATDATVSFETAVWFWMTPQPPKPSCHAVVTGQWAPSPADTAAGRLPGYGVVTNIINGGLECGHGADSRVADRIGFYKRYCDLLGVSYGNNVDCANQRPFNS

SEQ ID NO: 18204 - DNA, 681 bp, Sorghum bicolor
  misc_feature: Ceres ANNOT ID no. 8700715
  misc_feature: Encodes the peptide sequence at SEQ ID NO 18205
atggagatccgagcgcgccgcggcagtcgtactacactgtctcactgtctgaatgcatgcgaaaaccgcgtcgggcttcccggccatggaggaagggctcgggcttcccggccgtggaggacaaaacctccgtatcgcacaaaacctccaccacgcgaccgcaagtaccgcggcgtccggcaacggccctggggcaagtacgtggtggagatccgcgacccgaagcggcgtggctcgcgcgtgtggctcggcacgtacgacgcgcccgtcgaggccgcgcgcgcctacgaccgtgccgcgttccggatgtgcgccgccaaggccatcctcaacttccccaacgaggtcggcacccgcggcgctgacctttgggccgcgccagcgacggcgaacggcgaacaaacggaggcggcagcagatggagggtggtcaggacgaccccgaggtcgaggtggtcctggtggtgaacaaggtggtgaagatcgaggcgccgccgccgccgtcgacccaggtgtcctcaacctcgccgtcgtccgtgtctacatccgagaccaccgcctcatcggacgccccggactcgcgacgaccttccctgtcgtccggcgacgtcctggttcgccagcagaagcaatctcgtcgccgcaacagctcccaactgtttggggaggaaaggaattgtga

SEQ ID NO: 18205 - protein, 226 aa, Sorghum bicolor
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 1464 in the 10/666,642 US patent application
  misc_feature: The sequence is a functional homolog of SEQ ID NO 170 in the 10/225,066 US patent application
  misc_feature: The sequence is a functional homolog of SEQ ID NO 2 in the 10/903,236 US patent application
  misc_feature: The sequence is a functional homolog of SEQ ID NO 278 in the 10/666,642 US patent application
  misc_feature: The sequence is a functional homolog of SEQ ID NO 332 in the 10/374,780 US patent application
  misc_feature: The sequence is a functional homolog of SEQ ID NO 46 in the 10/225,068 US patent application
  misc_feature: The sequence is a functional homolog of SEQ ID NO 8 in the 10/714,887 US patent application
  misc_feature: The sequence is a functional homolog of SEQ ID NO 8 in the 11/435,388 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: Useful for biocontainment applications
  misc_feature: Functional homolog of the protein sequence given in SEQ ID NO 13707
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: Useful for making plants with altered lignin content
  misc_feature: Functional homolog of the protein sequence given in SEQ ID NO 13219
  misc_feature: Ceres ANNOT ID no. 8700715
  misc_feature (54)..(106): Pfam ID: AP2 Pfam Description: AP2 domain
MEIRARRGSRTTLSHCLNACENRVGLPGHGGRARASRPWRTKPPYRTKPPPRDRKYRGVRQRPWGKYVVEIRDPKRRGSRVWLGTYDAPVEAARAYDRAAFRMCAAKAILNFPNEVGTRGADLWAAPATANGEQTEAAADGGWSGRPRGRGGPGGEQGGEDRGAAAAVDPGVLNLAVVRVYIRDHRLIGRPGLATTFPVVRRRPGSPAEAISSPQQLPTVWGGKEL

SEQ ID NO: 18206 - DNA, 1050 bp, Sorghum bicolor
  misc_feature: Ceres ANNOT ID no. 8700743
  misc_feature: Encodes the peptide sequence at SEQ ID NO 18207
atggcgcggcgacagttgatcagcggcggcctcgcggtcgtcgcggtggtcgccgtgctgtcgtcggtgctgatctgctcggcgcacccggtgccgggcggacacggtggcgggttcccgccggcgctgctgctgcagccgcacttctacgaccacgcgtgcccgcagatgcaggccatcgtgggctccatcgtggcgaaggcgcacgcggaggacccgcgcatggcggcgtccctgctccggatgcacttccacgactgcttcgtgcagggctgcgacgcctccgtgctgctcgacgccgacggcagcggcaggttcgtcaccgagaagcgctccaaccccaacaaggactccctccgcggcttcgaggtcatcgacgagatcaaggccgcgctggagcacgcctgcccgcacaccgtctcctgcgccgacatcgtcgccgtcgccgccagggactccgtcgtcctgaccggcggacctggctgggaggtgccactggggaggagggactcactgacggcgagcctgagcggctcgaacaacctcatccctgcgcccaacgactcgctccccaccatcatcgtcaagttcgccaaccagggcctcgacgtcgtcgacctcgtggcgctctcaggagggcacaccatcggcgactcgcggtgcgtgagcttccggcagcggctgtacgggcagaacaacaacgggcaggtggaccggacgctgaacccggcgtacgcggctgagctgcgggggcggtgcccgcggtccggcggcgaccagaacctgttcgcgctggaccaggcgacgcagttccggttcgacaacctgtactaccacaacatcctggccatgaacgggctgctcagctccgacgagatcctgctcacgcagagccgcgagaccatggagctcgtccaccgctacgccgccgaccagggcctcttcttcgaccacttcgccaagtccatggtcaagatgggcaacatctcgccgctcaccggaaccgccggcgagatcaggcacaactgcaggagggtcaaccacttctaa

SEQ ID NO: 18207 - protein, 349 aa, Sorghum bicolor
  misc_feature: Useful for making plants with altered carbohydrate content
  misc_feature: Functional homolog of the protein sequence given in SEQ ID NO 13815
  misc_feature: Useful for making plants with altered cell wall content and/or composition
  misc_feature: Functional homolog of the protein sequence given in SEQ ID NO 13819
  misc_feature: Useful for making plants with modulated nitrogen use efficiency
  misc_feature: Functional homolog of the protein sequence given in SEQ ID NO 13820
  misc_feature: Useful for making plants with modulated oxidative stress sensitivity
  misc_feature: Functional homolog of the protein sequence given in SEQ ID NO 13607
  misc_feature: Useful for making plants with modulated light quality response
  misc_feature: Functional homolog of the protein sequence given in SEQ ID NO 13816
  misc_feature: Ceres ANNOT ID no. 8700743
  misc_feature: Down-regulated in root tissues in response to methyl jasmonate treatment
  misc_feature: Up-regulated in shoot tissues in response to methyl jasmonate treatment
  misc_feature: Up-regulated in root tissues in response to methyl jasmonate treatment
  misc_feature (45)..(348): SWISSPROT Homolog: EC 1.11.1.7 Peroxidase
  misc_feature (61)..(311): Pfam ID: peroxidase Pfam Description: Peroxidase
MARRQLISGGLAVVAVVAVLSSVLICSAHPVPGGHGGGFPPALLLQPHFYDHACPQMQAIVGSIVAKAHAEDPRMAASLLRMHFHDCFVQGCDASVLLDADGSGRFVTEKRSNPNKDSLRGFEVIDEIKAALEHACPHTVSCADIVAVAARDSVVLTGGPGWEVPLGRRDSLTASLSGSNNLIPAPNDSLPTIIVKFANQGLDVVDLVALSGGHTIGDSRCVSFRQRLYGQNNNGQVDRTLNPAYAAELRGRCPRSGGDQNLFALDQATQFRFDNLYYHNILAMNGLLSSDEILLTQSRETMELVHRYAADQGLFFDHFAKSMVKMGNISPLTGTAGEIRHNCRRVNHF

SEQ ID NO: 18208 - DNA, 1632 bp, Sorghum bicolor
  misc_feature: Ceres ANNOT ID no. 8700755
  misc_feature: Down-regulated in root tissues in response to methyl jasmonate treatment
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 18209
atgggcgacgcggccatcgccgtcgtgcatcagactgaagaggagcaggaggaacacatattccggagccggttcccgcccgtggacctaccggacgtcaccgtgccggagttcgtgctggcgggcgccgaggcctacgcggacaaggtggcgctcgtggaggccgctccgggcggccggtcctacacctacggcgaggtggcccaggacgtggcgcggttcgccagggcgctgcggtccatcggcatccgcaagggccacgtcgtggtggtcgcgctgccgaacctcgcggtgtacccggtggtgagcctcgggatcatgtccgcgggcgcggtcttctccggcgtgaacccgcgcgccatcgccgccgagatcaagaagcaggtggaggactcggaggccaagctcgttgtcgccaacgaggtggcctacgacaaggtgaaggacgcgggcgtgccggtgatcggcatcggggacgacatggagcgcttccccggcgcgatcagctgggacgagctcctcgccgcggcggaccgcacgggcgcgccggtggtggcgctggagccggtgcagcagtccgacctgtgcgcgctcccctactcgtccggcacgacgggggtgtccaagggcgtgatgctgagccaccggaacctggtctccaacctctgctcctccatgttcgccgtcggcgaggagctcgtcgggcaggtggtcaccctggggctcatgcccttcttccacatctacggcatcaccggcatctgctgctccacgctccggcacaagggcacggtggtggtgatggaccgcttcgacctgcgcaccttcctgggcgcgctggtgactcaccgcgtgaggttcgctcccatcgtgccgcccgtgatgctggccatggtgaagagctccgtggccgacgagttcgacctctccgacctcgccctcaggtccgtcatgaccgccgctcgcgtggaggaggcgtacgggctcacggagcacagctgcatcacgctgacgcacgccggcggcgacgacccgcagcaggggccggtccagatcgccaagaagaactcggtcgggttcatcctgcccaacctggaggtgaagttcgtcgaccccgacacgggccggtcgctgcccaagaacacggccggggagatctgcgtccggagccaggccgtgatgcagggctactacaggaagaaggaggagacggagcgcaccatcgacgccaagggctggctccacaccggcgacgtcggctacatcgacgacgacggcgacgtgttcgtcgtcgaccggatcaaggagctcatcaagtacaagggcttccaggttgctcctgccgagctggaggccattctcctgtcccacccgtcggtcgaagacgcggccgtcttcggcctgccggacgaggaggccggcgaggtcccggtgtcgtgcgtggtgcggcggcgtggctcgtcggagagcgaggcagacatcatggcgtacgtggccggtcgcgtggcgtcgtacaagaagctccggcagctgcagttcgtggacgtcatccccaagtcggtgtccggcaagatcctgcggcggcagcttagggacgagttcgtcaacaggaccaaaacggcagcagcctag

SEQ ID NO: 18209 - protein, 543 aa, Sorghum bicolor
  misc_feature: Useful for making plants with altered cell wall content and/or composition
  misc_feature: Functional homolog of the protein sequence given in SEQ ID NO 14387
  misc_feature: Ceres ANNOT ID no. 8700755
  misc_feature (20)..(531): SWISSPROT Homolog: EC 6.2.1.12 4-coumarate--CoA ligase
  misc_feature (63)..(465): Pfam ID: AMP-binding Pfam Description: AMP-binding enzyme
MGDAAIAVVHQTEEEQEEHIFRSRFPPVDLPDVTVPEFVLAGAEAYADKVALVEAAPGGRSYTYGEVAQDVARFARALRSIGIRKGHVVVVALPNLAVYPVVSLGIMSAGAVFSGVNPRAIAAEIKKQVEDSEAKLVVANEVAYDKVKDAGVPVIGIGDDMERFPGAISWDELLAAADRTGAPVVALEPVQQSDLCALPYSSGTTGVSKGVMLSHRNLVSNLCSSMFAVGEELVGQVVTLGLMPFFHIYGITGICCSTLRHKGTVVVMDRFDLRTFLGALVTHRVRFAPIVPPVMLAMVKSSVADEFDLSDLALRSVMTAARVEEAYGLTEHSCITLTHAGGDDPQQGPVQIAKKNSVGFILPNLEVKFVDPDTGRSLPKNTAGEICVRSQAVMQGYYRKKEETERTIDAKGWLHTGDVGYIDDDGDVFVVDRIKELIKYKGFQVAPAELEAILLSHPSVEDAAVFGLPDEEAGEVPVSCVVRRRGSSESEADIMAYVAGRVASYKKLRQLQFVDVIPKSVSGKILRRQLRDEFVNRTKTAAA

SEQ ID NO: 18210 - DNA, 1980 bp, Sorghum bicolor
  misc_feature: Ceres ANNOT ID no. 8700794
  misc_feature: Encodes the peptide sequence at SEQ ID NO 18211
atggacctcatctacccgaggagagctctggacaagtacggccgggacatgaccgccgccgccaagaacaacaagacggcggccgacccggtgatcggccgcgacagcgagatcgaccgcgtggtctgcacgctatgccgccgttccaagaacaacgcggtgctggtgggcgcgcccggggtgggcaagacggccatcgccgagggcctggcgcagagggtggcggcggggacggtcccgccgtgcctcgccggagcgcgcgtcgtggagctcgacctcgccgcgctgctggccgggacaaagtaccggggcacgtacgaggagcgcgtcaaggaggtgatcaaggaggccgagcgcgccgacgacggcagcaaggtgatcctgttcatcgatgagatacacacgctcctcggcagcagctccggcggcggcggcgccgctgccaacatgctgaagccggcgctggcgcgtggccgcatccggtgcgtcggcgccaccacgctcgatgagtaccgcaggtacatggagaaggacgccgcgctggagcggcggttccagagaatcgacgtcgaggagccgagcgaagacgtggccgtcggcatcctacgggtgcttaagcggcggtacgaggcgcaccatggtcgccattttcctgacaaggcaattgatcttattgatgagtcatgtgccaccacaagaatgcaggttgctgccaagcaaaaaacactcaactcttcaagacaaactgatcttggaaacaaagccaaactagttgtttgccccgagcatgttgcacaagctgtgagccgatggactggcattcctgtccacgcacttgacaatgacgaaaagcacaagttgatgcatctagcagacagattgcacgagcgcgtcgtaggccaggaggaagccgtgaattcggtggcgcaggcagtgttacgggcaaggatcggccttgataactgtggccgtcagcctataggttgtttccttttcctaggttctaccggtgttgggaaaacagagcttgcaaaagctctcgctgagcaactatttgacagcgagaacatgttgattcgcttcgacatgtctgaatctgtcgggtccagctctgttttgcgtctcattggagcacctccaagctatactggttatgaagatggtggccaactgactgaaaaagttcgaaggcggccttacagtgtcatcctttttgacgaggtggagaaggcagatcccgcggtgttcgacgccatccttcagctgctcgacgacggtgttctgaccgatggcaaaggccgggccgtggatttcaagaacaccttgatcatcatgacatcaaacctgggagcagaacacatggcagaggcaatgatgcagggtaaagaaacgatggaagctgcacgaggacttgtcatgaaacaggttcacaaattcttcaagccagagttcctcaacagattgagtgatgttgtcatatttgagccgctctcgcctgacaagctgaaggaggtgctcagaattcagatgaagagcatcattgccagtgtagccgacaagggcatctctctgttcgtaagcaatgccgccatggatgttatattcttcgaatcctactgcccaatgtatggtgcaagaccgataagaaggtgggtgcaaaagaacctgatgacgaggctttctgagatgctaatcaatggagaagtcgacgagggctcggctatctatgtcgatgctactgaagacaagaaggcgttgagatatgaagcaacaaaaatggctagaaagaagccgctgctgcctccgctagacgggatgcatgatttggaagactccgatgatggcgccgtggtggaggtggctcccatagcaggcagatctggccgtggccgtgggcgttggtatattttcctaccaggtctacaaattgttgtcctaggttttgtattttgtatcaccagatttaagaaacttaattga

SEQ ID NO: 18211 - protein, 659 aa, Sorghum bicolor
  misc_feature: Useful for making plants with modulated heat sensitivity
  misc_feature: Functional homolog of the protein sequence given in SEQ ID NO 14451
  misc_feature: Ceres ANNOT ID no. 8700794
  misc_feature (325)..(491): Pfam ID: AAA_2 Pfam Description: ATPase family associated with various cellular activities (AAA)
  misc_feature (52)..(247): Pfam ID: AAA Pfam Description: ATPase family associated with various cellular activities (AAA)
MDLIYPRRALDKYGRDMTAAAKNNKTAADPVIGRDSEIDRVVCTLCRRSKNNAVLVGAPGVGKTAIAEGLAQRVAAGTVPPCLAGARVVELDLAALLAGTKYRGTYEERVKEVIKEAERADDGSKVILFIDEIHTLLGSSSGGGGAAANMLKPALARGRIRCVGATTLDEYRRYMEKDAALERRFQRIDVEEPSEDVAVGILRVLKRRYEAHHGRHFPDKAIDLIDESCATTRMQVAAKQKTLNSSRQTDLGNKAKLVVCPEHVAQAVSRWTGIPVHALDNDEKHKLMHLADRLHERVVGQEEAVNSVAQAVLRARIGLDNCGRQPIGCFLFLGSTGVGKTELAKALAEQLFDSENMLIRFDMSESVGSSSVLRLIGAPPSYTGYEDGGQLTEKVRRRPYSVILFDEVEKADPAVFDAILQLLDDGVLTDGKGRAVDFKNTLIIMTSNLGAEHMAEAMMQGKETMEAARGLVMKQVHKFFKPEFLNRLSDVVIFEPLSPDKLKEVLRIQMKSIIASVADKGISLFVSNAAMDVIFFESYCPMYGARPIRRWVQKNLMTRLSEMLINGEVDEGSAIYVDATEDKKALRYEATKMARKKPLLPPLDGMHDLEDSDDGAVVEVAPIAGRSGRGRGRWYIFLPGLQIVVLGFVFCITRFKKLN

SEQ ID NO: 18212 - DNA, 1080 bp, Sorghum bicolor
  misc_feature: Ceres ANNOT ID no. 8700846
  misc_feature: Encodes the peptide sequence at SEQ ID NO 18213
atggagaagtacgagctgctcaaggacatcggcgccggcaacttcggcgtggcgcggctgatgcgcaacagggagaccaaggagctcgtcgccatgaagtacatcccccggggccagaagattgacgagaatgtggcgagggagatcatcaaccaccgctcgctccggcaccccaacatcatccggttcaaggaggtggtgctcacgccgacgcacctggcgatcgtgatggagtacgccgccggcggcgagctgttcgaccggatctgcaacgccggcaggttcagcgaagacgaggcgaggtacttcttccagcagctaatctgcggcgtcagctactgccacttcatgcaaatctgccaccgagacttgaagctggagaacacgctgctggacggcagcccggcgcctcgcctcaagatctgcgactttggttactccaagtcgtcgctgctgcactcgaagcccaagtcgacggtgggcacgccggcgtacatcgccccggaggtgctctcccgccgggaatacgacggcaagactgccgatgtgtggtcctgtggagtcaccctttatgtgatgctggtcggtgcttacccttttgaggacccagatgacccaaagaacttcagaaagacaattgggaggatcatgtcaatccaatacaaaataccggagtatgtgcacgtgtcccaagactgcaaggaactgctctctagaatatttgttgcaaactctgcaaagagaataacaatcagggagatcaggaaccacccctggttcctgaagaacctgcctagagagctcactgaacctgcacaggcaatgtactacaagaaagacaacagcgccccgacttactccgtccagtccgtggaggagatcatgaagattgtggagaaggcgcggacgccgcctccttcctccacccccgtggctggctttggttgggccgcggaggaggacgagcaggaggacagcaagaatccagacggaaaacatgaggaggaagaggatggtgaggacgagtatgacaaacaggtgaagcaagtccatgccagcggggagtttcatatcagctga

SEQ ID NO: 18213 - protein, 359 aa, Sorghum bicolor
  misc_feature: Useful for biocontainment applications
  misc_feature: Useful for making plants with modulated biomass
  misc_feature: Useful for making plants with modulated time to senescence
  misc_feature: Functional homolog of the protein sequence given in SEQ ID NO 14093
  misc_feature: Useful for making plants with modulated water use efficiency
  misc_feature: Functional homolog of the protein sequence given in SEQ ID NO 14094
  misc_feature: Ceres ANNOT ID no. 8700846
  misc_feature (1)..(359): SWISSPROT Homolog: EC 2.7.11.1 Non-specific serine/threonine protein kinase
  misc_feature (4)..(260): Pfam ID: Pkinase Pfam Description: Protein kinase domain
MEKYELLKDIGAGNFGVARLMRNRETKELVAMKYIPRGQKIDENVAREIINHRSLRHPNIIRFKEVVLTPTHLAIVMEYAAGGELFDRICNAGRFSEDEARYFFQQLICGVSYCHFMQICHRDLKLENTLLDGSPAPRLKICDFGYSKSSLLHSKPKSTVGTPAYIAPEVLSRREYDGKTADVWSCGVTLYVMLVGAYPFEDPDDPKNFRKTIGRIMSIQYKIPEYVHVSQDCKELLSRIFVANSAKRITIREIRNHPWFLKNLPRELTEPAQAMYYKKDNSAPTYSVQSVEEIMKIVEKARTPPPSSTPVAGFGWAAEEDEQEDSKNPDGKHEEEEDGEDEYDKQVKQVHASGEFHIS

SEQ ID NO: 18214 - DNA, 960 bp, Sorghum bicolor
  misc_feature: Ceres ANNOT ID no. 8700869
  misc_feature: Encodes the peptide sequence at SEQ ID NO 18215
atggccgagcgcctcgccgcatccgccgccaccctccgcgcctcggccgccgccgccgccaccccgtccgcgcgccgcgcggcgcgggccagccgcgcgttcttcccgccctcgccggcgtcgtcagctcgcgcgcgcgttggcctccgcgccgcgccgtctccgctcccgcagaaggcgagggcagtgaggtgcgcggctgtggcggcggcgtctgacgtggctcaggtgaaggccgcgcgcgaggacatcagggagcttctcaggacgactcactgccaccccatcctggtacgtctaggatggcatgatgctggtacatatgacaagaatattgaggagtggccacaacgaggtggagctaatggaagcttaagatttgatgttgagttgaaacatggagccaatgctggtctgataaatgctctaaagcttatccaaccaattaaggacaagtacccgagtatcacttatgcagatctatttcagttggcaagtgctacagcaattgaggaagctggtggcccaaagattccgatgaaatacggacgagttgatgttacaggacctgagcagtgcccacctgaagggaagcttcctgatgctggcccaagttcacctgctgaccacttgagggaggtattctacagaatgggccttgatgacaaggaaattgttgccttgtctggagcacatacacttggaaggtccaggcctgaacggagtggctgggggaaaccagaaacaaaatatactaaaaatggtcctggtgcacctggtgggcaatcatggacagttgagtggctgagatttgataacagttacttcaaggatatcaaagagaaacgagatcaggatcttctggtcctacctacagatgctgctttatttgaggacccaaacttcaagaggaccaagacgcattcttcagtgactacgctgaggctcatgctaaactga

SEQ ID NO: 18215 - protein, 319 aa, Sorghum bicolor
  misc_feature: Useful for making plants with altered carbohydrate content
  misc_feature: Functional homolog of the protein sequence given in SEQ ID NO 13795
  misc_feature: Ceres ANNOT ID no. 8700869
  misc_feature (82)..(303): SWISSPROT Homolog: EC 1.11.1.11 L-ascorbate peroxidase
  misc_feature (80)..(313): Pfam ID: peroxidase Pfam Description: Peroxidase
MAERLAASAATLRASAAAAATPSARRAARASRAFFPPSPASSARARVGLRAAPSPLPQKARAVRCAAVAAASDVAQVKAAREDIRELLRTTHCHPILVRLGWHDAGTYDKNIEEWPQRGGANGSLRFDVELKHGANAGLINALKLIQPIKDKYPSITYADLFQLASATAIEEAGGPKIPMKYGRVDVTGPEQCPPEGKLPDAGPSSPADHLREVFYRMGLDDKEIVALSGAHTLGRSRPERSGWGKPETKYTKNGPGAPGGQSWTVEWLRFDNSYFKDIKEKRDQDLLVLPTDAALFEDPNFKRTKTHSSVTTLRLMLN

SEQ ID NO: 18216 - DNA, 291 bp, Sorghum bicolor
  misc_feature: Ceres ANNOT ID no. 8700853
  misc_feature: Encodes the peptide sequence at SEQ ID NO 18217
atgtgctctcttttattttctgttctccttgtatatcacccccagatatctgattttcttgttgtgcctacatcagcttctcgtgggttccatgccactggtgtgaagagaatgggaggacatggccatgacgagccatactacatccatgccaagcacatgtataacttgcacaggatgaagcatcaagggttgaaggtgactctttccgtgctgggagcggttagcatcggtgttggagtccctgtgtacgcagtcatattccagcagaagaagactgcctcaggttga

SEQ ID NO: 18217 - protein, 96 aa, Sorghum bicolor
  misc_feature: Useful for making plants with modulated nitrogen use efficiency
  misc_feature: Functional homolog of the protein sequence given in SEQ ID NO 14611
  misc_feature: Ceres ANNOT ID no. 8700853
MCSLLFSVLLVYHPQISDFLVVPTSASRGFHATGVKRMGGHGHDEPYYIHAKHMYNLHRMKHQGLKVTLSVLGAVSIGVGVPVYAVIFQQKKTASG

SEQ ID NO: 18218 - DNA, 489 bp, Sorghum bicolor
  misc_feature: Ceres ANNOT ID no. 8700867
  misc_feature: Encodes the peptide sequence at SEQ ID NO 18219
atgccaggcgcgaccgacactcctccacgcaagcaggccacgcccggccacaccctccgacctcataccgacgccgccgtcgacagcaccggcagcggcagcttcgggcggaagcggttccggaccaagttcaccccggagcagaaggagcggatgcgcgagttcgcggagaaacaagggtggcgcatccagcggaacgacgacggcgccctggaccgcttctgcgacgagatcggggtcaagcgccaggtgctcaaggtgtggatgcacaaccacaagaaccagctcgcctccaactcccccacctccgccgttgccgttgccgctgccgcggccgccgccgcgggcatcggcatcggcatgacccccgctgccggcactggaaccggcggcgttggcatcaccggcgacggagacgacgaggacaccgacgactccccgccccgcgccgccgtctcctccccctccccgtccccgatcagcgtctag

SEQ ID NO: 18219 - protein, 162 aa, Sorghum bicolor
  misc_feature: The sequence is a functional homolog of SEQ ID NO 128 in the 10/714,887 US patent application
  misc_feature: The sequence is a functional homolog of SEQ ID NO 128 in the 11/435,388 US patent application
  misc_feature: The sequence is a functional homolog of SEQ ID NO 116 in the 10/714,887 US patent application
  misc_feature: The sequence is a functional homolog of SEQ ID NO 116 in the 11/435,388 US patent application
  misc_feature: The sequence is a functional homolog of SEQ ID NO 112 in the 10/714,887 US patent application
  misc_feature: The sequence is a functional homolog of SEQ ID NO 112 in the 11/435,388 US patent application
  misc_feature: The sequence is a functional homolog of SEQ ID NO 60 in the 10/714,887 US patent application
  misc_feature: The sequence is a functional homolog of SEQ ID NO 60 in the 11/435,388 US patent application
  misc_feature: The sequence is a functional homolog of SEQ ID NO 122 in the 10/714,887 US patent application
  misc_feature: The sequence is a functional homolog of SEQ ID NO 122 in the 11/435,388 US patent application
  misc_feature: The sequence is a functional homolog of SEQ ID NO 126 in the 10/714,887 US patent application
  misc_feature: The sequence is a functional homolog of SEQ ID NO 126 in the 11/435,388 US patent application
  misc_feature: The sequence is a functional homolog of SEQ ID NO 50 in the 10/714,887 US patent application
  misc_feature: The sequence is a functional homolog of SEQ ID NO 50 in the 11/435,388 US patent application
  misc_feature: The sequence is a functional homolog of SEQ ID NO 618 in the 10/666,642 US patent application
  misc_feature: Ceres ANNOT ID no. 8700867
MPGATDTPPRKQATPGHTLRPHTDAAVDSTGSGSFGRKRFRTKFTPEQKERMREFAEKQGWRIQRNDDGALDRFCDEIGVKRQVLKVWMHNHKNQLASNSPTSAVAVAAAAAAAAGIGIGMTPAAGTGTGGVGITGDGDDEDTDDSPPRAAVSSPSPSPISV

SEQ ID NO: 18220 - DNA, 618 bp, Sorghum bicolor
  misc_feature: Ceres ANNOT ID no. 8700901
  misc_feature: Encodes the peptide sequence at SEQ ID NO 18221
atggggggagcttctaattctaacctgcttcctcctggcttccacttcttcccatcagacgaagagctcgtcgtccatttcctccgccgcaaagcctcgctcttaccatgccagccagacatcgtccctacagtgtgtatgaatcactatgatccatgggaactgaatggcaaagcacttggggcaggtaaccagtggtacttcttcagccatgcgaagcacagcagggtcacaccaaacgggtactggagctctgtttgtgcagacgagacggtgagcagtggtggctgtagtgtcggtctgaagaagacacttgtcttctccactggagagccctctgaatctgaggggaccgagaccaactggatcatgcatgagtatcacttactggatgggaggaaggggattagcagtagcactacctcaactaatagttcaagcaagaaattgcatcacccaaacacagagtccaataactgggtgatatgccgagtgtttgattcgacgaccggtggatcgcaagcgagctgccatgaggagggtatggagctttcatgcttagatgaggtgttcctatccctcgacgactatgatgaagtcagtttgtcaaataattag

SEQ ID NO: 18221 - protein, 205 aa, Sorghum bicolor
  misc_feature: Useful for making plants with altered carbohydrate content
  misc_feature: Functional homolog of the protein sequence given in SEQ ID NO 13994
  misc_feature: The sequence is a functional homolog of SEQ ID NO 2694 in the 10/374,780 US patent application
  misc_feature: The sequence is a functional homolog of SEQ ID NO 662 in the 10/225,066 US patent application
  misc_feature: Ceres ANNOT ID no. 8700901
  misc_feature (10)..(130): Pfam ID: NAM Pfam Description: No apical meristem (NAM) protein
MGGASNSNLLPPGFHFFPSDEELVVHFLRRKASLLPCQPDIVPTVCMNHYDPWELNGKALGAGNQWYFFSHAKHSRVTPNGYWSSVCADETVSSGGCSVGLKKTLVFSTGEPSESEGTETNWIMHEYHLLDGRKGISSSTTSTNSSSKKLHHPNTESNNWVICRVFDSTTGGSQASCHEEGMELSCLDEVFLSLDDYDEVSLSNN

SEQ ID NO: 18222 - DNA, 1407 bp, Sorghum bicolor
  misc_feature: Ceres ANNOT ID no. 8700916
  misc_feature: Encodes the peptide sequence at SEQ ID NO 18223
atgccgcgcgcccaccaccacccgccaccacgccgcggtcgcctcctgcagctcgccgcggcggcgtcggggctcctgctcctcgcgctgctcgtcctcctcccggccgcgccgcccggggagcacaccaccgcgcccgcctcgctcctccgcgcggccgtcgcggcgcacccgtcgccggcctcctacgcgcggccctgcgccgaccacctcgccctctcgctgcaccgcctccgcgccgcgctatcctccctggagtccggcgacgtccccgccgcgctccacctcgcctccggctcgctccagtgccagtacgactgctcccacctcctctcgctcccggccttccgctcccacctcctcacgtcccgcttcctcgattcccttgccccacaaaccctaaatgctgccctgaaacctccctcttccgcccctgccgctgcattccctgcgaggatccgccctgacgccacagtctgcaaaccgaattccggagcggagccgtgtggctactcgaccgtgcaagccgcggtggatgcagcgccgaactacaccgccgggcactttgtcatagcagttgctgcaggtacatacaaggaaaatatcgtgattccttatgagaagaccaacattttgctgatgggggagggtatgggagctactgttatcactgcgtcacggagcgtggggattgatggactgggaactcatgaaactgccacggtggctgtgattggcgatggtttccgcgcgagagatataacatttgagaacagtgctggtgctcgagctcatcaggctgtggcattccgttcagatagtgatcggtcagtgctggagaatgtagagttccgcgggcatcaggatacactgtatgctcacacaatgcgtcagttctaccgcaggtgccatattacagggacagtggattttatatttgggaatgccgcagctgtgtttgaggaatgtgtgattaagactgtaccacgggccgagggagctcagaagcgtgcacgaaatgtggtggctgctagtgggaggatcgatccggggcagacgacagggtttgtgtttgtgaattgcactgtggatgggaacaaagagtttgtggaattgtttcggacaaagccacagtcatacaggctgtatttggggcggccatggaaggagtatgccaggacgttgtatgtcagctgttatttggggacagttgtcaggccggagggatggcttccatggcgaggtgattttgctctcaggacactctattatggagaatttgacagtcgaggtcctggtgcaaacaacacagcaagggttgagtggagcagtcagacaccagaacagcatgttaaacacttttcaaaggagaacttcattcagggccatcaatggattgcatactga

SEQ ID NO: 18223 - protein, 468 aa, Sorghum bicolor
  misc_feature: Useful for making plants with altered cell wall content and/or composition
  misc_feature: Functional homolog of the protein sequence given in SEQ ID NO 14612
  misc_feature: Ceres ANNOT ID no. 8700916
  misc_feature (171)..(466): SWISSPROT Homolog: EC 3.1.1.11 Pectinesterase
  misc_feature (156)..(463): Pfam ID: Pectinesterase Pfam Description: Pectinesterase
MPRAHHHPPPRRGRLLQLAAAASGLLLLALLVLLPAAPPGEHTTAPASLLRAAVAAHPSPASYARPCADHLALSLHRLRAALSSLESGDVPAALHLASGSLQCQYDCSHLLSLPAFRSHLLTSRFLDSLAPQTLNAALKPPSSAPAAAFPARIRPDATVCKPNSGAEPCGYSTVQAAVDAAPNYTAGHFVIAVAAGTYKENIVIPYEKTNILLMGEGMGATVITASRSVGIDGLGTHETATVAVIGDGFRARDITFENSAGARAHQAVAFRSDSDRSVLENVEFRGHQDTLYAHTMRQFYRRCHITGTVDFIFGNAAAVFEECVIKTVPRAEGAQKRARNVVAASGRIDPGQTTGFVFVNCTVDGNKEFVELFRTKPQSYRLYLGRPWKEYARTLYVSCYLGTVVRPEGWLPWRGDFALRTLYYGEFDSRGPGANNTARVEWSSQTPEQHVKHFSKENFIQGHQWIAY

SEQ ID NO: 18224 - DNA, 1974 bp, Sorghum bicolor
  misc_feature: Ceres ANNOT ID no. 8700968
  misc_feature: Encodes the peptide sequence at SEQ ID NO 18225
atggacgcgcccaaccctgcagcggctgctggctcaggaggaatgcctagtgacgccctgtaccgagagctgtggcatgcgtgtgccggcccgttggtcacagtacctagacaaggcgagcgcgtctattacttcccccagggccatatggagcagcttgaggcgtctacacaccagcagcttgatcagtacttaccgatgttcaatctaccacccaagatcctatgcagtgtagtcaacgtggaactacgggccgaagctgattcagatgaagtttatgctcaaattatgttgcaaccagaagctgatcaaaacgaactcaccagcctggaccctgaaccacaagaacctgaaaaatgcactgcccattccttctgcaagacactgacagcttcagatacgagcactcacggcggtttttctgttcttcggaggcatgctgaagaatgtcttcctcagctggacatgtctctaaatccaccttgccaagaactggttgccaaagatctccatggcactgaatggcattttcgacacatttttcgagggcaacccaagaggcatctccttacaactggctggagtgtctttgttagctcaaagagattggttgcgggggatgcatttatcttcatgagaggtgaaaatggtgagctacgggttggtgtaaggaggctcatgagacaagtaaatagcatgccgtcatctgtcatatcaagccacagcatgcatcttggagtcttggccacagcctcccatgccatctccactggaaccctcttttccgttttctacaaaccaagaactagccgatctgattttattgtgagtgttaacaagtaccttgaagctaagaagcagaaaatatctgttggaatgaggtttaagatgagatttgaaggtgatgaggctcctgaaagaaggttcagtggaacaattattggcattggcagtttgccggcaatgtcaaaatctctgtgggcagattctgactggagatctctaaaggttcaatgggacgaaccttcatccattcttcgtccagatagaatctcaccatgggaagtggagcccctggatgctgctaatccacaatcccctcaacctccaccaaggcctaagcgtccacgacccccagcttcaccttgtatggtttcagaactgccttcaggttttggactctggaaatccccaacagaatcatcccgtacactctcattttcggaacctcaacgggctcgagagttatttccttcaattcccacatcaaccttctcatcttcatcaaacgtcagtttcaattcaaagaatgagccatccatgctaaccacacagttctactggtcagcaagggatacaagagctgactcctgcgctgctagcaccaacacagtcatagttgaaaagaagcaagagccaagttctggtggttgcagattgtttggaattgatatatgctcagctgaggaagaagtattacctgtggttactgctccaggtgttggttatgagcagactgctgcctctgtagagttgaactcggataagctctcacagggatctgatgtcaacaattctgatgccccagcagctagcagtgagcgttcacctcttgaatcccaaagccggcaagtgaggagctgcaccaaggtaattatgcaaggaatggcagttggaagggctgtagacctgacaaagcttagtggctacagtgatctttgccagaagttggaggagatgtttgacatccacggggagctaggttgcacactcaagaaatggcgggtcattttcactgatgatgaggatgacatgatgcttgttggggatgatccttgggatgagttttgcagaatggtgaaaaggatttacatttacacatatgaggaggcgaagaaactgacatccaagtcaaagttacctgttagcagtgacagcagcaagctgagtgctgtaaactcactgtctgaatga

SEQ ID NO: 18225 - protein, 657 aa, Sorghum bicolor
  misc_feature: The sequence is a functional homolog of SEQ ID NO 298 in the 10/412,699 US patent application
  misc_feature: The sequence is a functional homolog of SEQ ID NO 108 in the 10/225,066 US patent application
  misc_feature: The sequence is a functional homolog of SEQ ID NO 296 in the 10/412,699 US patent application
  misc_feature: The sequence is a functional homolog of SEQ ID NO 692 in the 11/479,226 US patent application
  misc_feature: The sequence is a functional homolog of SEQ ID NO 84 in the 10/374,780 US patent application
  misc_feature: Useful for making plants with modulated seed size
  misc_feature: Useful for making plants with modulated biomass
  misc_feature: Functional homolog of the protein sequence given in SEQ ID NO 13377
  misc_feature: The sequence is a functional homolog of SEQ ID NO 300 in the 10/412,699 US patent application
  misc_feature: Useful for biocontainment applications
  misc_feature: Useful for making plants with modulated flowering time
  misc_feature: Functional homolog of the protein sequence given in SEQ ID NO 13656
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 100 in the 10/666,642 US patent application
  misc_feature: Ceres ANNOT ID no. 8700968
  misc_feature (251)..(336): Pfam ID: Auxin_resp Pfam Description: Auxin response factor
  misc_feature (124)..(229): Pfam ID: B3 Pfam Description: B3 DNA binding domain
  misc_feature (493)..(638): Pfam ID: AUX_IAA Pfam Description: AUX/IAA family
MDAPNPAAAAGSGGMPSDALYRELWHACAGPLVTVPRQGERVYYFPQGHMEQLEASTHQQLDQYLPMFNLPPKILCSVVNVELRAEADSDEVYAQIMLQPEADQNELTSLDPEPQEPEKCTAHSFCKTLTASDTSTHGGFSVLRRHAEECLPQLDMSLNPPCQELVAKDLHGTEWHFRHIFRGQPKRHLLTTGWSVFVSSKRLVAGDAFIFMRGENGELRVGVRRLMRQVNSMPSSVISSHSMHLGVLATASHAISTGTLFSVFYKPRTSRSDFIVSVNKYLEAKKQKISVGMRFKMRFEGDEAPERRFSGTIIGIGSLPAMSKSLWADSDWRSLKVQWDEPSSILRPDRISPWEVEPLDAANPQSPQPPPRPKRPRPPASPCMVSELPSGFGLWKSPTESSRTLSFSEPQRARELFPSIPTSTFSSSSNVSFNSKNEPSMLTTQFYWSARDTRADSCAASTNTVIVEKKQEPSSGGCRLFGIDICSAEEEVLPVVTAPGVGYEQTAASVELNSDKLSQGSDVNNSDAPAASSERSPLESQSRQVRSCTKVIMQGMAVGRAVDLTKLSGYSDLCQKLEEMFDIHGELGCTLKKWRVIFTDDEDDMMLVGDDPWDEFCRMVKRIYIYTYEEAKKLTSKSKLPVSSDSSKLSAVNSLSE

SEQ ID NO: 18226 - DNA, 750 bp, Sorghum bicolor
  misc_feature: Ceres ANNOT ID no. 8700987
  misc_feature: Encodes the peptide sequence at SEQ ID NO 18227
atggaagcagcagcaggagtggaggtggaggagggcgtgatgagggtgctgctggtggacgactcccccgtcgaccgccgggtggcgcagctgctcctcagcagcaactcctgcgccggctcattccacgtcatcgccgtggacagcgcgaagaaggcgatggagttcctcggcctcaaggacggcggcggcaaggagcaggccatcgacatggtgctcacagactactgcatgcctgagatgaccggctacgacctcctcaaggccatcaaggcactgaaccctctgaagccgatcccggtcatcgtcatgtcgtcagaagacgagccccagaggatcagccggtgcctgagcgccggcgccgaggacttcatcgtgaagcccctgcagagcaaggacgtgcagcgcctccggaactgctccaccaccgcggccgcgaggcccagcagcaagggcgccgccgcgccgtgcgaggccgccgccgtggccaagcggaatagcaacaagccgccgctggtgctgccgccctcctccgccgccgccgccgccacgtcgccgtcgtcgggacggcgaccgaacctcgccggagtcgccatggtgctgcagtcgtcgagcgtggagctgtcgcagtacctgccgctgctgctcaagctcatcgtgctggcgtacgccgtgctgtgcctgggcgagctcctgcacagatggtcgtcgtcgggcggccgctgctcgctctccccgtggtgcgcctga

SEQ ID NO: 18227 - protein, 249 aa, Sorghum bicolor
  misc_feature: The sequence is a functional homolog of SEQ ID NO 932 in the 10/666,642 US patent application
  misc_feature: Ceres ANNOT ID no. 8700987
  misc_feature (14)..(129): SWISSPROT Homolog: EC 2.7.13.3 Histidine kinase
  misc_feature (14)..(138): Pfam ID: Response_reg Pfam Description: Response regulator receiver domain
MEAAAGVEVEEGVMRVLLVDDSPVDRRVAQLLLSSNSCAGSFHVIAVDSAKKAMEFLGLKDGGGKEQAIDMVLTDYCMPEMTGYDLLKAIKALNPLKPIPVIVMSSEDEPQRISRCLSAGAEDFIVKPLQSKDVQRLRNCSTTAAARPSSKGAAAPCEAAAVAKRNSNKPPLVLPPSSAAAAATSPSSGRRPNLAGVAMVLQSSSVELSQYLPLLLKLIVLAYAVLCLGELLHRWSSSGGRCSLSPWCA

SEQ ID NO: 18228 - DNA, 162 bp, Sorghum bicolor
  misc_feature: Ceres ANNOT ID no. 8700985
  misc_feature: Encodes the peptide sequence at SEQ ID NO 18229
atgccggatgttgcgtccaaaataatggccttttctcaacaaggcccgcacactacatgcataatttcagcaaacgacgctctgtgcatggcgacactgcgtcaaccagcaacctctggtgggatagtgacatatgaggtatattcaggatcaattgcttag

SEQ ID NO: 18229 - protein, 53 aa, Sorghum bicolor
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
  misc_feature: The sequence is a functional homolog of SEQ ID NO 374 in the 10/374,780 US patent application
  misc_feature: The sequence is a functional homolog of SEQ ID NO 604 in the 10/225,066 US patent application
  misc_feature: The sequence is a functional homolog of SEQ ID NO 1503 in the 11/479,226 US patent application
  misc_feature: The sequence is a functional homolog of SEQ ID NO 646 in the 11/435,388 US patent application
  misc_feature: The sequence is a functional homolog of SEQ ID NO 2536 in the 10/374,780 US patent application
  misc_feature: The sequence is a functional homolog of SEQ ID NO 264 in the 10/225,066 US patent application
  misc_feature: The sequence is a functional homolog of SEQ ID NO 1507 in the 11/479,226 US patent application
  misc_feature: The sequence is a functional homolog of SEQ ID NO 1446 in the 10/666,642 US patent application
  misc_feature: The sequence is a functional homolog of SEQ ID NO 2606 in the 10/374,780 US patent application
  misc_feature: The sequence is a functional homolog of SEQ ID NO 296 in the 10/225,066 US patent application
  misc_feature: The sequence is a functional homolog of SEQ ID NO 74 in the 11/375,241 US patent application
  misc_feature: The sequence is a functional homolog of SEQ ID NO 878 in the 10/412,699 US patent application
  misc_feature: The sequence is a functional homolog of SEQ ID NO 182 in the 10/666,642 US patent application
  misc_feature: The sequence is a functional homolog of SEQ ID NO 738 in the 10/412,699 US patent application
  misc_feature: Useful for making plants with modulated low light sensitivity
  misc_feature: Functional homolog of the protein sequence given in SEQ ID NO 13342
  misc_feature: The sequence is a functional homolog of SEQ ID NO 2836 in the 10/374,780 US patent application
  misc_feature: The sequence is a functional homolog of SEQ ID NO 446 in the 10/225,066 US patent application
  misc_feature: Ceres ANNOT ID no. 8700985
MPDVASKIMAFSQQGPHTTCIISANDALCMATLRQPATSGGIVTYEVYSGSIA

SEQ ID NO: 18230 - DNA, 1494 bp, Sorghum bicolor
  misc_feature: Ceres ANNOT ID no. 8700992
  misc_feature: Encodes the peptide sequence at SEQ ID NO 18231
atgccatcgccatcatcatcgcaggttctggtgcttctcgccgtcgctgtctccctcctttccggctccagctatgtcgctgccggcggacaccccgattacgccgacgcgctcgcgaaggcgatactcttcttccaggggcagcggtccggccagctgccgccggaccaggccgtcacgtggcgctccaactccggcctctccgacggctcggccgcaaacgtcgatctcaccggcggctactacgacggcggcgacaacgccaagttcggcttcccgatggccttcacgacgacgatgctatcgtggagcgtcctggagcacggcgggaagatgaaggcggcgcgcgtagtgcacgacgcgcgcgccgccgtgcggtggggcgcggactacctcctcaaggcggccacgcagacgccgggcacgctctacgtcggcgtgggcgacccggacgcggaccaccggtgctgggagcggcccgaggacatggacacgccgaggaccgtgtacgcagtgtccgcgtcggcgcccgggtccgacgtcgccggcgagacggcggccgcgctcgccgcggccagcttggtgttccgggccgccgaccgggcctactccaggaggctgctcgccgcggcgcgggccgtgatggagctcgccgtgctgcaccagggaaagtacagcgacttcgtcggcggcaacatcggcgcctactaccagtcgtactccggctacaaggacgagctcctgtgggggtcggcgtggctgctctgggcgaccaagaactcctcctacctcggctacctctactccttgggggacatcgacagaagcgtcgacatgttcagctgggacaacaagctcgccggagctcgcgtgctactgtcacggagagctctggtgaacggggacaagaggctggagccgttcaggcagcaggcggaggacttcttctgccggatcctgcgcgactccccatcctccacgacgcagtacacggccggcggcctgatgcacaagtccgggaacgccaacctgcagtacgtgacctcggcgagcttcctgctgaccacctacgccaagtacatggccgtcacgaagcacgccttcgcctgcgggagcctctccgtcacggccaggtcgctcagggctctcgccaagcagcaggtggactacatcctgggtgccaacgccaagggcatgtcgtacatggtgaacttcggcgcgcggtggccgcagaggatccaccaccgggcgtcgtcgctgccgccggtggccgcccacccggcccacatcgggtgccaggaggggttccagagctacttctacgccagcgccgccaacccgaacgtgcacacgggcgccgtcgtcggcgggcccgacgagcacgaggagttccccgacgaccgcgccgactacgcgcggtccgagccgacgacgtacaccaacgcgcccctcgtcggctgcctcgcctacctcgccggcacgtacaggagctag

SEQ ID NO: 18231 - protein, 497 aa, Sorghum bicolor
  misc_feature: Useful for making plants with altered cell wall content and/or composition
  misc_feature: Functional homolog of the protein sequence given in SEQ ID NO 14613
  misc_feature: Useful for making plants with altered carbohydrate content
  misc_feature: Functional homolog of the protein sequence given in SEQ ID NO 13691
  misc_feature: Useful for biocontainment applications
  misc_feature: Useful for making plants with modulated nitrogen use efficiency
  misc_feature: Functional homolog of the protein sequence given in SEQ ID NO 13445
  misc_feature: Ceres ANNOT ID no. 8700992
  misc_feature (30)..(497): SWISSPROT Homolog: EC 3.2.1.4 Cellulase
  misc_feature (33)..(489): Pfam ID: Glyco_hydro_9 Pfam Description: Glycosyl hydrolase family 9
MPSPSSSQVLVLLAVAVSLLSGSSYVAAGGHPDYADALAKAILFFQGQRSGQLPPDQAVTWRSNSGLSDGSAANVDLTGGYYDGGDNAKFGFPMAFTTTMLSWSVLEHGGKMKAARVVHDARAAVRWGADYLLKAATQTPGTLYVGVGDPDADHRCWERPEDMDTPRTVYAVSASAPGSDVAGETAAALAAASLVFRAADRAYSRRLLAAARAVMELAVLHQGKYSDFVGGNIGAYYQSYSGYKDELLWGSAWLLWATKNSSYLGYLYSLGDIDRSVDMFSWDNKLAGARVLLSRRALVNGDKRLEPFRQQAEDFFCRILRDSPSSTTQYTAGGLMHKSGNANLQYVTSASFLLTTYAKYMAVTKHAFACGSLSVTARSLRALAKQQVDYILGANAKGMSYMVNFGARWPQRIHHRASSLPPVAAHPAHIGCQEGFQSYFYASAANPNVHTGAVVGGPDEHEEFPDDRADYARSEPTTYTNAPLVGCLAYLAGTYRS

SEQ ID NO: 18232 - DNA, 618 bp, Sorghum bicolor
  misc_feature: Ceres ANNOT ID no. 8701000
  misc_feature: Encodes the peptide sequence at SEQ ID NO 18233
atggctcgtggtaaggttcagatgaggaagatcgaaaacccggtgcaccggcaggtaaccttctgcaagcggcgaatgggcctgctgaagaaagctaaggagttatctgttctatgtgatgctgctatcggtgtcatcgtgatctcccctcatggcaagatttatgacctagccaccaatgggaacatgcaaggtttgatcgagaggtacaggagaacctattcagaaaggcctggtgaaagtagcaaccacaacaaaacccagataataaaacaagaggtgttagcgttaacgcgtgaaattgatttgcttcaaaagggattcaggtacatgcatggagagaatgtagagaatgatataaaccacatgaatcttgacgagctccaaacccttgaaaataatcttgaaatgtgggtaaatagcattcgctcccagaagatgcagatcatctctagggagattgagatgctcagaaacaaggaagccatgctgcaggctgtcaatggcgtgcttcaggaaaggataattgagcagaatgggattctgaatttcagcaacacggcgatgacaccgcaaacaccattccagctaaccatggagagaaactactatttgtag

SEQ ID NO: 18233 - protein, 205 aa, Sorghum bicolor
  misc_feature: Useful for making plants with altered terpenoid content
  misc_feature: Functional homolog of the protein sequence given in SEQ ID NO 13094
  misc_feature: The sequence is a functional homolog of SEQ ID NO 1955 in the 10/412,699 US patent application
  misc_feature: The sequence is a functional homolog of SEQ ID NO 1949 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8701000
  misc_feature (9)..(59): Pfam ID: SRF-TF Pfam Description: SRF-type transcription factor (DNA-binding and dimerisation domain)
  misc_feature (74)..(177): Pfam ID: K-box Pfam Description: K-box region
MARGKVQMRKIENPVHRQVTFCKRRMGLLKKAKELSVLCDAAIGVIVISPHGKIYDLATNGNMQGLIERYRRTYSERPGESSNHNKTQIIKQEVLALTREIDLLQKGFRYMHGENVENDINHMNLDELQTLENNLEMWVNSIRSQKMQIISREIEMLRNKEAMLQAVNGVLQERIIEQNGILNFSNTAMTPQTPFQLTMERNYYL

SEQ ID NO: 18234 - DNA, 1035 bp, Sorghum bicolor
  misc_feature: Ceres ANNOT ID no. 8701017
  misc_feature: Encodes the peptide sequence at SEQ ID NO 18235
atggcggccttctcatccagcaacggcgtgccgccgggcttccggttccaccccaccgacgaggagctgctgctgtactacctcaagaagaaggtcggattcgagaagttcgacctcgaggtcatcagggaagtcgacctcaacaagatcgagccctgggagctgcaagagaggtgccggatcgggtcggcgccgcagaacgagtggtactttttcagccacaaggaccgcaagtacccgacggggtcgaggacgaaccgcgccacgaccgccggcttctggaaggccacgggccgggacaagtgcatccgcaccagctaccgcaagatcggcatgcgaaagactctcgtcttctaccgcggccgcgcccctcacggccagaagaccgactggatcatgcatgagtatcgccttgaggacgccgacgacgcccagggcggcaccagcgaggacggatgggtggtgtgccgcgtgttcaagaagaagtgcttcttcaagatcggcggcggcgaagggagcaccagccagggcgcggatgctggcgggcacctggccgtgtcgccgccgccgctcggcggacaccacgaccacgccagggccgccatggcgtacatgcacccgcacccgtactaccaccacgcatcctcctactactcccagatgcaggccccggcgccgccgcacgccgccgcgtactcgcaccacgtgcaggtccaggacctcctcaccaaccaccggcccacggtcgacgacggcgccggcaccgccggctacgacttctccggcctgccggtcgagcatcaccccggtggaggcctggacgtcggcagcagcgacggcgtcgccacggacggtggtggcggccagctggccggcgaagggagggaccaggccaccggtgcagccgcggagcagtggcaggcgattgatggtttcagcaacggcgggagtgcggcggtgcagcagatgactggcgccatgagttccggcgcccaacgaggtggggagatggatttgtggggttacgggaggtaa

SEQ ID NO: 18235 - protein, 344 aa, Sorghum bicolor
  misc_feature: Useful for making plants with altered carbohydrate content
  misc_feature: Functional homolog of the protein sequence given in SEQ ID NO 13622
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 344 in the 10/666,642 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Ceres ANNOT ID no. 8701017
  misc_feature (10)..(139): Pfam ID: NAM Pfam Description: No apical meristem (NAM) protein
MAAFSSSNGVPPGFRFHPTDEELLLYYLKKKVGFEKFDLEVIREVDLNKIEPWELQERCRIGSAPQNEWYFFSHKDRKYPTGSRTNRATTAGFWKATGRDKCIRTSYRKIGMRKTLVFYRGRAPHGQKTDWIMHEYRLEDADDAQGGTSEDGWVVCRVFKKKCFFKIGGGEGSTSQGADAGGHLAVSPPPLGGHHDHARAAMAYMHPHPYYHHASSYYSQMQAPAPPHAAAYSHHVQVQDLLTNHRPTVDDGAGTAGYDFSGLPVEHHPGGGLDVGSSDGVATDGGGGQLAGEGRDQATGAAAEQWQAIDGFSNGGSAAVQQMTGAMSSGAQRGGEMDLWGYGR

SEQ ID NO: 18236 - DNA, 753 bp, Sorghum bicolor
  misc_feature: Ceres ANNOT ID no. 8701036
  misc_feature: Encodes the peptide sequence at SEQ ID NO 18237
atggacgggtccggttcggccgccatcttcccgaacacgcgcacccccgaggatgtcttcacggatttccgcgcccgccgtgccggcattctcaaggcactcaccaccgatgtggagaagttctacaagttgtgcgacccagagaaggagaacttgtgcctctatggactatctaatgaaacctgggaagtgaccgttcctgctgaggaagttcctccagaactaccagagcccgcactgggaataaactttgctcgtgatggaatgccagagaaagattggctctcgctggtagctgtgcacagtgatgcatggttgattgctgtggcattttactttggggctcgcttcggatttgataaagatgccaggagacggctctacatgatgataaataatcatcccactgtatttgaagttgtgacaggaattgggaagaagcaaccaaaagcccccagctcaaatggcaaaaccaagtcgagttctaagaaacccaattctaacagcaagccagcaaagcagcctctgccaaagcaggagcaacagatcatcaaagaagatggaggcgacaaggatcaagcttacctgtgcggtacatgtggagggaggtattctaatgaagaattctggattggctgtgacatttgcgagaagtggtaccatggtgactgtgtccgcatcacacctgcgagggcagactacatcaagcagtacaaatgccccgcttgcagcaacaagagaagcagagagtga

SEQ ID NO: 18237 - protein, 250 aa, Sorghum bicolor
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: The sequence is a functional homolog of SEQ ID NO 1981 in the 11/479,226 US patent application
  misc_feature: Useful for making plants with altered alkaloid content
  misc_feature: Functional homolog of the protein sequence given in SEQ ID NO 13176
  misc_feature: Ceres ANNOT ID no. 8701036
  misc_feature (196)..(246): Pfam ID: PHD Pfam Description: PHD-finger
MDGSGSAAIFPNTRTPEDVFTDFRARRAGILKALTTDVEKFYKLCDPEKENLCLYGLSNETWEVTVPAEEVPPELPEPALGINFARDGMPEKDWLSLVAVHSDAWLIAVAFYFGARFGFDKDARRRLYMMINNHPTVFEVVTGIGKKQPKAPSSNGKTKSSSKKPNSNSKPAKQPLPKQEQQIIKEDGGDKDQAYLCGTCGGRYSNEEFWIGCDICEKWYHGDCVRITPARADYIKQYKCPACSNKRSRE

SEQ ID NO: 18238 - DNA, 432 bp, Sorghum bicolor
  misc_feature: Ceres ANNOT ID no. 8701051
  misc_feature: Encodes the peptide sequence at SEQ ID NO 18239
atggtggccaccccggtccagctccgcacaaccggccgcctcaccttctgctgctcctccttccccagcgcaccagggacagccaccaccaccaggcggccgcggcgattcgcggcggcgagggcgtccgcggagacgatggcgacggagaagctgggcatcaaggtggagcgcaacccgcccgagtcccgcctctccgagctcggcgtccgccagtggcccaagtgggggtgcgacaagagcaagttcccgtggacctactccgccaaggagacgtgctacctgctgcaggggaaggtgaaggtgtaccccgagggtcacggcgaggagttcgtggagatcgccgcgggggaccttgtcgtcttccccaagggcatgagctgcacctgggacgtcgccgaggccgtcgacaagcactacaacttcgagtag

SEQ ID NO: 18239 - protein, 143 aa, Sorghum bicolor
  misc_feature: Useful for making plants with modulated cold sensitivity
  misc_feature: Functional homolog of the protein sequence given in SEQ ID NO 13616
  misc_feature: Ceres ANNOT ID no. 8701051
  misc_feature (65)..(140): Pfam ID: Cupin_3 Pfam Description: Protein of unknown function (DUF861)
MVATPVQLRTTGRLTFCCSSFPSAPGTATTTRRPRRFAAARASAETMATEKLGIKVERNPPESRLSELGVRQWPKWGCDKSKFPWTYSAKETCYLLQGKVKVYPEGHGEEFVEIAAGDLVVFPKGMSCTWDVAEAVDKHYNFE

SEQ ID NO: 18240 - DNA, 990 bp, Sorghum bicolor
  misc_feature: Ceres ANNOT ID no. 8701096
  misc_feature: Encodes the peptide sequence at SEQ ID NO 18241
atggcagcatccacggcggcggcggtggcggtgccggaggtgtccctgcggtcgggcgacgcgaggccgatgccgatggtcggcatgggcacggcgcagttccccgtggtgaacgaggccaccaggaacgccgtgctggcggccatcgaggtgggtttccgccacttcgacacggccttcttgtacggcaccgaggagccgctcggcgaggccgcggccgaggccatccgccgcggcctcgtccggtcccgggaggacctgttcgtgacgtccaagctgtggtgcacgcagaaccacccgcacctcgtcctgccgtccctccgggaaactctcaagaacctgcagatggagtacgtggacctgtatctgatccactggccggtgtgcatcaagcccgggccgcccaagttcccgaacaagaaggaggacgcggtgccggtggacttcgagggcgtgtggcgcgccatggaggagtgccagcggctggggctcgcgagagccatcggcgtcagcaacttcaccaccaagcacctcgacagggtcctggccgtcgccacgatcccgccggcggtgaaccaggtggagctgaacccggcgtggcagcagcggacgctgagggcgtactgcgccgacaggggcatccacgtcgccgcctactcgccgctgggcgggcagaactgggacggccagggcaacgccgtgctggactccgaggtgctcgccgagatagccaaggccagagggaaaaccgtcgcgcaggtggcgttgcgatggatacatgagcagggagtgacgtccatcgccaagagctacaacaaggagaggctgaagcagaaccttgagatattcgactgggagctgaccgaggaggacaggctcaagatcagccagatcccgcagaggaaggttgtccaggctaccagcttgttctcggaagagggtgagttcacgtctgttgatcctgaagaaatgaatattgcagaggaatag

SEQ ID NO: 18241 - protein, 329 aa, Sorghum bicolor
  misc_feature: Useful for making plants with modulated drought sensitivity
  misc_feature: Functional homolog of the protein sequence given in SEQ ID NO 13495
  misc_feature: The sequence is a functional homolog of SEQ ID NO 26 in US patent 7193127
  misc_feature: Ceres ANNOT ID no. 8701096
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature (12)..(304): SWISSPROT Homolog: EC 2.3.1.170 6'-deoxychalcone synthase
  misc_feature (16)..(300): Pfam ID: Aldo_ket_red Pfam Description: Aldo/keto reductase family
MAASTAAAVAVPEVSLRSGDARPMPMVGMGTAQFPVVNEATRNAVLAAIEVGFRHFDTAFLYGTEEPLGEAAAEAIRRGLVRSREDLFVTSKLWCTQNHPHLVLPSLRETLKNLQMEYVDLYLIHWPVCIKPGPPKFPNKKEDAVPVDFEGVWRAMEECQRLGLARAIGVSNFTTKHLDRVLAVATIPPAVNQVELNPAWQQRTLRAYCADRGIHVAAYSPLGGQNWDGQGNAVLDSEVLAEIAKARGKTVAQVALRWIHEQGVTSIAKSYNKERLKQNLEIFDWELTEEDRLKISQIPQRKVVQATSLFSEEGEFTSVDPEEMNIAEE

SEQ ID NO: 18242 - DNA, 1800 bp, Sorghum bicolor
  misc_feature: Ceres ANNOT ID no. 8701097
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 18243
atggagaagccaagttttagtacgaaaatcatttacggagccggccatcaagtcatcttttatgatttcctagaaagtgagagccaggtggaaagccatcatatgcatgatgcaccgggcatatgtacattctctccgggatctactaatcgaacaatcaagcagcctccggaggcaagtgaggccagcaaagagaacagacgagcaacaatatctcctgttcctcttgcaaggagaaaaatcaggaggagcaaagtaacggcgctgattgacatggttctgacgcacgttcacgacctcgacgacgcagcggccgcgtcggccgtcgtgttcgcctcgagatacgttcaggacccgcttccaaggtacgagctgggggagaagtccatctccaaggacgcggcgtaccagatcatccacgacgagctgctgctggacagcagcccgcggctgaacctggcgtcgttcgtgaccacgtggatggagcccgagtgcgacaggctcatcctggagggcatcaacaagaactacgccgacatggacgagtaccccgtcaccaccgagctccagaaccggtgcgtcaacatcatcgcgcggctgttccacgcgcccgcggtgggcgccagcagcgacggcaaggccgtcggcgtcggcacggtgggttcctcggaggccatcatgctggccggtctggccttcaagcggcggtggcagaaccggcggaaggcggcgggcaagccctacgacaagcccaacatcgtcaccggtgccaacgtgcaggtgtgctgggagaagttcgccaggtacttcgaggtggagctcaaggaggtgaagctccgggaaggctgctacgtcatggaccccgacgaggccgtgcggatggtggacgagaacaccatctgcgtcgccgccatcctcggctccacgctcaccggcgagttcgaggacgtcaagatgctcaacgacctgctcgcggccaagaacgccgagacagggtgggacaccccgatccacgtggacgccgccagcggcggcttcatcgcgccgttcctgtacccggagctggagtgggacttccggctgccgctggtgaagagcatcaacgtcagcggccacaagtacggcctcgtctacgccggcgtcggctgggtcatctggaggagcaaggaggacctgcccgaggacctcatcttccacatcaactacctcggcgccgaccagcccaccttcacgctcaacttctccaaagggtctagtcaaatcatcgcgcaatattaccaatttcttcgattaggcttcgaggggtaccgcaacgtgatggagaactgcatggagagcgctcagacgctgcgggaggggctggagcagatgggccgcttcaccatcatctccaaggagcagggcgtgccgctggtggccttcacgttcaagagcaaggacgagacctcgctggcgttcaagctgtcgtcggagctgcgccggtacgggtggatcgtcccggcgtacacgatgccggcgaacctggagcacatggccgtgctccgcgtcgtggtctgggaggacttcggccggccgctggcggagcggttcctgtcccacgtgcggatggcgctggaggagctcgaccacgcggccaagggcgggcccgtgcccaggatgcgggtcaccatcgagctcggacctcccgacaggggctccggcgaggaggcgtccgccagggttgtcaagcgggaggccgtcgtggtgccggtgcaccgcagcgtgtcgctctccggcgggaagaccaagggcgtctgctag

SEQ ID NO: 18243 - protein, 599 aa, Sorghum bicolor
  misc_feature: Useful for making plants with modulated nitrogen use efficiency
  misc_feature: Functional homolog of the protein sequence given in SEQ ID NO 14115
  misc_feature: Ceres ANNOT ID no. 8701097
  misc_feature (92)..(599): SWISSPROT Homolog: EC 4.1.1.15 Glutamate decarboxylase
  misc_feature (121)..(477): Pfam ID: Pyridoxal_deC Pfam Description: Pyridoxal-dependent decarboxylase conserved domain
MEKPSFSTKIIYGAGHQVIFYDFLESESQVESHHMHDAPGICTFSPGSTNRTIKQPPEASEASKENRRATISPVPLARRKIRRSKVTALIDMVLTHVHDLDDAAAASAVVFASRYVQDPLPRYELGEKSISKDAAYQIIHDELLLDSSPRLNLASFVTTWMEPECDRLILEGINKNYADMDEYPVTTELQNRCVNIIARLFHAPAVGASSDGKAVGVGTVGSSEAIMLAGLAFKRRWQNRRKAAGKPYDKPNIVTGANVQVCWEKFARYFEVELKEVKLREGCYVMDPDEAVRMVDENTICVAAILGSTLTGEFEDVKMLNDLLAAKNAETGWDTPIHVDAASGGFIAPFLYPELEWDFRLPLVKSINVSGHKYGLVYAGVGWVIWRSKEDLPEDLIFHINYLGADQPTFTLNFSKGSSQIIAQYYQFLRLGFEGYRNVMENCMESAQTLREGLEQMGRFTIISKEQGVPLVAFTFKSKDETSLAFKLSSELRRYGWIVPAYTMPANLEHMAVLRVVVWEDFGRPLAERFLSHVRMALEELDHAAKGGPVPRMRVTIELGPPDRGSGEEASARVVKREAVVVPVHRSVSLSGGKTKGVC

SEQ ID NO: 18244 - DNA, 1506 bp, Sorghum bicolor
  misc_feature: Ceres ANNOT ID no. 8701197
  misc_feature: Encodes the peptide sequence at SEQ ID NO 18245
atgggcttcgccgctgctgccgccgacgacgccggcaagccgcacgccgtgctggtgccgttcccggcgcagggccacgtcacgccgatgctgaagctgggaaagatcctccactgctggggcttccacgtcaccttcgtgaacagcgagtacaaccaccgccgcctgctccggtcccgcggcgcgggcgcgctcgacggcctcccgggcttccgcttcgccaccatcccggacggcctgccgccgtccgacgcggacgccacccaggacgttccctccctctgccgctccacggaggagacctgcctcccgcatttcagggccctgctccaagctctcaacgccgcctcatcatcccctgacgacgacgtgccgccgccggtcacctgcgtcgtcggcgacggcaccatgagctttaccttggaggccgccagggagatcggcgtcccgtgcgctctcctctggactgccagcgcctgcggttacatgggctaccgttactaccgcaccctcatcgacaagggcatcttcccgttgaaagaggagcagctgacgaacgggttcttggacacgccggtggacgggatgagcaagcacatgaggctcaaggacttcccaagcttcatccgctccacggaccccgacgagttcatggtccactacgccattagggtgacgggtcagacagccggcgcggacgccgtcgtcctcaacaccttcgacgagctcgagcaggaggcgctcgacgccatgcgcgccgagacgatcccacctgcagcgacgtccatcaacaccatcggcccgctcgccctcctcgccgagcagatcgtgcccaagggcggccaccaccagctcgacgcgctgggctccaacctctggaaggaggacgtgtcctgcttccgctggctcgacggcagggcgcccaggtcggtggtgtacgtgaactacggcagcatcacggtgatgaccgacgaggagctggtggagttcgcgtggggtctggccaacagcggccacgacttcctgtggatcatccggccggacctcgtcagtggcgacgccgccgtgctgccgccggagttccgggaggcgaccaaagggcgcggcctgctggcgagctggtgcccgcaggacgcggtgctgcggcacgaggcggtgggcgtgttcctgacgcactccgggtggaactcgacgctggagagcctctgcgccggggtgccaatgctgtgctggccgttcttcgcggagcagcagaccaactgccggtacaagtgcacggagtggggcgtgggcgtggagatcggccacgacgtgcggcgggaggccgtggaggcgaagatacgggaggccatggacggggaggaaggaaaggagatgcgtcgccgcgcgttggagtggcgggacaccgccgtgcgcgcgacgcagcccggcgggcgctcgtacgccaatctgcagaagctggtgactgacgtgctcctctcgggtggcaatggcaagagttcttaa

SEQ ID NO: 18245 - protein, 501 aa, Sorghum bicolor
  misc_feature: Useful for making plants with altered carbohydrate content
  misc_feature: Functional homolog of the protein sequence given in SEQ ID NO 14546
  misc_feature: Ceres ANNOT ID no. 8701197
  misc_feature (139)..(488): SWISSPROT Homolog: EC 2.4.1.121 Indole-3-acetate beta-glucosyltransferase
  misc_feature (16)..(495): Pfam ID: UDPGT Pfam Description: UDP-glucoronosyl and UDP-glucosyl transferase
MGFAAAAADDAGKPHAVLVPFPAQGHVTPMLKLGKILHCWGFHVTFVNSEYNHRRLLRSRGAGALDGLPGFRFATIPDGLPPSDADATQDVPSLCRSTEETCLPHFRALLQALNAASSSPDDDVPPPVTCVVGDGTMSFTLEAAREIGVPCALLWTASACGYMGYRYYRTLIDKGIFPLKEEQLTNGFLDTPVDGMSKHMRLKDFPSFIRSTDPDEFMVHYAIRVTGQTAGADAVVLNTFDELEQEALDAMRAETIPPAATSINTIGPLALLAEQIVPKGGHHQLDALGSNLWKEDVSCFRWLDGRAPRSVVYVNYGSITVMTDEELVEFAWGLANSGHDFLWIIRPDLVSGDAAVLPPEFREATKGRGLLASWCPQDAVLRHEAVGVFLTHSGWNSTLESLCAGVPMLCWPFFAEQQTNCRYKCTEWGVGVEIGHDVRREAVEAKIREAMDGEEGKEMRRRALEWRDTAVRATQPGGRSYANLQKLVTDVLLSGGNGKSS

SEQ ID NO: 18246 - DNA, 2085 bp, Sorghum bicolor
  misc_feature: Ceres ANNOT ID no. 8701210
  misc_feature: Encodes the peptide sequence at SEQ ID NO 18247
atgtcggcctcgtcctcgtccctgtgcggcggggacccggcgatgaggagcgtggtgtggttccggagggacctcagggtggaggacaacccggcgcttgcggcggcggcgcgtgccggtggggaggtagtgccggcgtacgtctggtcgccagaggaagagggcccttattaccccgggcgtgtgtcccggtggtggatcagccagagtctgaagcacctggacgcctcgctccgccgcctaggtgcaggaaagctcgtcacgcggaggtcggccgacgccgtcgttgcgctcctccagctggtccgcgacaccggcgccacgcacgtctacttcaatcatctatacgacccgatctcactagtcagggatcaccggttgaaggagatgctggcggctgagggcatcgttgtgcaatctttcaatgcggatctgctgtatgagccatgggaagttgtcgatgatgaagggcaaccattcaccatgttcactgcattctggaacaggtgcctcagcatgcagtatgatccccctgcaccacttctgcccccgaagaagatcaattcaggtgacttatcgatgtgtccatcggaagatctgatctttgaggatgattcagagaggggaagcaacgctcttctggcccgagcatggacaccagggtggcagaacgcagacaaggcactgacagccttcctcaatggtccattggctgactactcagtgaaccgtaagaaggctgatagtgcgagcacatccctactctcacctcacctgcatttcggtgagcttagtgtgcgcaaggttttccacctagttcgtatgaagcagcttgtgtggagtaacgagggcaaccacgctgctgaggagagctgcaccttgtttctccgttccattggcctgcgggagtactctcggtacctgagcttcaatcacccaagcagccatgagaggcccctcttggcgcatctcaggtttttcccctgggtggtcaatgagagctactttaagatttggaggcagggaaggactgggtacccgctcgttgatgctggcatgagggaactgtgggcgacaggatggttgcatgaccggatacgtgtggtggtttcaagcttctttgtcaaggtccttcaacttccatggcgatggggtatgaagtacttctgggacacattactggatgctgatcttgaaagcgatgcactgggctggcagtacatcactggctctcttcctgatagtcgagagcttgaccgcatcgacaatccgcagtttgaaggctacaagttcgacccgcatggggagtatgtccgacggtggattcctgagctcgtaaggctgccgacagaatggatacatcatccatgggatgcacctgtttccgtgctgcaagctgcaggaattgagctgggatccaactatcccctccccatagttgagctagacgcggccaaagccagactgcaagaagccctatcagaaatgtggcagctggaggcagcatcaagggccaccatgaacaatggaatggaggaaggcctcggtgattcctcagaggttccatttcctgaagaattacagatggaagtcgatcggcagcgagcccaggcaacagccaatgtggtgatgactgttcggaggcgtgaggatcagatggtgcctaccatgacctcttcattgaacagagctgaaacagaggtttccgccgatctagggaacagtgaggacactagggcacaggttccgtttcatgcacatttccatccccgagttgagagggaagacatgatccagaatactgaaggccctgcacttagaatcaatggcactcaccaacacaacatctttcagcaacctcagaatcataggcgagaagctcttgctccatcagtgtcggaggcttcaagtagctggaccggcagagagggcgctgtggtcccagtttggtcacctcctgcagcatcaggccattcagaaacttttgctgctgatgaagctgacgtttctagtaggagttatttggataggcatccacagtcgcaccggttgatgaactggagtcaattatcacagtcattgtga

SEQ ID NO: 18247 - protein, 694 aa, Sorghum bicolor
  misc_feature: Useful for making plants with modulated light quality response
  misc_feature: Useful for making plants with modulated low light sensitivity
  misc_feature: Useful for making plants with modulated nitrogen use efficiency
  misc_feature: Functional homolog of the protein sequence given in SEQ ID NO 13918
  misc_feature: Useful for making plants with modulated light quality sensitivity
  misc_feature: Functional homolog of the protein sequence given in SEQ ID NO 13499
  misc_feature: Ceres ANNOT ID no. 8701210
  misc_feature: Up-regulated in root tissues in response to methyl jasmonate treatment
  misc_feature: Down-regulated in shoot tissues in response to aminocyclopropane carboxylic treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature (16)..(494): SWISSPROT Homolog: EC 4.1.99.3 Deoxyribodipyrimidine photo-lyase
  misc_feature (219)..(497): Pfam ID: FAD_binding_7 Pfam Description: FAD binding domain of DNA photolyase
  misc_feature (15)..(188): Pfam ID: DNA_photolyase Pfam Description: DNA photolyase
MSASSSSLCGGDPAMRSVVWFRRDLRVEDNPALAAAARAGGEVVPAYVWSPEEEGPYYPGRVSRWWISQSLKHLDASLRRLGAGKLVTRRSADAVVALLQLVRDTGATHVYFNHLYDPISLVRDHRLKEMLAAEGIVVQSFNADLLYEPWEVVDDEGQPFTMFTAFWNRCLSMQYDPPAPLLPPKKINSGDLSMCPSEDLIFEDDSERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVNESYFKIWRQGRTGYPLVDAGMRELWATGWLHDRIRVVVSSFFVKVLQLPWRWGMKYFWDTLLDADLESDALGWQYITGSLPDSRELDRIDNPQFEGYKFDPHGEYVRRWIPELVRLPTEWIHHPWDAPVSVLQAAGIELGSNYPLPIVELDAAKARLQEALSEMWQLEAASRATMNNGMEEGLGDSSEVPFPEELQMEVDRQRAQATANVVMTVRRREDQMVPTMTSSLNRAETEVSADLGNSEDTRAQVPFHAHFHPRVEREDMIQNTEGPALRINGTHQHNIFQQPQNHRREALAPSVSEASSSWTGREGAVVPVWSPPAASGHSETFAADEADVSSRSYLDRHPQSHRLMNWSQLSQSL

SEQ ID NO: 18248 - DNA, 1446 bp, Sorghum bicolor
  misc_feature: Ceres ANNOT ID no. 8701202
  misc_feature: Up-regulated in root tissues in response to methyl jasmonate treatment
  misc_feature: Down-regulated in shoot tissues in response to aminocyclopropane carboxylic treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 18249
atgggctccatcggtgccgacgacgccgatcgccggccgcacgccgtgtgcgtgccgttcccagcgcagggccacgtcacgccgatgctgaagctggccaagatcctccacggccggggcttccacatcaccttcgtcaacacggagttcaaccaccgccgcctgctccgctcccgcggcgccggcgcgctcgacggcctcccggacttccgcttcgccgccatcccggagggtctgcccccgtccgacgtcgacgccacccaggacgtgccgtcgctctgccgcgccaccatggagaactgcctcccgcatttcacgagcctcctcgccgagctcaactcctccccggacgtgccgccggtcacttgcgtcgtcggcgacgacgtcatgagcttcaccctggaagcagccagagacatcgccgtgccgtgcgccctcttctggacggccagcgtctgcggctacatgggctaccgctattaccgcgacctcatggagaagggcatcttcccgctcaaagacgccgagcagctgacgaacgggttcttggacacgccggcggcggactgggcgccggggatgagcaagcacttccggctcaaggacttcccaagcttcatgcgctcgacggaccccgacgagttcatgttccacttcgccctgaaggtgacggagcagatagccggcgcggacgccgttgtcctcaacaccttcgacgagctcgagcaggaggcgctggacgccatgcgcgccatgatcccgccgtccgcgtccatccacaccattggcccgctcgccttcctcgccgaggagatagtggcaccgggaggcccgaccgacgcgctaggctccaacgtccaacctctggaaggacgacgtctcctgcttcgactggctccacggcagggcgcccaggagctggtggaattcgcgtggggcctggccaacagcggccacgacttcctgtggatcatccggccggacctcgtcaacggcgacgccgccgtgctgccgccggagttcctggagaccatcaggggccgcggacacctggcgagctggtgtccgcaggaggcggtgctgaggcacgaggcggtgggcgtgttcctgacgcactccgggtggaactcgaccatggagagcctgtgcgccggggtgcccatgctgtgctggcctttcttcgcggagcagcagaccaactgccggtacaagtgcgtggagtggggcgtggccatggagatcggccacgacgtccggcgtgaggtggtggaggagaagatcagagaggtgatgggtggggagaaaggaaagcagatgcaccgccgtgcggtggagtggcaggagactggtctccgcgcgacaaggtccggagggcgctcatacgccaacctcgacaagctggtcgccgacgtgctcctctcgggtggcggcgacaagagttcctga

SEQ ID NO: 18249 - protein, 481 aa, Sorghum bicolor
  misc_feature: Useful for making plants with altered carbohydrate content
  misc_feature: Functional homolog of the protein sequence given in SEQ ID NO 14546
  misc_feature: Ceres ANNOT ID no. 8701202
  misc_feature (13)..(468): SWISSPROT Homolog: EC 2.4.1.115 Anthocyanidin 3-O-glucosyltransferase
  misc_feature (15)..(479): Pfam ID: UDPGT Pfam Description: UDP-glucoronosyl and UDP-glucosyl transferase
MGSIGADDADRRPHAVCVPFPAQGHVTPMLKLAKILHGRGFHITFVNTEFNHRRLLRSRGAGALDGLPDFRFAAIPEGLPPSDVDATQDVPSLCRATMENCLPHFTSLLAELNSSPDVPPVTCVVGDDVMSFTLEAARDIAVPCALFWTASVCGYMGYRYYRDLMEKGIFPLKDAEQLTNGFLDTPAADWAPGMSKHFRLKDFPSFMRSTDPDEFMFHFALKVTEQIAGADAVVLNTFDELEQEALDAMRAMIPPSASIHTIGPLAFLAEEIVAPGGPTDALGSNVQPLEGRRLLLRLAPRQGAQELVEFAWGLANSGHDFLWIIRPDLVNGDAAVLPPEFLETIRGRGHLASWCPQEAVLRHEAVGVFLTHSGWNSTMESLCAGVPMLCWPFFAEQQTNCRYKCVEWGVAMEIGHDVRREVVEEKIREVMGGEKGKQMHRRAVEWQETGLRATRSGGRSYANLDKLVADVLLSGGGDKSS

SEQ ID NO: 18250 - DNA, 1506 bp, Sorghum bicolor
  misc_feature: Ceres ANNOT ID no. 8701251
  misc_feature: Encodes the peptide sequence at SEQ ID NO 18251
atggacgacgaacccaaggacgacggcaagggccacaaaggaaaggccgtcgtcgaccaccatgccggcgccgctgaccagcatgaacaaccggaaagccaggaggagttcttcagcgactccgagtcgggctgcgagtccatcgaggtcgccgacctcaagaagcgcatgtggaaggaccagctgcttctcatgaagctcgagggccggtcgggccgtgaccaccgccgccacggcggcgaggggcagctccagctccagcccggcagtactgacgacgtcctgatccaggtcaaggatgaggagtcgcccgagaaccggtaccgtcgcaaggcgatgctccgggcgcaggacggcgtcatccgccacatgctcaagatgatggaggcctgcaacgcgcgcgggttcgtgtacggcgtcgtggacgagaccggcgtgcccgtgtccggctcctccgacagcctccgcggctggtggaaggacgaggtgggcttcgaccgggcggggccgatggcgctctccgccctggaccaggagtgccccggcgggagcccgatggcggcggcgtcgttcctgcacggcctgcacgacatccaggacagcacgctggggtccctgctgtcggcgctcatccagcactgcgagcccccgcagcggagcttcccgctggaccgcggcctggcgccgccgtggtggccgacggggcgggaggcgtggtggggcatgcagggcgatgcgccggcgcaccagggcccgccgccgtaccggaagccccacgacctgaagaaggcgtggaagatctcgctgctgagcgcggtgatcaagcacctcacgccgcgcttcgaccagatgcgcaagctcgtgtggcagtccaagcggctgcagcacaagatgagcgccagggacgccgacgcctggtccaaggtcatcacccaggaggaggcgctcgaccgccgcgcgcagcgcgcgctgcagatcacgccgctcgacgaggaggaagaggacgacgacgacggtggccccgacgccggcgccgacgctagtggtgtcgattctccgctagccgcagcgcagcacgtcgagaagcgcaagcgcaaggtcggcggcgaggggggcacgggtagtagtagcggcgccggcgtcgacgtcgacgtcggcaaggagttgctgctggcgctgccggacatagattgcgtgcccgatgctgaccgcagctcgatcgacgagctcatgaagctctattaccgctgcctgcaggggaccgacgacggcgagcacaaggcgaagggcgcggtggcagtcccagacggagggcagcaggctgcgccggtgacgcacgacagcatgctccaaggaggtttacagcgcggcgggaccgcgcccgacgggtcggcggcggtgcatgacgacgacatgatgctccaaagtcttctgggaatcgctgacgtcgtggacatgagtgacttcccaaacagcccgatttggcagtggggggtttacgactga

SEQ ID NO: 18251 - protein, 501 aa, Sorghum bicolor
  misc_feature: The sequence is a functional homolog of SEQ ID NO 1361 in the 11/479,226 US patent application
  misc_feature: Ceres ANNOT ID no. 8701251
  misc_feature (33)..(404): Pfam ID: EIN3 Pfam Description: Ethylene insensitive 3
MDDEPKDDGKGHKGKAVVDHHAGAADQHEQPESQEEFFSDSESGCESIEVADLKKRMWKDQLLLMKLEGRSGRDHRRHGGEGQLQLQPGSTDDVLIQVKDEESPENRYRRKAMLRAQDGVIRHMLKMMEACNARGFVYGVVDETGVPVSGSSDSLRGWWKDEVGFDRAGPMALSALDQECPGGSPMAAASFLHGLHDIQDSTLGSLLSALIQHCEPPQRSFPLDRGLAPPWWPTGREAWWGMQGDAPAHQGPPPYRKPHDLKKAWKISLLSAVIKHLTPRFDQMRKLVWQSKRLQHKMSARDADAWSKVITQEEALDRRAQRALQITPLDEEEEDDDDGGPDAGADASGVDSPLAAAQHVEKRKRKVGGEGGTGSSSGAGVDVDVGKELLLALPDIDCVPDADRSSIDELMKLYYRCLQGTDDGEHKAKGAVAVPDGGQQAAPVTHDSMLQGGLQRGGTAPDGSAAVHDDDMMLQSLLGIADVVDMSDFPNSPIWQWGVYD

SEQ ID NO: 18252 - DNA, 1122 bp, Sorghum bicolor
  misc_feature: Ceres ANNOT ID no. 8701265
  misc_feature: Encodes the peptide sequence at SEQ ID NO 18253
atggcggcgagagctcatcatctgctcctgcgactcgcgctgctgtgcgcgtgcgcgtgcgccgccgccctcggctcggccaatgcggcggggaggaagatggtcggcgtgtacgagctcaaggcgggcgatttctccgtcagcgtcaccaactggggcgccaccatcacctccgtcgtcctcccggattccaaagggaatttggctgacgttgtgcttggctatgacaccattggaggatatgtgagtggtaaaagctactttggagcccttgttggacgagtagccaacagaattgcctatgcacgcttcgtgcttgatggaaaagcttatcatctttttaaaaacgatggcaacaacacacttcatggtggccataggggtttcagtcaggttatatggacggttaaagaatttgtcgccggcggtgactcgccctacatcacactgtactaccatagtttcgatggagaacaaggtttcccaggcgacctggacgtgtacgtgacgtacgagctggcgtccccgtacgagctgcgcgtgcacatgaacgcgacggccgcgaacaaggcgacgccggtgaacctggcgcagcacacgtactggaacctgggcggggagggcagcggcgacgtcctccacaacacggtgcagctgttcgcgtcgcggtacacgcccgtggacagcgcgctcatcccgacgggcgtcgtggcgcccgtggccggcacgccctacgacttcctggccccgacgcccgtgggcgcgcgcatccgccaggtctccggcggcaaggccggcatctacggctacgacaccaactacgccgtggacggggacgacgccggcgccggggcggcgctgcggaaggtggccgtcgtccgggacggcaagtcggggcgggcgatggagctgtgggcgaaccagcctggggtgcagttctacacgggcaacttcctccaggacgtcgaggggaagggcggcaaggtgtatggccagtacggcgcgctgtgcctcgagacgcagggcttcccggacgccgtgaaccaccccagctttccctcccagatcgtcagtccggggcaggtgtacaagcacgacatggtgttcaagttctccttttag

SEQ ID NO: 18253 - protein, 373 aa, Sorghum bicolor
  misc_feature: Useful for making plants with altered oil content
  misc_feature: Functional homolog of the protein sequence given in SEQ ID NO 13360
  misc_feature: Ceres ANNOT ID no. 8701265
  misc_feature (30)..(372): SWISSPROT Homolog: EC 5.1.3.3 Aldose 1-epimerase
  misc_feature (36)..(370): Pfam ID: Aldose_epim Pfam Description: Aldose 1-epimerase
MAARAHHLLLRLALLCACACAAALGSANAAGRKMVGVYELKAGDFSVSVTNWGATITSVVLPDSKGNLADVVLGYDTIGGYVSGKSYFGALVGRVANRIAYARFVLDGKAYHLFKNDGNNTLHGGHRGFSQVIWTVKEFVAGGDSPYITLYYHSFDGEQGFPGDLDVYVTYELASPYELRVHMNATAANKATPVNLAQHTYWNLGGEGSGDVLHNTVQLFASRYTPVDSALIPTGVVAPVAGTPYDFLAPTPVGARIRQVSGGKAGIYGYDTNYAVDGDDAGAGAALRKVAVVRDGKSGRAMELWANQPGVQFYTGNFLQDVEGKGGKVYGQYGALCLETQGFPDAVNHPSFPSQIVSPGQVYKHDMVFKFSF

SEQ ID NO: 18254 - DNA, 1692 bp, Sorghum bicolor
  misc_feature: Ceres ANNOT ID no. 8701282
  misc_feature: Encodes the peptide sequence at SEQ ID NO 18255
atggcaaaggctctcctaggtggcctgtcggcgatcctcgtcgtcgcagtggtcgtcggcgtggtcgccaccgtcactcgctccggcaagaaggccggcgacaacttcaacgtcccgggggatgcctcccttgccacgtccggcaagtcggtcaagtccctgtgcgcgcccacgctgtacaaggattcgtgcgagaagacgctctcccaggccaccaatggaaccgagaaccccaaggagatcttccacagcgtcgccaaggtggcgctggagtcggtgaagacggcggtggagcagtccaagaacatcggcgaggccaaggccagcgacaagatgacagagagcgcgcgcgaggactgcaagaagctcctcgaggacgccgtggacgacctcaggggcatgctggatatggccggcggcgacatcaaggtgctcttcagccggtccgacgacctcgagacgtggctcacgggcgtgatgacgttcatggacacctgcatcgacggcttcgtggacgagaagctcagggccgacatgcactcggtgctgcgcaacgccaccgagctcagcagcaacgcgctcgccatcaccaacagcctcggcgggatcctgaagaagctggacctcgacatgttcaagaaggactcgcggcgccggctgctgtcgtcggagcaggacgagaaggggtggcccgtgtggatgaggtcgccggagaggaagctgctggcggcgggcaaccagcctaagccgaacgccgtggtggccaaggacggcagcgggcagttcaagagcatccagcaggccgtggacgccatgcccaagggccagcaggggaggtacgtcatctacgtgaaggccggtgtctacgacgagatcgtcatgatcgccaaggacaaggtcaacatcttcatgtacggcgacgggcccaagaatacccgcgtgaccggccagaagagcttcgccgacggcatcaccaccatgaagaccgccaccttctccatcgaggcggccgggttcatctgcaagaacatggggttccacaacacggccggcgcggcgaagcaccaggcggtggcgctccgcgtccagggcgacctcgcggcgttctacaactgcaggttcgacgcgttccaggacacgctgtacgtgcacgccaggcggcagttcttccgcaactgcgtcatctccggcaccatcgacttcatcttcggcaactcggcggcggtgttccagaactgcctcatcatcacgcggcggcccatggacaaccagcagaactcggtgacggcgcacgggcgcacggaccccaacatgaagtccgggatcgtcatccagaactgccggctggtgcccgaccagaagctcttcgccgaccgcttcaagatcccctcgtacctgggccgtccatggaaggagttctcgcgcctcgtcatcatggagagcaccatcgccgacttcatcaagccggaggggtacatgccctggaacggcgacttcggcatcaagacgctcttctacgccgagtacaacaaccgcgggcccggcgccggcaccagcaagagggtcaactggcctgggttccacgtcatcacccggaaggacgccgagcagttcaccgccgggccgttcatcgacggcgcgctgtggctcaagttcaccggcacgccgcacatcctcgggttcaagtcctaa

SEQ ID NO: 18255 - protein, 563 aa, Sorghum bicolor
  misc_feature: Useful for making plants with altered cell wall content and/or composition
  misc_feature: Functional homolog of the protein sequence given in SEQ ID NO 14614
  misc_feature: Ceres ANNOT ID no. 8701282
  misc_feature (30)..(560): SWISSPROT Homolog: EC 3.1.1.11 Pectinesterase
  misc_feature (251)..(547): Pfam ID: Pectinesterase Pfam Description: Pectinesterase
  misc_feature (45)..(196): Pfam ID: PMEI Pfam Description: Plant invertase/pectin methylesterase inhibitor
MAKALLGGLSAILVVAVVVGVVATVTRSGKKAGDNFNVPGDASLATSGKSVKSLCAPTLYKDSCEKTLSQATNGTENPKEIFHSVAKVALESVKTAVEQSKNIGEAKASDKMTESAREDCKKLLEDAVDDLRGMLDMAGGDIKVLFSRSDDLETWLTGVMTFMDTCIDGFVDEKLRADMHSVLRNATELSSNALAITNSLGGILKKLDLDMFKKDSRRRLLSSEQDEKGWPVWMRSPERKLLAAGNQPKPNAVVAKDGSGQFKSIQQAVDAMPKGQQGRYVIYVKAGVYDEIVMIAKDKVNIFMYGDGPKNTRVTGQKSFADGITTMKTATFSIEAAGFICKNMGFHNTAGAAKHQAVALRVQGDLAAFYNCRFDAFQDTLYVHARRQFFRNCVISGTIDFIFGNSAAVFQNCLIITRRPMDNQQNSVTAHGRTDPNMKSGIVIQNCRLVPDQKLFADRFKIPSYLGRPWKEFSRLVIMESTIADFIKPEGYMPWNGDFGIKTLFYAEYNNRGPGAGTSKRVNWPGFHVITRKDAEQFTAGPFIDGALWLKFTGTPHILGFKS

SEQ ID NO: 18256 - DNA, 453 bp, Sorghum bicolor
  misc_feature: Ceres ANNOT ID no. 8701289
  misc_feature: Encodes the peptide sequence at SEQ ID NO 18257
atgtcgaggaggaagaccagggagcccaaggaggagaacgttacacttggacccactgtccgtgaaggagagtatgtctttggtgttgctcacatctttgcatccttcaatgacaccttcattcatgtcactgatttgtctgggagggaaactctggttcggatcactggtggcatgaaggtcaaagctgatcgtgatgagtcgtcgccttatgctgctatgcttgcttctcaagatgttgcacagcgttgcaaggagcttggtatcactgcgctgcacattaagcttcgtgccactgggggcaacaagaccaagacccctggacctggtgctcagtctgctctcagggcccttgctcgttctgggatgaaaattggacgcattgaggatgttaccccggttcccactgacagcactcgcagaaagggtggtaggaggggaaggaggctgtag

SEQ ID NO: 18257 - protein, 150 aa, Sorghum bicolor
  misc_feature: Useful for making plants with modulated biomass
  misc_feature: Functional homolog of the protein sequence given in SEQ ID NO 14542
  misc_feature: Ceres ANNOT ID no. 8701289
  misc_feature (28)..(146): Pfam ID: Ribosomal_S11 Pfam Description: Ribosomal protein S11
MSRRKTREPKEENVTLGPTVREGEYVFGVAHIFASFNDTFIHVTDLSGRETLVRITGGMKVKADRDESSPYAAMLASQDVAQRCKELGITALHIKLRATGGNKTKTPGPGAQSALRALARSGMKIGRIEDVTPVPTDSTRRKGGRRGRRL

SEQ ID NO: 18258 - DNA, 483 bp, Sorghum bicolor
  misc_feature: Ceres ANNOT ID no. 8701313
  misc_feature: Encodes the peptide sequence at SEQ ID NO 18259
atggcgcttagcaactttttatatcaacaataccttttggattctctggatgtggcattacttaactgtgctttcacattcaatagttctggcaaagggaggcagttgatgggacaagatctttccggattaggtgtcaagggacttcaaaatctagaaaatcagctagagatgagcgttcgttgcatccggacaaaaaaggaccaactcctggttgatgaaattcacgaactgaatcgaaagggaagtctcatccaacaagacaacatggaattacacagaaaggtcaacctaattcgccaggaaaatgccgaattatacaagctctatgagaaagaagcagcaggtgaagtcaaccgagattcaacaactccatacaactttgcagttgcagagaatgccaacattcctatccatcttgagcttaatactacaccgcaagaacatgatgttgagccacctgcggctcctaaattagggtaa

SEQ ID NO: 18259 - protein, 160 aa, Sorghum bicolor
  misc_feature: The sequence is a functional homolog of SEQ ID NO 2197 in the 10/666,642 US patent application
  misc_feature: The sequence is a functional homolog of SEQ ID NO 2199 in the 10/666,642 US patent application
  misc_feature: Useful for making plants with altered lignin content
  misc_feature: Functional homolog of the protein sequence given in SEQ ID NO 13210
  misc_feature: The sequence is a functional homolog of SEQ ID NO 2195 in the 10/666,642 US patent application
  misc_feature: The sequence is a functional homolog of SEQ ID NO 2189 in the 10/666,642 US patent application
  misc_feature: Ceres ANNOT ID no. 8701313
  misc_feature (8)..(98): Pfam ID: K-box Pfam Description: K-box region
MALSNFLYQQYLLDSLDVALLNCAFTFNSSGKGRQLMGQDLSGLGVKGLQNLENQLEMSVRCIRTKKDQLLVDEIHELNRKGSLIQQDNMELHRKVNLIRQENAELYKLYEKEAAGEVNRDSTTPYNFAVAENANIPIHLELNTTPQEHDVEPPAAPKLG

SEQ ID NO: 18260 - DNA, 855 bp, Sorghum bicolor
  misc_feature: Ceres ANNOT ID no. 8701323
  misc_feature: Encodes the peptide sequence at SEQ ID NO 18261
atggccggcggtcccgcggcggtgtcgttcctgaccaacatcgcgaaggcggccgctgggctcggaatcgcggcctccctcacctcagcgtcgctctacaccgtcgacggcggcgagcgcgccgtcatcttcgaccggttccgcggggtgctcccggagacggtcggcgagggcacccatttcctcgtgccgtggctgcagaagcccttcatcttcgacatccgcacgcggccgcacaacttctcctccaactccgggaccaaggacctgcagatggtcaacctcacgctccgcctcctctcccgccccgacgtccagcacctccccaccatcttcacctccctcggcctcgagtacgacgacaaggtgctcccctccatcggcaacgaggtgctcaaggccgtcgtcgcccagttcaacgccgaccagctcctcaccgagcgcccccacgtctccgcgctcgtccgcgacgcgctcatccgccgcgcccgcgagttcaacatcatcctggacgacgtcgccatcacccacctctcctacggtatcgagttctccctggccgttgagaagaagcaggtcgcgcagcaggaggccgagcgctccaagttcctcgtcgccaaggcggagcaggagaggcgggcggccatcgtgcgcgccgagggagagagcgagtccgcgcgcctcatctctgaggccacggcgatggctgggacagggctgatcgagctcaggaggatcgaggcggccaaggagattgccgcagagctggctcgctcgccaaatgtggcatacattccttctggggaaaacggaaagatgctgcttggtctcaatgctgcgggatttggtcggtga

SEQ ID NO: 18261 - protein, 284 aa, Sorghum bicolor
  misc_feature: Useful for making plants with modulated biomass
  misc_feature: Functional homolog of the protein sequence given in SEQ ID NO 14547
  misc_feature: Ceres ANNOT ID no. 8701323
  misc_feature (33)..(212): Pfam ID: Band_7 Pfam Description: SPFH domain / Band 7 family
MAGGPAAVSFLTNIAKAAAGLGIAASLTSASLYTVDGGERAVIFDRFRGVLPETVGEGTHFLVPWLQKPFIFDIRTRPHNFSSNSGTKDLQMVNLTLRLLSRPDVQHLPTIFTSLGLEYDDKVLPSIGNEVLKAVVAQFNADQLLTERPHVSALVRDALIRRAREFNIILDDVAITHLSYGIEFSLAVEKKQVAQQEAERSKFLVAKAEQERRAAIVRAEGESESARLISEATAMAGTGLIELRRIEAAKEIAAELARSPNVAYIPSGENGKMLLGLNAAGFGR

SEQ ID NO: 18262 - DNA, 300 bp, Sorghum bicolor
  misc_feature: Ceres ANNOT ID no. 8701310
  misc_feature: Encodes the peptide sequence at SEQ ID NO 18263
atggggcgcggcaagatagtgatccgccggatcgacaactccacgagccggcaggtgacgttctccaaacggcggaacgggatcttcaagaaggcaagggagctcggcatcctctgtgatgcggaggtcggactggtcatcttctccagcaccggtcggctctacgaatacgccagcacaagcatgaagtcagtgattgatcgatatggtcgagcgaaggaggagcagcagcttgtagcaaaccccaacacagaacttaaggccaccgaaccaacaattctagtttgctataatcactag

SEQ ID NO: 18263 - protein, 99 aa, Sorghum bicolor
  misc_feature: The sequence is a functional homolog of SEQ ID NO 1701 in the 10/412,699 US patent application
  misc_feature: The sequence is a functional homolog of SEQ ID NO 2199 in the 10/666,642 US patent application
  misc_feature: The sequence is a functional homolog of SEQ ID NO 2189 in the 10/666,642 US patent application
  misc_feature: The sequence is a functional homolog of SEQ ID NO 2197 in the 10/666,642 US patent application
  misc_feature: Useful for making plants with altered lignin content
  misc_feature: Functional homolog of the protein sequence given in SEQ ID NO 13210
  misc_feature: The sequence is a functional homolog of SEQ ID NO 2191 in the 10/666,642 US patent application
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 2193 in the 10/666,642 US patent application
  misc_feature: The sequence is a functional homolog of SEQ ID NO 2195 in the 10/666,642 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: The sequence is a functional homolog of SEQ ID NO 1366 in the 10/666,642 US patent application
  misc_feature: The sequence is a functional homolog of SEQ ID NO 1730 in the 10/412,699 US patent application
  misc_feature: The sequence is a functional homolog of SEQ ID NO 207 in the 11/479,226 US patent application
  misc_feature: The sequence is a functional homolog of SEQ ID NO 64 in the 10/412,699 US patent application
  misc_feature: Useful for biocontainment applications
  misc_feature: Functional homolog of the protein sequence given in SEQ ID NO 14236
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: Useful for making plants with modulated flowering time
  misc_feature: Useful for making plants with altered alkaloid content
  misc_feature: Functional homolog of the protein sequence given in SEQ ID NO 13525
  misc_feature: Useful for making plants with modulated biomass
  misc_feature: Functional homolog of the protein sequence given in SEQ ID NO 13528
  misc_feature: The sequence is a functional homolog of SEQ ID NO 42 in the 10/666,642 US patent application
  misc_feature: The sequence is a functional homolog of SEQ ID NO 730 in the 10/666,642 US patent application
  misc_feature: The sequence is a functional homolog of SEQ ID NO 32 in the 10/666,642 US patent application
  misc_feature: The sequence is a functional homolog of SEQ ID NO 1470 in the 10/666,642 US patent application
  misc_feature: The sequence is a functional homolog of SEQ ID NO 284 in the 10/666,642 US patent application
  misc_feature: Useful for making plants with altered terpenoid content
  misc_feature: Functional homolog of the protein sequence given in SEQ ID NO 13438
  misc_feature: The sequence is a functional homolog of SEQ ID NO 14 in the 10/666,642 US patent application
  misc_feature: The sequence is a functional homolog of SEQ ID NO 122 in the 10/225,066 US patent application
  misc_feature: The sequence is a functional homolog of SEQ ID NO 234 in the 10/374,780 US patent application
  misc_feature: The sequence is a functional homolog of SEQ ID NO 1454 in the 10/374,780 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 4 in US patent 7057087
  misc_feature: The sequence is a functional homolog of SEQ ID NO 729 in the 10/666,642 US patent application
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 2 in US patent 7273968
  misc_feature: The sequence is a functional homolog of SEQ ID NO 46 in the 10/666,642 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 30 in the 10/666,642 US patent application
  misc_feature: The sequence is a functional homolog of SEQ ID NO 14 in the 10/374,780 US patent application
  misc_feature: The sequence is a functional homolog of SEQ ID NO 328 in the 10/225,066 US patent application
  misc_feature: The sequence is a functional homolog of SEQ ID NO 34 in the 10/286,264 US patent application
  misc_feature: The sequence is a functional homolog of SEQ ID NO 468 in the 11/435,388 US patent application
  misc_feature: The sequence is a functional homolog of SEQ ID NO 68 in the 10/412,699 US patent application
  misc_feature: The sequence is a functional homolog of SEQ ID NO 707 in the 10/666,642 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 2 in US patent 7049489
  misc_feature: The sequence is a functional homolog of SEQ ID NO 1971 in the 10/412,699 US patent application
  misc_feature: The sequence is a functional homolog of SEQ ID NO 731 in the 10/666,642 US patent application
  misc_feature: The sequence is a functional homolog of SEQ ID NO 1973 in the 10/412,699 US patent application
  misc_feature: The sequence is a functional homolog of SEQ ID NO 1949 in the 10/412,699 US patent application
  misc_feature: The sequence is a functional homolog of SEQ ID NO 1961 in the 10/412,699 US patent application
  misc_feature: The sequence is a functional homolog of SEQ ID NO 1884 in the 10/412,699 US patent application
  misc_feature: The sequence is a functional homolog of SEQ ID NO 352 in the 10/374,780 US patent application
  misc_feature: The sequence is a functional homolog of SEQ ID NO 384 in the 10/225,066 US patent application
  misc_feature: The sequence is a functional homolog of SEQ ID NO 946 in the 10/412,699 US patent application
  misc_feature: The sequence is a functional homolog of SEQ ID NO 2232 in the 10/374,780 US patent application
  misc_feature: The sequence is a functional homolog of SEQ ID NO 232 in the 10/225,068 US patent application
  misc_feature: The sequence is a functional homolog of SEQ ID NO 310 in the 10/225,066 US patent application
  misc_feature: The sequence is a functional homolog of SEQ ID NO 919 in the 10/666,642 US patent application
  misc_feature: The sequence is a functional homolog of SEQ ID NO 1110 in the 10/225,066 US patent application
  misc_feature: The sequence is a functional homolog of SEQ ID NO 166 in the 10/374,780 US patent application
  misc_feature: The sequence is a functional homolog of SEQ ID NO 1812 in the 10/412,699 US patent application
  misc_feature: The sequence is a functional homolog of SEQ ID NO 568 in the 10/412,699 US patent application
  misc_feature: The sequence is a functional homolog of SEQ ID NO 1945 in the 10/412,699 US patent application
  misc_feature: The sequence is a functional homolog of SEQ ID NO 1947 in the 10/412,699 US patent application
  misc_feature: Useful for making plants with modulated nitrogen use efficiency
  misc_feature: Functional homolog of the protein sequence given in SEQ ID NO 13191
  misc_feature: The sequence is a functional homolog of SEQ ID NO 4 in US patent 7303918
  misc_feature: The sequence is a functional homolog of SEQ ID NO 1951 in the 10/412,699 US patent application
  misc_feature: The sequence is a functional homolog of SEQ ID NO 1056 in the 10/225,066 US patent application
  misc_feature: The sequence is a functional homolog of SEQ ID NO 1882 in the 10/412,699 US patent application
  misc_feature: The sequence is a functional homolog of SEQ ID NO 350 in the 10/374,780 US patent application
  misc_feature: The sequence is a functional homolog of SEQ ID NO 944 in the 10/412,699 US patent application
  misc_feature: The sequence is a functional homolog of SEQ ID NO 1965 in the 10/412,699 US patent application
  misc_feature: The sequence is a functional homolog of SEQ ID NO 1955 in the 10/412,699 US patent application
  misc_feature: The sequence is a functional homolog of SEQ ID NO 1953 in the 10/412,699 US patent application
  misc_feature: The sequence is a functional homolog of SEQ ID NO 1967 in the 10/412,699 US patent application
  misc_feature: The sequence is a functional homolog of SEQ ID NO 216 in the 10/225,066 US patent application
  misc_feature: The sequence is a functional homolog of SEQ ID NO 2454 in the 10/374,780 US patent application
  misc_feature: The sequence is a functional homolog of SEQ ID NO 1963 in the 10/412,699 US patent application
  misc_feature: The sequence is a functional homolog of SEQ ID NO 1886 in the 10/412,699 US patent application
  misc_feature: The sequence is a functional homolog of SEQ ID NO 2146 in the 10/374,780 US patent application
  misc_feature: The sequence is a functional homolog of SEQ ID NO 948 in the 10/412,699 US patent application
  misc_feature: The sequence is a functional homolog of SEQ ID NO 1969 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8701310
  misc_feature (9)..(59): Pfam ID: SRF-TF Pfam Description: SRF-type transcription factor (DNA-binding and dimerisation domain)
MGRGKIVIRRIDNSTSRQVTFSKRRNGIFKKARELGILCDAEVGLVIFSSTGRLYEYASTSMKSVIDRYGRAKEEQQLVANPNTELKATEPTILVCYNH

SEQ ID NO: 18264 - DNA, 1770 bp, Sorghum bicolor
  misc_feature: Ceres ANNOT ID no. 8701320
  misc_feature: Encodes the peptide sequence at SEQ ID NO 18265
atggatcccgtcctcgctcctactcgatctaaaaggacccaaccaccactagacgcgccccaaccccttgcggaaacgagatgtttaggtcataaatccaaccgcaaaaacaagcagagcgtcagtggagaaaggggatcgaagcagcggcggcccaaaatcaagagaggaggagaagccgaggggcgcaggagaaggggagcacgaagggtacctctgcgtgctgtcgtcctcgtcgagctccggcgttcgaattgggggtgcgcgaagagacggcgctgcctggggtctagaaaagggccgtctccgagtcccgctgcccaatcatatggtgacgcgtgtcctcgccaacgtggcagccctaatcccgcgcggccgcgcggtgcatgtggtcatctggcccacctggcagacggacgggcggctgagccatcgacgaattcaaggccgtcacgacgtgtggggaccggactgcctgctccacatgtcagggtcgtcgatgacgcgaccggcgatgaggccacccctcgccgcgccaaatggtggtacgtgacgttccacaacgtcacggcgatggtcggcgccggcgtgctcagcctgccgtacgccatggctcacctaggatggggacccgggctggtggcgctgctggcgtcgtgggggatcacgctgtacacgctgcggctgctgatcgagctgcacgagtgcgttccgggcgtgcggttcgaccggctccgcgacctcggcgcgcatgcgctgggcccgcgcctggggccctgggtggtggtgccgcagcagctcatcgtgcagctcggctgcgacatggtgtacatggtcacgggcggcaagtgcctgcagaagttcgccgagtccgtgtgccctcgctgcgcgccgctgcaccagtcctactggatctgcatcttcggctccttccagttcctgctttcccagcttcccaacctcgacgccatcaccgccgtgtccttcgccgccgccgccatgtcactctgctactcgaccatctcgtgggcggcgtgcgtggcgcgcgggccggtgcgcggggtgagctacgcgtacaaggccggcacggcggcggactcgacgttccgggtgttcagcgcgctggggcaggtggcgttcgcgtacgcggggcacggcgtggtgctggagatccaggccaccatcccgtccacgccaaccaagccgtccagagcgcccatgtggaagggcaccgtcgccgcgtacctcgtcaccgccgcctgctacttccccgtcgcgctcctcgggtactgggccttcggccgcgacgtcggcgacaacgtcctcgtcgcgctgcagcgcccgccctggctcgtcgccgccgccaacatgatggtcgtcatccatgtcgtcggaagctaccaggtgtatgcgatgccaatattcgaaagcatcgagacgattctggtgacaagattcaggctgccgcaaggactactcctccgtctcgtggcccgatcggcttacgtcgcattcacgctgttcatcgcggtgaccttcccgttcttcggcgacctcctcggcttcttcggagggtttgggttcacgccgacctcctacttcctcccctgcattctgtggctgaagatcaagaagccgccgaggttcagcgcgtcgtggtgtgccaactggggctgcatcgtcgtcggagtgctgctgatgattgtgtccaccatcggcggcttacggagcatcgtccaagacgcgtcgacgttccagttctactcctga

SEQ ID NO: 18265 - protein, 589 aa, Sorghum bicolor
  misc_feature: Useful for making plants with altered oil content
  misc_feature: Functional homolog of the protein sequence given in SEQ ID NO 13448
  misc_feature: Ceres ANNOT ID no. 8701320
  misc_feature (177)..(576): Pfam ID: Aa_trans Pfam Description: Transmembrane amino acid transporter protein
MDPVLAPTRSKRTQPPLDAPQPLAETRCLGHKSNRKNKQSVSGERGSKQRRPKIKRGGEAEGRRRRGARRVPLRAVVLVELRRSNWGCAKRRRCLGSRKGPSPSPAAQSYGDACPRQRGSPNPARPRGACGHLAHLADGRAAEPSTNSRPSRRVGTGLPAPHVRVVDDATGDEATPRRAKWWYVTFHNVTAMVGAGVLSLPYAMAHLGWGPGLVALLASWGITLYTLRLLIELHECVPGVRFDRLRDLGAHALGPRLGPWVVVPQQLIVQLGCDMVYMVTGGKCLQKFAESVCPRCAPLHQSYWICIFGSFQFLLSQLPNLDAITAVSFAAAAMSLCYSTISWAACVARGPVRGVSYAYKAGTAADSTFRVFSALGQVAFAYAGHGVVLEIQATIPSTPTKPSRAPMWKGTVAAYLVTAACYFPVALLGYWAFGRDVGDNVLVALQRPPWLVAAANMMVVIHVVGSYQVYAMPIFESIETILVTRFRLPQGLLLRLVARSAYVAFTLFIAVTFPFFGDLLGFFGGFGFTPTSYFLPCILWLKIKKPPRFSASWCANWGCIVVGVLLMIVSTIGGLRSIVQDASTFQFYS

SEQ ID NO: 18266 - DNA, 846 bp, Sorghum bicolor
  misc_feature: Ceres ANNOT ID no. 8701329
  misc_feature: Encodes the peptide sequence at SEQ ID NO 18267
atggtctgctcccagctcaccgccgcgggggcctcctccctcgccaccgcagcggttcgttcccgggcgcattccccagccgccgccttcgcgcaactacggtcgacgcctcgcattgcgagcgctggcttgtcggttaagggaaacagggcggctcttccgttggtcgccgccgcggggccggccgcggcggcgccggtggccgacctggacggccccccggccacggagaagcagcccatcattgtcatcgataactacgacagcttcacctacaacctctgccagtatatgggggagcttggattgaactttgaagtataccgcaatgatgaactgaccatagaagatgtaaagaggaagaacccaagaggaatacttatttctccagggcctggtgaaccacaagattcaggaatatcattgcaggctgttcttgaattaggcccaaccatcccaatttttggagtttgcatgggcctgcagtgcattggggaggcatttgggggaaagattatccgtgctccttctggagtgatgcatgggaaaagctctccagtttattacgacgaggaattaggaaaggccttattcaatggcttgccaaacccttttaccgctgcgaggtaccacagcttggtcattgaggaagaaaccttcccgcatgatgctttagaggccactgcatggactgaagatggacttatcatggctgctcgccacaagaagtacaaacacatccagggtgtccaattccacccggagagcatcatcacccctgacggcaagaaaatcatcctcaatttcgtcagattcattgaggaactggagaagcagcgttcctag

SEQ ID NO: 18267 - protein, 281 aa, Sorghum bicolor
  misc_feature: Useful for making plants with altered carbon content
  misc_feature: Functional homolog of the protein sequence given in SEQ ID NO 13357
  misc_feature: Ceres ANNOT ID no. 8701329
  misc_feature (81)..(270): SWISSPROT Homolog: EC 4.1.3.27 Anthranilate synthase
  misc_feature (82)..(272): Pfam ID: GATase Pfam Description: Glutamine amidotransferase class-I
MVCSQLTAAGASSLATAAVRSRAHSPAAAFAQLRSTPRIASAGLSVKGNRAALPLVAAAGPAAAAPVADLDGPPATEKQPIIVIDNYDSFTYNLCQYMGELGLNFEVYRNDELTIEDVKRKNPRGILISPGPGEPQDSGISLQAVLELGPTIPIFGVCMGLQCIGEAFGGKIIRAPSGVMHGKSSPVYYDEELGKALFNGLPNPFTAARYHSLVIEEETFPHDALEATAWTEDGLIMAARHKKYKHIQGVQFHPESIITPDGKKIILNFVRFIEELEKQRS

SEQ ID NO: 18268 - DNA, 942 bp, Sorghum bicolor
  misc_feature: Ceres ANNOT ID no. 8701355
  misc_feature: Encodes the peptide sequence at SEQ ID NO 18269
atgggcgcgccgctgctccgccgccgcctcctgctgtccctcgcgctcctggccgcctgctgcgccgcggtggggacagcggcggcggcgaaagcgaaagcgcccaggctgtcgcccaactactaccgccacagctgcccgcgggtgcagcggatcgtgtcggacgtcatcgcggcgaagcagcgcgccaacccgtcgacggcggcgggcacgctgcggctcttcttccacgactgcttcgtcaacggctgcgacgcctccgtgctggcggcgctggagtccgcctgccccggcgtggtgtcctgcgccgacgtcctggcgctggcggcgcgggacctcgtggggatccttggcgggccacggttccccgtcgcgctgggccgccgcgactccgcccgctccgaggcgcgcgacgtggagggcaacctgccacgcaccaacatgtcggcgcgcgccatggtgcggctcttcgcgggcaaggggctctcggcccgggagatggtggcgctggccggcgcccacaccgtgggcttctcccactgcgccgagttcgcgcaccgcatctacggataccggggcccgggcgccgccggcgccggggccggccacgacccgcggctcaacccggagttcgcccgcgcgctgcagcgctcctgcgcggggtaccggaccgaccccaccgtctccatcttcaacgacatcgtcacgcccagtgagttcgacgaggcatactacaagaacctgccccacgggctgggcctgctcgcctccgacgccgccatctgggagtacccgcccaccagggtgttcgcgcagcggtactccgccaaccgcaccgccttcttcgaggacttcgccgccgccatgcagaggctcggcgccgtcggcgtcaagaccgggcgccagggcgtcgtcagacgccgctgcgacgcgctcgactga

SEQ ID NO: 18269 - protein, 313 aa, Sorghum bicolor
  misc_feature: Useful for making plants with altered carbohydrate content
  misc_feature: Functional homolog of the protein sequence given in SEQ ID NO 13617
  misc_feature: Ceres ANNOT ID no. 8701355
  misc_feature (88)..(310): SWISSPROT Homolog: EC 1.11.1.7 Peroxidase
  misc_feature (53)..(277): Pfam ID: peroxidase Pfam Description: Peroxidase
MGAPLLRRRLLLSLALLAACCAAVGTAAAAKAKAPRLSPNYYRHSCPRVQRIVSDVIAAKQRANPSTAAGTLRLFFHDCFVNGCDASVLAALESACPGVVSCADVLALAARDLVGILGGPRFPVALGRRDSARSEARDVEGNLPRTNMSARAMVRLFAGKGLSAREMVALAGAHTVGFSHCAEFAHRIYGYRGPGAAGAGAGHDPRLNPEFARALQRSCAGYRTDPTVSIFNDIVTPSEFDEAYYKNLPHGLGLLASDAAIWEYPPTRVFAQRYSANRTAFFEDFAAAMQRLGAVGVKTGRQGVVRRRCDALD

SEQ ID NO: 18270 - DNA, 339 bp, Sorghum bicolor
  misc_feature: Ceres ANNOT ID no. 8701357
  misc_feature: Encodes the peptide sequence at SEQ ID NO 18271
atggctcccagcaagctcgccgtggtcatcgccttggtggcgtctctcctcctgctcaccaacatcaacaccaaggctgctccgggtccgggcggctacccgccggctcctccgctcggccctccgccgcaccagatcgtcgaccccgccaaagactgcgggggcgcgtgcgacgtgcggtgcggcgcgcagtcgcggaagaaccggtgcgcccgggcgtgcctcaagtgctgcagcgtctgccgctgcgtgccggcgggcacggccggcaaccagcagacgtgcggcaagtgctacaccgactggatcacgcacggcaacaggaccaagtgcccgtga

SEQ ID NO: 18271 - protein, 112 aa, Sorghum bicolor
  misc_feature: Useful for making plants with altered terpenoid content
  misc_feature: Functional homolog of the protein sequence given in SEQ ID NO 14097
  misc_feature: Ceres ANNOT ID no. 8701357
  misc_feature (4)..(112): Pfam ID: GASA Pfam Description: Gibberellin regulated protein
MAPSKLAVVIALVASLLLLTNINTKAAPGPGGYPPAPPLGPPPHQIVDPAKDCGGACDVRCGAQSRKNRCARACLKCCSVCRCVPAGTAGNQQTCGKCYTDWITHGNRTKCP

SEQ ID NO: 18272 - DNA, 1467 bp, Sorghum bicolor
  misc_feature: Ceres ANNOT ID no. 8701409
  misc_feature: Encodes the peptide sequence at SEQ ID NO 18273
atggctggggagctcgtgctggccgctgtggcgaccctgctcgcgtcgtcgctcctggctctggtgctcagccacttcctgcctttgcttctgaatcccaaggcccccaagggaagcttcgggtggccgctcctcggcgagacgctgcggttcctcacgccgcacgcgtccaacacgctgggcggcttcctggaggatcactgctccaggtatgggcaggtgttcaagtcccacctgttctgcacccccacggtggtgtcctgcgaccaggacctcaaccacttcatcctgcagaacgaggagcggctgttccagtgcagctaccccaggccgatccatggcatcctgggcaagtcctccatgctcgtggtcctgggcgaggaccacaagcgcctcaggaacctcgccctcgccctcgtcacctccaccaagctcaagcccagctacctcggcgacatcgagaagatcgcgctgcacgtcgtcggcgcatggcgacgacacgacggcggcggcggcggcggcggcggcggcggcgtcagagtcatcgccttctgcgaggaggcaagaaagttcgcattcagtgtgatagtgaagcaggtgctggggctgtcaccagaggagccggtcactgcaaggatactggaggacttcctggccttcatgaagggcctcatctccttccctctctacatcccagggaccccatatgccaaggctgtccaggcgagggagaggatatccaacactgtgaagggcatcatcgaggagcggaggagtgctgggtcatgcaacaagggtgacttccttgacgtgctgctgtcaagcaacgagctctctgacgaggagaaagtgagcttcgtgctggactccctgctgggaggatatgagaccacctcgctcctcatctccatggtcgtttacttccttgggcagtctgctcaagatctggacctggttaagagggagcacgacagcataagatccaacaaagggaaggaggagtgcttgacttcagaagactacaagaagatggaatatacccaacaagttatcaacgaggcgctgagatgtggcaacattgtcaagtttgtccaccggaaggcgctcaaagatgtcaaatacaaagagtatctgattccatctggctggaaggtcctaccggtcttcagcgctgttcatctgaacccctcacttcatggaaacgcacaacagtttcagccctgtagatgggaggggacaagccaagggacaagcaagaggtttacaccgttcggtggtggcccccggctctgcccaggatcagagcttgctaaagtagaggctgctttcttcctccatcaccttgtcctcaattatagatggagaattgatggcgatgacattccgatggcatacccatatgtggagtttcagagaggtctgccaatagaaatcgagccaacttcacctgaatctggactgtcctga

SEQ ID NO: 18273 - protein, 488 aa, Sorghum bicolor
  misc_feature: Useful for making plants with modulated oxidative stress sensitivity
  misc_feature: Functional homolog of the protein sequence given in SEQ ID NO 14548
  misc_feature: Ceres ANNOT ID no. 8701409
  misc_feature (34)..(475): SWISSPROT Homolog: EC 1.14.13.93 (+)-abscisic acid 8'-hydroxylase
  misc_feature (36)..(480): Pfam ID: p450 Pfam Description: Cytochrome P450
MAGELVLAAVATLLASSLLALVLSHFLPLLLNPKAPKGSFGWPLLGETLRFLTPHASNTLGGFLEDHCSRYGQVFKSHLFCTPTVVSCDQDLNHFILQNEERLFQCSYPRPIHGILGKSSMLVVLGEDHKRLRNLALALVTSTKLKPSYLGDIEKIALHVVGAWRRHDGGGGGGGGGGVRVIAFCEEARKFAFSVIVKQVLGLSPEEPVTARILEDFLAFMKGLISFPLYIPGTPYAKAVQARERISNTVKGIIEERRSAGSCNKGDFLDVLLSSNELSDEEKVSFVLDSLLGGYETTSLLISMVVYFLGQSAQDLDLVKREHDSIRSNKGKEECLTSEDYKKMEYTQQVINEALRCGNIVKFVHRKALKDVKYKEYLIPSGWKVLPVFSAVHLNPSLHGNAQQFQPCRWEGTSQGTSKRFTPFGGGPRLCPGSELAKVEAAFFLHHLVLNYRWRIDGDDIPMAYPYVEFQRGLPIEIEPTSPESGLS

SEQ ID NO: 18274 - DNA, 633 bp, Sorghum bicolor
  misc_feature: Ceres ANNOT ID no. 8701414
  misc_feature: Encodes the peptide sequence at SEQ ID NO 18275
atgtcgtacgcctacctcttcaagtacatcatcatcggcgacacaggcgtcggcaagtcgtgcctgctgctgcagttcaccgacaagcggttccagcccgtccacgacctcaccatcggcgtcgagttcggggcccggatgatcaccatcgacaacaagcccatcaagctccagatttgggacacggctgggcaagagtcattcagatccataactaggtcatactacagaggcgctgctggtgctcttttggtctacgatatcactaggagggagactttcaaccaccttgcaagctggctggaggatgcgaggcagcatgcgaatgctaacatgacgataatgcttgtcgggaacaagtgtgatctgtctcacaggcgtgcagtgagctatgaggaaggcgagcagtttgcaaaggaacatggacttatcttcatggaggcatctgcaaagaccgcgcagaatgtcgaggaggcatttgttaagaccgctggagcaatctacaagaaaattcaagatggtgtttttgatgtatctaatgagtcttatggaatcaaagttggatatgtagtccctggccaatctggaggtgctggtagctcgtcttctcaaggtggtagctgctgcagctaa

SEQ ID NO: 18275 - protein, 210 aa, Sorghum bicolor
  misc_feature: Useful for making plants with altered lignin content
  misc_feature: Functional homolog of the protein sequence given in SEQ ID NO 13076
  misc_feature: Useful for making plants with altered alkaloid content
  misc_feature: Functional homolog of the protein sequence given in SEQ ID NO 13220
  misc_feature: Ceres ANNOT ID no. 8701414
  misc_feature (8)..(127): SWISSPROT Homolog: EC 2.7.11.1 Non-specific serine/threonine protein kinase
  misc_feature (8)..(169): Pfam ID: Ras Pfam Description: Ras family
  misc_feature (8)..(122): Pfam ID: Miro Pfam Description: Miro-like protein
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTIMLVGNKCDLSHRRAVSYEEGEQFAKEHGLIFMEASAKTAQNVEEAFVKTAGAIYKKIQDGVFDVSNESYGIKVGYVVPGQSGGAGSSSSQGGSCCS

SEQ ID NO: 18276 - DNA, 1464 bp, Sorghum bicolor
  misc_feature: Ceres ANNOT ID no. 8701453
  misc_feature: Encodes the peptide sequence at SEQ ID NO 18277
atgcttgctcgtcttcttcccctgctcctcctcctcctgctgcttgctgctgcctccaacgcttgtgattgcgctggcaggcagccgccgatcagcagcaggaggagcttccccgaggggttcatcttcgggacggcgtcggcagcctatcagtacgagggtggtgcaatggaggggagcagagggccaagcatctgggacaccttcactcatcagcatccagataaaattgctaacagaagcaatggggatgtggcagtggattcctaccatctctacaaggaagatgtgcgcatcatgaagagtatgggaatggatgcctacaggttttcaatctcctggagtagaattcttccatatggaagtctgagcggtggagtcaacagagagggcatcagatactacaataacttgatcgatgagcttctgttgaaagggatacagccatttgtgaccctttttcactgggattcacctcaggcgttggaagataaatatggaggatttcttagtcctaacattatcaacgactacaaggactatgctgaggtttgctttaaagaatttggtgaccgagtgaaacactggatcacgttcaatgagccctggagcttctgctcaggtgggtatgcatctggcacgtttgcgccgggccggtgctcaccatgggagcagggcaagtgcagcgctggggattcaggaacagagccttacactgtctgccatcatcagattctcgcccatgcagaaacagtccgattgtacaaggaaaaatataaggtggagcaaaaaggaaatattggaataactctagtctcaagctggtttgtgcccttttcccattcaaaatcaaacgatgatgcagcgaggcgtgccatcgacttcatgcttggatggttcatggaccccctcactagaggagagtacccgctaagcatgagagcactggtgggaaaccgcttgccacagttcacaaaggaacagtccgagttggtcaagggcgcattcgacttcattggactaaactattacaccacaaactacgccgataaccttcctcaatcaaacggcctcaacgttagctctaggactgatgcccgtgttaatcttaccggttttcggaatggtgtcccaattggtcctcaggaaaactatggcaatcctaccgtctatatcactgaaaatggcgtcgacgaagccaacaacaagagcctgtcactcgaggaagctctgaaggacgacaccaggatagagtttcaccacgctcactttcttgccctgcaaagtgccataagggacggggccaacgtgaagggatacttcgcgtggtcgctgctggacaacttcgagtgggcgagtggctacactgtccggttcgggatatacttcgtggactacaacgacgggctgaagcggtaccccaagagttctgcgcactggttcacggagttcctcaagaaatag

SEQ ID NO: 18277 - protein, 487 aa, Sorghum bicolor
  misc_feature: Useful for making plants with altered cell wall content and/or composition
  misc_feature: Functional homolog of the protein sequence given in SEQ ID NO 14615
  misc_feature: Useful for making plants with altered carbohydrate content
  misc_feature: Functional homolog of the protein sequence given in SEQ ID NO 14324
  misc_feature: Useful for making plants with modulated biomass
  misc_feature: Useful for making plants with modulated flowering time
  misc_feature: Functional homolog of the protein sequence given in SEQ ID NO 14326
  misc_feature: Ceres ANNOT ID no. 8701453
  misc_feature (33)..(395): SWISSPROT Homolog: EC 3.2.1.21 Beta-glucosidase
  misc_feature (33)..(487): Pfam ID: Glyco_hydro_1 Pfam Description: Glycosyl hydrolase family 1
MLARLLPLLLLLLLLAAASNACDCAGRQPPISSRRSFPEGFIFGTASAAYQYEGGAMEGSRGPSIWDTFTHQHPDKIANRSNGDVAVDSYHLYKEDVRIMKSMGMDAYRFSISWSRILPYGSLSGGVNREGIRYYNNLIDELLLKGIQPFVTLFHWDSPQALEDKYGGFLSPNIINDYKDYAEVCFKEFGDRVKHWITFNEPWSFCSGGYASGTFAPGRCSPWEQGKCSAGDSGTEPYTVCHHQILAHAETVRLYKEKYKVEQKGNIGITLVSSWFVPFSHSKSNDDAARRAIDFMLGWFMDPLTRGEYPLSMRALVGNRLPQFTKEQSELVKGAFDFIGLNYYTTNYADNLPQSNGLNVSSRTDARVNLTGFRNGVPIGPQENYGNPTVYITENGVDEANNKSLSLEEALKDDTRIEFHHAHFLALQSAIRDGANVKGYFAWSLLDNFEWASGYTVRFGIYFVDYNDGLKRYPKSSAHWFTEFLKK

SEQ ID NO: 18278 - DNA, 1500 bp, Sorghum bicolor
  misc_feature: Ceres ANNOT ID no. 8701451
  misc_feature: Encodes the peptide sequence at SEQ ID NO 18279
atgcttcttggtcgtcttctacctctgtttctccttctggcagtcacctctgcctccattgcctacgatgacgccggcctgccgccggtgaaccggacaagtttcccggagggtttcatcttcggaacggcatcgtcggcctatcaggcaagaacttctttgtcatctgtacatggcgttaatacatataacagaatcgctaacagaagtaacggggatgtggccgtgaattcctaccacctctacaaggaagatgtgcgcctaatgaaggatatgggaatggatgcatacaggttctccatctcatggacaagaattcttccaaatggaagcctgagcggtggagtcaaccgagaaggagtcagatactacaacaatttgattaatgagcttttgtcgaaagggcttcaaccatttgtgaccctttttcactgggactcgccgcaggcattagaagataaatatggaggatttcttagtcccaatatcatcaatgactataaggactattctgaagtctgcttcaaagagtttggggaccgagtgaagcattggatcaccttcaatgagccgtggaccttctgctccgtgggctatgcatctggtacctttccgccagcgaggtgctcatcatgggaagagggcaagtgcaatgttggggattcaggaagggagccttacactgcatgtcattatcagatgcttgcccatgcagaaactgttcggttgtacaaagagaaataccagggtgtacaaaagggaaagattggaataactattgtatcacattggtttactcccttctcccaatccagatccgatatcgatgcagcgagacgtgctgtagacttcatgctaggatggtctttggaccccctcatcagaggagactacccattaagcatgaaaaggttggtaggaaatcgtcttccgcaattcacaaaggaacaatctaagttggtcaaaggtgcatttgacttcatcgggctcaactactacaccggatactacactgaagacgttcctccatccctgaacaagagctataacacagacgctcaagcgaatactactggtgttcggggtggtttgcctattggtcgtcaggcagcttcaccttcgctctacatctaccctcaaggcttccttgagctactactccatgtgaaggaaaactacggaaatcctaccatatacatcactgaaaatggcgttgatgaagccaccaacaatagcctgccactacaggaagccttgaaggatgatattaggatagagtactaccacaagcatctccttgccctgtcaagtgccataagggctggagcaaacgtgaaagggtactttgcatggtcattgcttgataacttcgagtggagggatgcctttacggtccgctttgggataaacttcgtggactacaatgacggattgaagcgatatcccaagaattctgcccattggtttagggaaatccttcagaaaaatgtcttgttatga

SEQ ID NO: 18279 - protein, 499 aa, Sorghum bicolor
  misc_feature: Useful for making plants with altered carbohydrate content
  misc_feature: Functional homolog of the protein sequence given in SEQ ID NO 14324
  misc_feature: Useful for making plants with modulated biomass
  misc_feature: Functional homolog of the protein sequence given in SEQ ID NO 14616
  misc_feature: Useful for making plants with altered cell wall content and/or composition
  misc_feature: Functional homolog of the protein sequence given in SEQ ID NO 14325
  misc_feature: Ceres ANNOT ID no. 8701451
  misc_feature (30)..(473): SWISSPROT Homolog: EC 3.2.1.21 Beta-glucosidase
  misc_feature (31)..(498): Pfam ID: Glyco_hydro_1 Pfam Description: Glycosyl hydrolase family 1
MLLGRLLPLFLLLAVTSASIAYDDAGLPPVNRTSFPEGFIFGTASSAYQARTSLSSVHGVNTYNRIANRSNGDVAVNSYHLYKEDVRLMKDMGMDAYRFSISWTRILPNGSLSGGVNREGVRYYNNLINELLSKGLQPFVTLFHWDSPQALEDKYGGFLSPNIINDYKDYSEVCFKEFGDRVKHWITFNEPWTFCSVGYASGTFPPARCSSWEEGKCNVGDSGREPYTACHYQMLAHAETVRLYKEKYQGVQKGKIGITIVSHWFTPFSQSRSDIDAARRAVDFMLGWSLDPLIRGDYPLSMKRLVGNRLPQFTKEQSKLVKGAFDFIGLNYYTGYYTEDVPPSLNKSYNTDAQANTTGVRGGLPIGRQAASPSLYIYPQGFLELLLHVKENYGNPTIYITENGVDEATNNSLPLQEALKDDIRIEYYHKHLLALSSAIRAGANVKGYFAWSLLDNFEWRDAFTVRFGINFVDYNDGLKRYPKNSAHWFREILQKNVLL

SEQ ID NO: 18280 - DNA, 1518 bp, Sorghum bicolor
  misc_feature: Ceres ANNOT ID no. 8701458
  misc_feature: Encodes the peptide sequence at SEQ ID NO 18281
atggctgtgagtcgtcttctacctctgtttctccttctatccgtcgctgctggcggcgcctacgacggcgctggccagccgccgatcagccggaggagctttcctgaggggttcatcttcggggcatcctctgcttcctatcagtatgagggcggggtaatggaggggggcagaggaccaagcatctgggacaccttcactcatcagcacccagataaaatcattgacagaagcaacggggatgtggccatagattcctaccatctctacaaagaagatgtgcgcctgttgaaggatatgggaatggatgcatacaggttctccatctcatggacaaggattcttccaaatggaagtctgagcggtggcatcaacagagaaggaatcagatactacaacaacttgatcaatgaactcatgtcgaaagggttacaaccattcgtaacccttttccactgggactcgcctcaggcattagaagacaaatacggaggatttcttagtccgaacatgataaatgactacaaggactacgctgaagtatgcttcaaagagtttggtgatagagtgaaacactggataacgttcaacgaacctgcacaattctgctcaattgggtatgcatctggcattggtgcgccaggccggtgctcaccatgggagcagggcaagtgcagcgctggggattcaggaagggagccttacactgtctgtcatcaccagctgctcgctcatggagaagcagttcgcctgtacaaagagaagtaccaggctgtccaaagagggaaaatcggagtaacattagtctccctatggtttcttcctttgtccccatccaaatccaatgaggatgcagtgacacgtgctttagatttcatgcttggatggtttatggacccacttgttggaggtgactacccgctcagcatgagaagattggtgggaaatcgcttgccgcgattcacaaaggaacaatctaagctactcaagggtgcattcgatttcatcggactcaactactacaccacatactatgctgctagccttcctccatcatcaaatggcctctacagtagtaacactgataatcaagctaatctttctggcattcgaaatggtgtgcccataggtcctcaggctgcttcgtcttggctcttcatgtaccctcaaggctttcgcgagcttctactttatatgaagaaaaactatggcaaccctgctatctacatcactgaaaatggctttgatgaagccaacaacaagagcttaccactccaggaagccttgaaagacgacacccggatagagtaccaccacaagcacctccttgcactgctaagtgctataagggatggagcaaacgtgaaagcatactttgcatggtcgttgatggacaacttcgagtgggtgaatggctacacggtcagattcgggctaaactacgtggactacaatgatgggttgaagcggtaccccaagaattcagctcattggttcaaggcgttcctgcagaaatga

SEQ ID NO: 18281 - protein, 505 aa, Sorghum bicolor
  misc_feature: Useful for making plants with altered carbohydrate content
  misc_feature: Functional homolog of the protein sequence given in SEQ ID NO 14324
  misc_feature: Useful for making plants with altered cell wall content and/or composition
  misc_feature: Functional homolog of the protein sequence given in SEQ ID NO 14325
  misc_feature: Useful for making plants with modulated biomass
  misc_feature: Functional homolog of the protein sequence given in SEQ ID NO 14616
  misc_feature: Ceres ANNOT ID no. 8701458
  misc_feature (29)..(483): SWISSPROT Homolog: EC 3.2.1.21 Beta-glucosidase
  misc_feature (30)..(505): Pfam ID: Glyco_hydro_1 Pfam Description: Glycosyl hydrolase family 1
MAVSRLLPLFLLLSVAAGGAYDGAGQPPISRRSFPEGFIFGASSASYQYEGGVMEGGRGPSIWDTFTHQHPDKIIDRSNGDVAIDSYHLYKEDVRLLKDMGMDAYRFSISWTRILPNGSLSGGINREGIRYYNNLINELMSKGLQPFVTLFHWDSPQALEDKYGGFLSPNMINDYKDYAEVCFKEFGDRVKHWITFNEPAQFCSIGYASGIGAPGRCSPWEQGKCSAGDSGREPYTVCHHQLLAHGEAVRLYKEKYQAVQRGKIGVTLVSLWFLPLSPSKSNEDAVTRALDFMLGWFMDPLVGGDYPLSMRRLVGNRLPRFTKEQSKLLKGAFDFIGLNYYTTYYAASLPPSSNGLYSSNTDNQANLSGIRNGVPIGPQAASSWLFMYPQGFRELLLYMKKNYGNPAIYITENGFDEANNKSLPLQEALKDDTRIEYHHKHLLALLSAIRDGANVKAYFAWSLMDNFEWVNGYTVRFGLNYVDYNDGLKRYPKNSAHWFKAFLQK

SEQ ID NO: 18282 - DNA, 1314 bp, Sorghum bicolor
  misc_feature: Ceres ANNOT ID no. 8701493
  misc_feature: Encodes the peptide sequence at SEQ ID NO 18283
atggagaccctgcgggtgcggaggcgcgagaggaaaaagcatccgcgttcgtgggttatgaatgtgttgggtattgcagagaaaataagaagtgcaactcaatcgttcaccctccgacttggtgaactttttgcaaaaccacatatcaaatgtaccaactgcgactgcgacattgacattagtaatgtttctttggtgtggccagcacttcctgctggtgtcaaatttgatcccacggaccttgaacttctgcagcatctacaagcaaaatctagcccaccggattcagggtcgcatatgcttattaatgaatttatacctactataaaagagaaggagggaatttgctatacacatcccaaaaatctccctggtatgaagatggatggtagctgcctccatttctttaataggatattaaacgcatatgacagtggtaagcgcaagcgtcggaggattattgccaccggcgacatttgtgacggtgttgctgatgggaacagcaggtggcataagaccggatcatccaaacccatatttgacgagaatggtgtgagaataggctggaagaagatcttagttctttataaaggtcccaagaaagttggtggcaagccaaaaagagaaaattgggtgatgcatcaataccatcttggtctaaaagaagatgaaaccaatgggcaatttgtagtctgtaaagtattctaccaattgccatcgaagaaaagtgacaactctaaaacagatgttgtagttgaatctgtttcatctgttgcaaaaattaatcctaggactccaatgacatatcctccccagccccgtaggctgaacaacagcccatgcaacaccgagcagtatacccccattcagcaggatcagggggaagaagaatgtggcacatcgaagatgaaggttgaagcagctgaatgctctgcatgctttgctgaattttcaccagctatccctacctcgcatgaactcaggaccccaatggcagatcctccccagccccatcgcctgaacaacagcccatgtaataccgagcagtatacccacattcaggtggatcagggggaagaagaatgtagcacatctaaggtgaaggctgaagcagctgaatgctctgcatgcgttgctgaacaatcaccagctattcctacctcggatgaacccatgcagcctacggatgccctggacacaggacttgacgcatctctacccttccatggtctgtttgatgggttgcctgacctggataatactcttccattcactggaacaccttcaggtgatagtatcagtttacatgcctag

SEQ ID NO: 18283 - protein, 437 aa, Sorghum bicolor
  misc_feature: Useful for making plants with altered carbohydrate content
  misc_feature: Functional homolog of the protein sequence given in SEQ ID NO 14394
  misc_feature: The sequence is a functional homolog of SEQ ID NO 562 in the 11/435,388 US patent application
  misc_feature: Ceres ANNOT ID no. 8701493
  misc_feature (70)..(219): Pfam ID: NAM Pfam Description: No apical meristem (NAM) protein
METLRVRRRERKKHPRSWVMNVLGIAEKIRSATQSFTLRLGELFAKPHIKCTNCDCDIDISNVSLVWPALPAGVKFDPTDLELLQHLQAKSSPPDSGSHMLINEFIPTIKEKEGICYTHPKNLPGMKMDGSCLHFFNRILNAYDSGKRKRRRIIATGDICDGVADGNSRWHKTGSSKPIFDENGVRIGWKKILVLYKGPKKVGGKPKRENWVMHQYHLGLKEDETNGQFVVCKVFYQLPSKKSDNSKTDVVVESVSSVAKINPRTPMTYPPQPRRLNNSPCNTEQYTPIQQDQGEEECGTSKMKVEAAECSACFAEFSPAIPTSHELRTPMADPPQPHRLNNSPCNTEQYTHIQVDQGEEECSTSKVKAEAAECSACVAEQSPAIPTSDEPMQPTDALDTGLDASLPFHGLFDGLPDLDNTLPFTGTPSGDSISLHA

SEQ ID NO: 18284 - DNA, 558 bp, Sorghum bicolor
  misc_feature: Ceres ANNOT ID no. 8701534
  misc_feature: Encodes the peptide sequence at SEQ ID NO 18285
atgtccaccgctgacgcggcgagcccggcgctggcgccggacggggacgcgccggcgggcgagggcctggccctggcgcagttcgcggcgggctgcttctggagcgtggagctggcgtaccagcgcctccccggcgtggcgcgcacggaggtcgggtactcgcagggccaccgccacgccccgacctaccgcgacgtctgcggcggcggcacgggccacgccgaggtggtgcgcgtgcactacgaccccgacgcctgcccctacgccgtcctcctcgacgtcttctgggccaagcacaaccccaccacgctcaacagacagggcaacgacgttgggacgcagtaccggtcgggcatctactactacacggcggagcaggagaagctggcgcgcgagtcgctggcggcgaagcagaagggttggaaggacaccatcgtcaccgagatcctgccggcgcggcggttctaccccgccgaggagtaccaccagcagtacctccagaagggcggccagtccgccaacaagggatgcagcgatcccatccgctgctacggctga

SEQ ID NO: 18285 - protein, 185 aa, Sorghum bicolor
  misc_feature: Useful for making plants with modulated flowering time
  misc_feature: Functional homolog of the protein sequence given in SEQ ID NO 13951
  misc_feature: Ceres ANNOT ID no. 8701534
  misc_feature (27)..(185): SWISSPROT Homolog: EC 1.8.4.11 Peptide-methionine-(S)-S-oxide reductase
  misc_feature (24)..(179): Pfam ID: PMSR Pfam Description: Peptide methionine sulfoxide reductase
MSTADAASPALAPDGDAPAGEGLALAQFAAGCFWSVELAYQRLPGVARTEVGYSQGHRHAPTYRDVCGGGTGHAEVVRVHYDPDACPYAVLLDVFWAKHNPTTLNRQGNDVGTQYRSGIYYYTAEQEKLARESLAAKQKGWKDTIVTEILPARRFYPAEEYHQQYLQKGGQSANKGCSDPIRCYG

SEQ ID NO: 18286 - DNA, 1431 bp, Sorghum bicolor
  misc_feature: Ceres ANNOT ID no. 8701550
  misc_feature: Encodes the peptide sequence at SEQ ID NO 18287
atggcaaccccgaccgtcgtcttgctgccggtctggggcgccggccatctcatgcccatggtagaagccggcaagcggctgctcgctagcggcagtaggcgggcgctctcggtcacggtgctcgtcatgcggccgccgacggagcagcacgcgtccgagctcgagggcgacatacgccgggcggaggaggccgccgccggcctcgacgtccgcttccaccgcctgcccgccgtcaagccgccgacggaccacgctggccccgtcgagttcatctcccgagtcgtgcagctgcacgcgccccacgtcagggcggccgtctcgagcctgtcatgcccggtggccgcgctcgtcctcgacctgttctgcaccccgttcgtcgacgtggcccgcgagctcgccgtgccggcgtatgtgtacttcacctgcaacgccgcggcgctctccttcttcctgcgcctgccggcgctgtgcgaggaggtggccggcgagttcggggagatggacggcgcggcggacatccccgggctgcccccggtgcccgcactctcgctcccgacgccaatcatggaaaggaagaagcctgattgcgcgtggtacgcgtgccacggcaggcgcttcatggacgccgacggcatcatcgtcaacacagccgccgagctcgagcagggcgtcctctccgccatcgccaagggccggtgcacgcgcgggaccgggagccggcctgctccgacgctgtacccgatcggcccggtgatctcgttccccccgccggccgcagagccgccgcacgagtgcctacggtggctggagtcccagcctccggcgtccgtggtcttcctctgcttcgggagcggagggttcttcaccgcgccgcgggcgcacgaggccgcccacggcctggagcgcagcgggcaccggttcctctgggtgctgcgcggcgcaccggcgcccgacacgaggagccccacggacgcggacctggcggagctgctcccggagggcttcgtcgagcggacgaggaacagggggctcgtgtggccgacggcagtgccgcagaaggagatcctcgcgcacgcggccgtgggcggcttcgtgacgcactgcgggtggaactcagtcctggagagcctgtggttcggcgtgcccatggcgccgtggccgctgtacgccgagcagcacctgaacgcgttcgcgctggtggccgccatgggcgtcgccgtggcgatggaggtggacaggaagagggacaacttcgtggaggcggcggagctggagcgggctgtgaaggcgctgatgggtgacggcgaggaggggaggaaggcgagggagaaggccgcggtggtgcaggcggcgtgccggaatgccgtcgacgatggcgggtcgtcgaccgctacgctgtcaaagctctgcaacgatatctgtcgacagtga

SEQ ID NO: 18287 - protein, 476 aa, Sorghum bicolor
  misc_feature: Useful for making plants with altered carbohydrate content
  misc_feature: Functional homolog of the protein sequence given in SEQ ID NO 14352
  misc_feature: Ceres ANNOT ID no. 8701550
  misc_feature (15)..(475): SWISSPROT Homolog: EC 2.4.1.115 Anthocyanidin 3-O-glucosyltransferase
  misc_feature (5)..(476): Pfam ID: UDPGT Pfam Description: UDP-glucoronosyl and UDP-glucosyl transferase
MATPTVVLLPVWGAGHLMPMVEAGKRLLASGSRRALSVTVLVMRPPTEQHASELEGDIRRAEEAAAGLDVRFHRLPAVKPPTDHAGPVEFISRVVQLHAPHVRAAVSSLSCPVAALVLDLFCTPFVDVARELAVPAYVYFTCNAAALSFFLRLPALCEEVAGEFGEMDGAADIPGLPPVPALSLPTPIMERKKPDCAWYACHGRRFMDADGIIVNTAAELEQGVLSAIAKGRCTRGTGSRPAPTLYPIGPVISFPPPAAEPPHECLRWLESQPPASVVFLCFGSGGFFTAPRAHEAAHGLERSGHRFLWVLRGAPAPDTRSPTDADLAELLPEGFVERTRNRGLVWPTAVPQKEILAHAAVGGFVTHCGWNSVLESLWFGVPMAPWPLYAEQHLNAFALVAAMGVAVAMEVDRKRDNFVEAAELERAVKALMGDGEEGRKAREKAAVVQAACRNAVDDGGSSTATLSKLCNDICRQ

SEQ ID NO: 18288 - DNA, 807 bp, Sorghum bicolor
  misc_feature: Ceres ANNOT ID no. 8701602
  misc_feature: Encodes the peptide sequence at SEQ ID NO 18289
atggcggcagcagcatccatggcggcccgtggcggcgctctcgttgcgatcagcaggccgagcaggaggatgggtggctgcagggcggaaccgccgcgtttcttggtcgtcagctgcgacgccaggacagcggacgtctactcctccctggctgcaaagattttgggacctcccatgaccttcaatgcggcgaagctcaaggtggagttcgccggggaggacaagcagcctcctcctttcccccgagcctacactctgacccactgcgacttcacggcgaacctgacgctggccgtgagcggtcccatgaccaccagcgagcagctgcgcagctggcagtcgacgctgcagagggacgacgtggtggcggagtggaaggaggtgaccaccgccgccaacgccggcggggagagggagatgacgctgcaggtgcattgcttcgtcagcggcgccaacctcctgcaggagctcgccgcaggtttcagatactacgtcttctccaaagagctgccgctggtcctcaaggcggtggttcatggcgacgcggctctgttcgcggagaggccggagctgatggaggccaaggtgtgggtgcatttccactccacctcgcgcaagtacaaccggatagagtgctggggcccgctcagggaggccaccaccaggaggaaccacagccacctgctggatctggatggccgccggctggaccaacaactgcagaacgccatcaccaagagcaagcggcgaaggaagtgggcggcccccgagacaatcttcaacgccctgctcgcccttctcctctga

SEQ ID NO: 18289 - protein, 268 aa, Sorghum bicolor
  misc_feature: Useful for making plants with modulated time to senescence
  misc_feature: Functional homolog of the protein sequence given in SEQ ID NO 14344
  misc_feature: Useful for making plants with modulated abscission
  misc_feature: Functional homolog of the protein sequence given in SEQ ID NO 14345
  misc_feature: Ceres ANNOT ID no. 8701602
MAAAASMAARGGALVAISRPSRRMGGCRAEPPRFLVVSCDARTADVYSSLAAKILGPPMTFNAAKLKVEFAGEDKQPPPFPRAYTLTHCDFTANLTLAVSGPMTTSEQLRSWQSTLQRDDVVAEWKEVTTAANAGGEREMTLQVHCFVSGANLLQELAAGFRYYVFSKELPLVLKAVVHGDAALFAERPELMEAKVWVHFHSTSRKYNRIECWGPLREATTRRNHSHLLDLDGRRLDQQLQNAITKSKRRRKWAAPETIFNALLALLL

SEQ ID NO: 18290 - DNA, 645 bp, Sorghum bicolor
  misc_feature: Ceres ANNOT ID no. 8701611
  misc_feature: Encodes the peptide sequence at SEQ ID NO 18291
atggatatattgtgcgtgtttctatggaaaggttttccaagtgcaagggctggtgttaatggtgaggctcaccatgcaatgagtggctatcaaaagaagatgaagtcccccatgaacttatccagacaaggagccctctctcaattctctgaggatggaatcccgaacgatctcaccaataatgtgcatggcattggacactctgaagagaacatcaccgccaataatgtggcacgttccttctcaactgggttctcaattggatcatgggaggacccaaattctattgtgttttccaacccgacaagcaaagcagggatacacaacaatgacgacatcatagctagtattagtaactcgtatgaactacagatgcagcaagaccaagttccattcagagtacgagccaagcgtggctgtgccacgcatccaaggagcatcgcagagcgggagcgaagaacgaggatcagcgagaagctcagaaagttgcaggcccttgtgcctaacatggacaagcaaactagtacagcggacatgctggacttagcagttgatcacatcagaggactccagagcgagctgcaggctctcaaggaagacaaggagaagtgcacctgccgcggcaatcgtccatcagggagataa

SEQ ID NO: 18291 - protein, 214 aa, Sorghum bicolor
  misc_feature: The sequence is a functional homolog of SEQ ID NO 170 in the 10/714,887 US patent application
  misc_feature: The sequence is a functional homolog of SEQ ID NO 170 in the 11/435,388 US patent application
  misc_feature: The sequence is a functional homolog of SEQ ID NO 168 in the 10/714,887 US patent application
  misc_feature: The sequence is a functional homolog of SEQ ID NO 168 in the 11/435,388 US patent application
  misc_feature: The sequence is a functional homolog of SEQ ID NO 1257 in the 10/412,699 US patent application
  misc_feature: The sequence is a functional homolog of SEQ ID NO 176 in the 10/714,887 US patent application
  misc_feature: The sequence is a functional homolog of SEQ ID NO 176 in the 11/435,388 US patent application
  misc_feature: The sequence is a functional homolog of SEQ ID NO 1258 in the 10/412,699 US patent application
  misc_feature: The sequence is a functional homolog of SEQ ID NO 172 in the 10/714,887 US patent application
  misc_feature: The sequence is a functional homolog of SEQ ID NO 172 in the 11/435,388 US patent application
  misc_feature: The sequence is a functional homolog of SEQ ID NO 174 in the 10/714,887 US patent application
  misc_feature: The sequence is a functional homolog of SEQ ID NO 174 in the 11/435,388 US patent application
  misc_feature: The sequence is a functional homolog of SEQ ID NO 194 in the 10/714,887 US patent application
  misc_feature: The sequence is a functional homolog of SEQ ID NO 194 in the 11/435,388 US patent application
  misc_feature: The sequence is a functional homolog of SEQ ID NO 186 in the 10/714,887 US patent application
  misc_feature: The sequence is a functional homolog of SEQ ID NO 186 in the 11/435,388 US patent application
  misc_feature: Ceres ANNOT ID no. 8701611
  misc_feature (143)..(191): Pfam ID: HLH Pfam Description: Helix-loop-helix DNA-binding domain
MDILCVFLWKGFPSARAGVNGEAHHAMSGYQKKMKSPMNLSRQGALSQFSEDGIPNDLTNNVHGIGHSEENITANNVARSFSTGFSIGSWEDPNSIVFSNPTSKAGIHNNDDIIASISNSYELQMQQDQVPFRVRAKRGCATHPRSIAERERRTRISEKLRKLQALVPNMDKQTSTADMLDLAVDHIRGLQSELQALKEDKEKCTCRGNRPSGR

SEQ ID NO: 18292 - DNA, 780 bp, Sorghum bicolor
  misc_feature: Ceres ANNOT ID no. 8701679
  misc_feature: Encodes the peptide sequence at SEQ ID NO 18293
atggcggtcctggctctcggcctagcactcctctgcgctgccgccgcgcagaactgcggctgccaggcaggttactgctgcagcaagttcggttactgcggcacgaccgacgagtactgcggcgacgggtgccagtcgggcccgtgccgctctggcggcggcagcagtggaggtgggaacgtggctggcgttgtcaccgacgcattcttcaacagcatcaagaaccaggccgggaacgggtgcgagggcaagaacttctacacccggagcgcgttcctgagcgccgccgacgcgtacaaaggcttcggtggcaggtcggtgcagggcaagcgcgagatcgccgccttcttcgcccacatcacgcacgagaccggacatttctgctacatcagcgagatcaacaagaacaacgcctactgcgactcgagcaacaggcagtggccgtgtgccgcgggtcagaagtactacgggcgcggcccgctgcaaatctcgtggaactacaactacgggcctgccgggagggacatcggcttcgacgggcttcggaacccggacagggtggcgcaggacgccgtggtcgcgttcaagacggcgctctggttctggaccaacaacgtgcacggggtgatgtcgcaggggttcggcgccaccatcagggccatcaacggcgccctcgagtgcaacggcaagaatactgcccagatgaacgcgcgggtgggctactacaggcagtactgccagcagctcggcgtcgaccccggacccaacctcacttgctag

SEQ ID NO: 18293 - protein, 259 aa, Sorghum bicolor
  misc_feature: The sequence is a functional homolog of SEQ ID NO 12 in US patent 7087810
  misc_feature: Ceres ANNOT ID no. 8701679
  misc_feature (28)..(259): SWISSPROT Homolog: EC 3.2.1.14 Chitinase
  misc_feature (64)..(259): Pfam ID: Glyco_hydro_19 Pfam Description: Chitinase class I
  misc_feature (16)..(49): Pfam ID: Chitin_bind_1 Pfam Description: Chitin recognition protein
MAVLALGLALLCAAAAQNCGCQAGYCCSKFGYCGTTDEYCGDGCQSGPCRSGGGSSGGGNVAGVVTDAFFNSIKNQAGNGCEGKNFYTRSAFLSAADAYKGFGGRSVQGKREIAAFFAHITHETGHFCYISEINKNNAYCDSSNRQWPCAAGQKYYGRGPLQISWNYNYGPAGRDIGFDGLRNPDRVAQDAVVAFKTALWFWTNNVHGVMSQGFGATIRAINGALECNGKNTAQMNARVGYYRQYCQQLGVDPGPNLTC

SEQ ID NO: 18294 - DNA, 840 bp, Sorghum bicolor
  misc_feature: Ceres ANNOT ID no. 8701681
  misc_feature: Encodes the peptide sequence at SEQ ID NO 18295
atggcgagctcgccgacgatcctgactgttctggctctcgggctgctagcgctcctctgcgctgtcggtccggccgccgcgcagaactgcggctgccagccagacttctgctgcagccagtatggctactgcggccagaccagcgagtactgtggcaccgggtgccggtcgggcccctgcacagggacagggagcggcggcagcagcggcagcggcagcggcgcgaacgtcggtaacgtcgtcaccgacgcgttcttcaacggcatcaagaaccaggccggaagtgggtgcgagggcagcaacttctactcgcgcgacgcgttcctgagcgctgccagtgccagtgcgtactccggcttcgcccagggcggctcggaggacgacggcaagcgcgagatcgccgccttcttcgctcacgccacacacgagaccggacatttctgctacattagcgagatcaacaaggacaacgcctactgtgactcgagctacacacagtggccgtgcgccgcggggcagaagtactacggaagaggccccctgcagatctcgtggaactacaactacgggccggcaggacagagcatcggcttcgacgggctcgggaacccggacgccgtggcgcaggacgccgtgatcgcgttcaaggcggcgctctggttctggatgaacaacgtgcacggggtgatgccacaggggtttggcgccaccatcagagccataaacggcgccctcgagtgcaacggaaacaaccccgcgcaaatgaacgcgcgggtgggctactacaagcagtactgccagcagttcggcgtcgacccggggagcaacctcacctgctag

SEQ ID NO: 18295 - protein, 279 aa, Sorghum bicolor
  misc_feature: The sequence is a functional homolog of SEQ ID NO 12 in US patent 7087810
  misc_feature: Ceres ANNOT ID no. 8701681
  misc_feature (1)..(279): SWISSPROT Homolog: EC 3.2.1.14 Chitinase
  misc_feature (80)..(279): Pfam ID: Glyco_hydro_19 Pfam Description: Chitinase class I
  misc_feature (27)..(60): Pfam ID: Chitin_bind_1 Pfam Description: Chitin recognition protein
MASSPTILTVLALGLLALLCAVGPAAAQNCGCQPDFCCSQYGYCGQTSEYCGTGCRSGPCTGTGSGGSSGSGSGANVGNVVTDAFFNGIKNQAGSGCEGSNFYSRDAFLSAASASAYSGFAQGGSEDDGKREIAAFFAHATHETGHFCYISEINKDNAYCDSSYTQWPCAAGQKYYGRGPLQISWNYNYGPAGQSIGFDGLGNPDAVAQDAVIAFKAALWFWMNNVHGVMPQGFGATIRAINGALECNGNNPAQMNARVGYYKQYCQQFGVDPGSNLTC

SEQ ID NO: 18296 - DNA, 801 bp, Sorghum bicolor
  misc_feature: Ceres ANNOT ID no. 8701683
  misc_feature: Encodes the peptide sequence at SEQ ID NO 18297
atgctgacggttctggctctcgggctagcgctcctcagcgccgcaggtccggccaccgcgcagaactgcagctgcccgccaggctactgctgcagccagttcggttactgcggcacgagcttcgactactgcaacggcaacacgtgccagtccggcccctgcacgggatccggcggtagcagcggcgcgaacgtaagcggcgtcgtcaccgacgcatttttcaacggcatcaagtcccaggccgggagcgggtgcgagggcagtaacttctactcgcggagggcgttcctgcgcgctgccagcagctcgtaccccgccttcgcccatggcggcacggaagccgacggcaagcgcgagatcgccgccttcttcgcgcacgtcacgcacgagacccgacatctctgctacataagcgagatcaacgagaacagcgcctactgcaactcgagcaacgcacaatggccgtgcgccccggggaagaagtactacgggcgcggcccgctgcagatctcgtggaactacaactacggtcctgccgggagggagatcggcttcgacgggctcgggaacccggacatggtggcgcaggaccccgtgatcgcgttcaagacggcgctctggttctggatgaacaacgtgcacggggtgatgccgcaagggttcggcgccaccatcagggccatcgacggcgccctcgagtgcaacggaaacaaccctgcgcaaatgaacgcgcgggtgggctactacaagcagtactgccagcagttcggcgtcgacccggggaacagtctcacctgctag

SEQ ID NO: 18297 - protein, 266 aa, Sorghum bicolor
  misc_feature: The sequence is a functional homolog of SEQ ID NO 12 in US patent 7087810
  misc_feature: Ceres ANNOT ID no. 8701683
  misc_feature (21)..(266): SWISSPROT Homolog: EC 3.2.1.14 Chitinase
  misc_feature (68)..(266): Pfam ID: Glyco_hydro_19 Pfam Description: Chitinase class I
  misc_feature (20)..(54): Pfam ID: Chitin_bind_1 Pfam Description: Chitin recognition protein
MLTVLALGLALLSAAGPATAQNCSCPPGYCCSQFGYCGTSFDYCNGNTCQSGPCTGSGGSSGANVSGVVTDAFFNGIKSQAGSGCEGSNFYSRRAFLRAASSSYPAFAHGGTEADGKREIAAFFAHVTHETRHLCYISEINENSAYCNSSNAQWPCAPGKKYYGRGPLQISWNYNYGPAGREIGFDGLGNPDMVAQDPVIAFKTALWFWMNNVHGVMPQGFGATIRAIDGALECNGNNPAQMNARVGYYKQYCQQFGVDPGNSLTC

SEQ ID NO: 18298 - DNA, 477 bp, Sorghum bicolor
  misc_feature: Ceres ANNOT ID no. 8701674
  misc_feature: Encodes the peptide sequence at SEQ ID NO 18299
atggctgaggtggccaaccacagcaaaaggaaccacaccgacagctacttcagtggcaaagccgccgccgtcgccgtcgcggccaccggcccagaggagttcgcaagcatgtcctcgaagaagccgaggaataccagcccgagaatcgcgcccgtatcaccaaaggagaagaaggacaagatcggcgagagagtcgcggcgctccagcagctagtgtcaccatttggaaagaccgatacggcttctgttctgcaggaagcatcgggctacatcaagttcctgcaccagcaactcgaggtcctgagctccccttacatgcgtgctcctccggctcccggcgctgtgcctgaggaccccgagcactacagcctccggaaccgcgggctgtgcctggtgccggtggacctgacgctgcagctgacccagagcaatggggccgacctgtgggcgccggcgaacacgaccaggcgcaggtga

SEQ ID NO: 18299 - protein, 158 aa, Sorghum bicolor
  misc_feature: Useful for making plants with modulated heat sensitivity
  misc_feature: Functional homolog of the protein sequence given in SEQ ID NO 12956
  misc_feature: Useful for making plants with altered lignin content
  misc_feature: Useful for making plants with modulated nitrogen use efficiency
  misc_feature: Functional homolog of the protein sequence given in SEQ ID NO 13645
  misc_feature: The sequence is a functional homolog of SEQ ID NO 564 in the 10/666,642 US patent application
  misc_feature: Ceres ANNOT ID no. 8701674
MAEVANHSKRNHTDSYFSGKAAAVAVAATGPEEFASMSSKKPRNTSPRIAPVSPKEKKDKIGERVAALQQLVSPFGKTDTASVLQEASGYIKFLHQQLEVLSSPYMRAPPAPGAVPEDPEHYSLRNRGLCLVPVDLTLQLTQSNGADLWAPANTTRRR

SEQ ID NO: 18300 - DNA, 699 bp, Sorghum bicolor
  misc_feature: Ceres ANNOT ID no. 8701677
  misc_feature: Encodes the peptide sequence at SEQ ID NO 18301
atgatcctgacgcccttgctggctcttggtctagcactcctctgtgccgccagcccgtgcttggggttggggagcggcggcgccggcgcgtccgtgtctagcgtcgtcaccgaggcgttcttcgacggcatcaagtcccaggccgggaacgggtgcgagggcaagaatttctacacgcggagcgcgttcgtgagcgctgccgacgcgttcccggccttcgcgcatggcggcacggaggcggagggcaagcgcgagatcgccgccttcttcgcgcacgtcacgtacgagaccgggtatttctgctacatcaaccagatcgggaagagccaagtctcgtgcgccctgagctcacagtggccgtgtgccccggggaagaagtactacgggcgcggcccgctgcagatctcgtggaacttcaactacggtccggcggggcagagcatcggcgtcgacctgctggagaacccggacaaggtggcgcaggaccccgtggtttcattcaagacggcgctctggctctggatgaccaacgcgcacaaggtgatgccaacgcaggggttcggcgccactatcagggtcctccacggcgccctcgagtgcaacggcaagaaccccgccgcgatgaaggcgcgggtgggctactacaaggactactgcaagcagttcggtgtcgacccagggaacaacgtcacctgctag

SEQ ID NO: 18301 - protein, 232 aa, Sorghum bicolor
  misc_feature: The sequence is a functional homolog of SEQ ID NO 12 in US patent 7087810
  misc_feature: Ceres ANNOT ID no. 8701677
  misc_feature (37)..(232): SWISSPROT Homolog: EC 3.2.1.14 Chitinase
  misc_feature (35)..(232): Pfam ID: Glyco_hydro_19 Pfam Description: Chitinase class I
MILTPLLALGLALLCAASPCLGLGSGGAGASVSSVVTEAFFDGIKSQAGNGCEGKNFYTRSAFVSAADAFPAFAHGGTEAEGKREIAAFFAHVTYETGYFCYINQIGKSQVSCALSSQWPCAPGKKYYGRGPLQISWNFNYGPAGQSIGVDLLENPDKVAQDPVVSFKTALWLWMTNAHKVMPTQGFGATIRVLHGALECNGKNPAAMKARVGYYKDYCKQFGVDPGNNVTC

SEQ ID NO: 18302 - DNA, 822 bp, Sorghum bicolor
  misc_feature: Ceres ANNOT ID no. 8701680
  misc_feature: Encodes the peptide sequence at SEQ ID NO 18303
atggcaaacgcgccgccgaggatcttggcagtcctgggggctctcgggctagcactcctctgcgctgccgccgtcccggccgccgcgcagaactgcggctgccaggcaggttactgctgcagcaagttcggttactgcggcacgacggacgactactgtggcgacgggtgccagtcgggcccgtgccgctcgagcggcagcagcagtagtggtggtgggaacgtgggtagcgttgtcaccgacgcattcttcaacggcatcaagaaccaggccgcgagcgggtgcgagggcaagaacttctacaccaggagtgcgttcctgagcgccgccaactcgtacaaaagcttcggtggcgggtcggtggcgggcaagcgcgagatcgccgctttcttcgcccatgtcacccacgagaccgggcatttctgctacatcagcgagatcaacaagaacaacgcctactgcgactcgagcaacaagcagtggccgtgcgccgcgggacagaagtactacgggcgcggcccgctgcaaatctcgtggaactacaactacgggcctgccgggaaggccatcggcttcaacgggctcgcgaacccgaacaaggtggcgcaggacgccgtgatcgcgttcaagacggcgctctggtactggacgaacaacgtgcacggggtgatgtcgcaggggttcggcgccaccatcagggccatcaacggcgccctcgagtgcaacggcaagaatactgcccagatgaacgcgcgggtgggctactacaagcagtactgccggcagctcggcgtcgaccccgggcccaacctcacttgctag

SEQ ID NO: 18303 - protein, 273 aa, Sorghum bicolor
  misc_feature: The sequence is a functional homolog of SEQ ID NO 12 in US patent 7087810
  misc_feature: Ceres ANNOT ID no. 8701680
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (1)..(273): SWISSPROT Homolog: EC 3.2.1.14 Chitinase
  misc_feature (78)..(273): Pfam ID: Glyco_hydro_19 Pfam Description: Chitinase class I
  misc_feature (29)..(62): Pfam ID: Chitin_bind_1 Pfam Description: Chitin recognition protein
MANAPPRILAVLGALGLALLCAAAVPAAAQNCGCQAGYCCSKFGYCGTTDDYCGDGCQSGPCRSSGSSSSGGGNVGSVVTDAFFNGIKNQAASGCEGKNFYTRSAFLSAANSYKSFGGGSVAGKREIAAFFAHVTHETGHFCYISEINKNNAYCDSSNKQWPCAAGQKYYGRGPLQISWNYNYGPAGKAIGFNGLANPNKVAQDAVIAFKTALWYWTNNVHGVMSQGFGATIRAINGALECNGKNTAQMNARVGYYKQYCRQLGVDPGPNLTC

SEQ ID NO: 18304 - DNA, 816 bp, Sorghum bicolor
  misc_feature: Ceres ANNOT ID no. 8701678
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 18305
atggaaaacgcgccgaggatcttgacggtcctggctctcgggctagcactcctctgcgctggcgccggcccggccgccgcgcagaactgcggctgccagccaggctactgctgcagccagtatggttactgcggcaagggcgacgcctactgtggcaaggggtgtcgctcgggcccgtgccagggcggcggcggtagcggcgcgaacgtgggtagcgtcgtcaccgacgcgttcttcaacggcatcaagaaccaggccccgaactggtgcgagggcaagaacttctacacgcgaagcgcgttcctgaacgccgccaacgcgtacccaggcttcgcccatggcggctccgaggtggagggcaagcgcgagatcgccgccttcttcgcgcacgtcacgcacgagactggacatttctgctacatcaacgagatcaacggagcgagcaggaactactgcgacgcgaacaacaggcagtggccatgcgccccggggaagaagtactacgggcgcggcccgctgcagatctcgtggaactacaactacggtcctgccggaaaggccatcggcttcgacgggctcgggaacccggacaaggtggcgcaggaccccgtgatttcattcaagacggcgctctggttctggatgaacaatgtgcaccaggtcatgccgcaggggttcggcgccaccatccgggccatcaacggcgccctcgagtgcaacggcaagaaccctggcgcggtgaacgcgcgggtgggctactacaaggactattgcaagcagttcggcgtcgacccggggaacaacctcacctgctag

SEQ ID NO: 18305 - protein, 271 aa, Sorghum bicolor
  misc_feature: The sequence is a functional homolog of SEQ ID NO 12 in US patent 7087810
  misc_feature: Ceres ANNOT ID no. 8701678
  misc_feature (1)..(271): SWISSPROT Homolog: EC 3.2.1.14 Chitinase
  misc_feature (73)..(271): Pfam ID: Glyco_hydro_19 Pfam Description: Chitinase class I
  misc_feature (27)..(60): Pfam ID: Chitin_bind_1 Pfam Description: Chitin recognition protein
MENAPRILTVLALGLALLCAGAGPAAAQNCGCQPGYCCSQYGYCGKGDAYCGKGCRSGPCQGGGGSGANVGSVVTDAFFNGIKNQAPNWCEGKNFYTRSAFLNAANAYPGFAHGGSEVEGKREIAAFFAHVTHETGHFCYINEINGASRNYCDANNRQWPCAPGKKYYGRGPLQISWNYNYGPAGKAIGFDGLGNPDKVAQDPVISFKTALWFWMNNVHQVMPQGFGATIRAINGALECNGKNPGAVNARVGYYKDYCKQFGVDPGNNLTC

SEQ ID NO: 18306 - DNA, 1137 bp, Sorghum bicolor
  misc_feature: Ceres ANNOT ID no. 8701703
  misc_feature: Encodes the peptide sequence at SEQ ID NO 18307
atggaccaggcctcgcccgcggacccagccgcctcctgctcggcctccgcctccccctccccctccgcctctgcggcggcgtcggcggcggcgtcggcgtcaggggacgtcgccgcgatgctgccggactcgccgccgcggcgcggggcggggcaccgccgcgcgcagtcggagatcctcctcgggggcgccgcgctccccgacgacctcaccttcgacgccgacctcggcgtcgtcggggaggcctgcgtggccggcgacgaggacgaggaggacgaggacgaggacgaggaagggggcggcggcggcgctggcggcagccggatgttcgagatgttcctcgagaacggcggcacgctcgccgggccgtcggcgcacccgcatccggcggcgacggcgacgccgccgccgcggccacggcaccagcacagcatgtcgatggacggctccacgtccctgcttggatccgccgccgcggggacgcctgggagggcgggcgctgacgccaagaaggccatctccgacgccaagctcgccgagctcgcgctcgttgaccccaagcgcgccaagaggattttggcaaaccgccagtcagctgctaggtcaaaagaaagaaagatgcgctacattgcagagcttgaaaggaaagtgcagaatctccagtcagaagcaactacactatcagctcagctggccatgttgcagcgagataccactggtttgacaagcgagaatagtgatctgaaggtacgtgtgcagacaatggagcagcaggttcggctacaggatgctttgaacgacaggctaagagacgagattcagcagctgaaggttgcaacaggacaggtaaatgccaacattggaaaaatgggaaactttagtatgtcgtcatttggaggcaatccacaaagctaccagcggagccatatacagtctcttctggctgctcagcagctgcagcagctccagatccactcccaacatcagcaacagcagacgcatttgcagcagcagcaccagttgctgcaggaggctcatccattcccggtggacctaaagatgagagggtttgccatgtcatcacatgctcaaaatgcaggcgcctcagacagccatgctgtcaagagtgaaccctga

SEQ ID NO: 18307 - protein, 378 aa, Sorghum bicolor
  misc_feature: The sequence is a functional homolog of SEQ ID NO 186 in the 10/225,068 US patent application
  misc_feature: The sequence is a functional homolog of SEQ ID NO 2802 in the 10/374,780 US patent application
  misc_feature: The sequence is a functional homolog of SEQ ID NO 908 in the 10/225,066 US patent application
  misc_feature: Ceres ANNOT ID no. 8701703
  misc_feature (183)..(237): Pfam ID: bZIP_2 Pfam Description: Basic region leucine zipper
MDQASPADPAASCSASASPSPSASAAASAAASASGDVAAMLPDSPPRRGAGHRRAQSEILLGGAALPDDLTFDADLGVVGEACVAGDEDEEDEDEDEEGGGGGAGGSRMFEMFLENGGTLAGPSAHPHPAATATPPPRPRHQHSMSMDGSTSLLGSAAAGTPGRAGADAKKAISDAKLAELALVDPKRAKRILANRQSAARSKERKMRYIAELERKVQNLQSEATTLSAQLAMLQRDTTGLTSENSDLKVRVQTMEQQVRLQDALNDRLRDEIQQLKVATGQVNANIGKMGNFSMSSFGGNPQSYQRSHIQSLLAAQQLQQLQIHSQHQQQQTHLQQQHQLLQEAHPFPVDLKMRGFAMSSHAQNAGASDSHAVKSEP

SEQ ID NO: 18308 - DNA, 1893 bp, Sorghum bicolor
  misc_feature: Ceres ANNOT ID no. 8701715
  misc_feature: Encodes the peptide sequence at SEQ ID NO 18309
atgtactcggcgaaccactggggcgggtccttcgacatcaccaccgacggagcgtccgaggaggacgacagccggaacacggacgtcgacggcggcgcgctgtcggcgaggcagcaccacgagctggacgagacgcagcaggggtggctgctcggcccgccggaggccaagaagaagggcaggcacgtcgacctcggctgcgtcctcgtcaagcgcaaggtcctgtggtgggcattctgggggctcgtcgccggcttcgtcctcgtcggcctccccatcatcgtctacaagtccatcccccgcagggcgccccctccgccgccgccggaccagtacgccgaggcgctgcacaaggcactcctcttcttcaacgcccagaaatccggccggattccgaagaacaatggcatcccgtggcgtgggaactctggtctcaaggacggctccgacgccaaggacgtcaagggcggcctcgtcggcggctactacgacgccggcgacaacatcaagttccacttcccgatggccttctccatgacgctgctgagctggtcagtgatcgagtacagcgccaagtacaaggccgtggaggagtatgaccatgtcagggagctcatcaagtggggcaccgactatctgctacacactttcaactcctctgcttccacaatcgaccatgtctacgctcaggtaggtgcggcaaagaccggaaagatcaagagcaggacaccggacgaccactactgctggaaccggccggaggacatggcgtaccctcgtccgtccctgccggtgacctcggctcccgacctcggaggggagatcgccgcggccctggcggccgcctccatcgcgttccgcgacgacgccgcctactccaagaagctcgtccacggcgcggtcaccatgttcgggttcgccaccggcgacgggtgggccaacgagcacgccacctactccaggcaccagcaggacatcgagcccttctacaactccaccagctactgggacgagtacgtctggggcgccgcgtgggtgtactacgccacgggcaacaccacctacctgagcttcgccgccgaccctcagctcgccgagcgcgccaaggcattcgacgacgtcctcgacctgtccgtgttcagctgggacaacaagctccccggcgctggcctgctcctgtcgcggctgcgcatgttcctcaaccccggctacccctacgagcagtcccttgtcggctaccacaaggagagtcgcttggacatgtgcaagtacttccggcgcttcggggccttcaacttcaccaggggcgggctggcgctcttcaaccacggcagggggcagccgctgcagtacgtggtcgccaactccttcctcgccgccctcttcgccgactacatggaggcgatcaacgtccccgggtggtactgtggccccaacttcatgcccacccaagacctccgtgcgttcgccaagtctcagctcaactacattcttggggacaacccgaggaagatgagctacgtggtgggcttcggcaacaagtacccgcggcacgtgcaccaccggggcgcgtcgacgccgcacagccgcgtcaagtactcgtgcaccggcgggtacaagtggcgcgacagcaagaaggcggacccgaacgtgatcacgggcgcgatggtgggcgggccggaccgcaacgacaggttcaacgactcgcgcatggccttcgggcagaccgagccgacgctggtgggcaacgccggcctcgtggcggcgctcgtggccgtcaccagcagtggccgcggcgtcggcgtcggcgccgtcgacaagaacagcatgttctccgccgtgccgccgctgttcccggccacgccacctccgccgcccgcgtggaagccttga

SEQ ID NO: 18309 - protein, 630 aa, Sorghum bicolor
  misc_feature: Useful for making plants with altered carbohydrate content
  misc_feature: Functional homolog of the protein sequence given in SEQ ID NO 13774
  misc_feature: Useful for making plants with altered cell wall content and/or composition
  misc_feature: Functional homolog of the protein sequence given in SEQ ID NO 13773
  misc_feature: Ceres ANNOT ID no. 8701715
  misc_feature (1)..(612): SWISSPROT Homolog: EC 3.2.1.4 Cellulase
  misc_feature (111)..(591): Pfam ID: Glyco_hydro_9 Pfam Description: Glycosyl hydrolase family 9
MYSANHWGGSFDITTDGASEEDDSRNTDVDGGALSARQHHELDETQQGWLLGPPEAKKKGRHVDLGCVLVKRKVLWWAFWGLVAGFVLVGLPIIVYKSIPRRAPPPPPPDQYAEALHKALLFFNAQKSGRIPKNNGIPWRGNSGLKDGSDAKDVKGGLVGGYYDAGDNIKFHFPMAFSMTLLSWSVIEYSAKYKAVEEYDHVRELIKWGTDYLLHTFNSSASTIDHVYAQVGAAKTGKIKSRTPDDHYCWNRPEDMAYPRPSLPVTSAPDLGGEIAAALAAASIAFRDDAAYSKKLVHGAVTMFGFATGDGWANEHATYSRHQQDIEPFYNSTSYWDEYVWGAAWVYYATGNTTYLSFAADPQLAERAKAFDDVLDLSVFSWDNKLPGAGLLLSRLRMFLNPGYPYEQSLVGYHKESRLDMCKYFRRFGAFNFTRGGLALFNHGRGQPLQYVVANSFLAALFADYMEAINVPGWYCGPNFMPTQDLRAFAKSQLNYILGDNPRKMSYVVGFGNKYPRHVHHRGASTPHSRVKYSCTGGYKWRDSKKADPNVITGAMVGGPDRNDRFNDSRMAFGQTEPTLVGNAGLVAALVAVTSSGRGVGVGAVDKNSMFSAVPPLFPATPPPPPAWKP

SEQ ID NO: 18310 - DNA, 1356 bp, Sorghum bicolor
  misc_feature: Ceres ANNOT ID no. 8701731
  misc_feature: Encodes the peptide sequence at SEQ ID NO 18311
atggagtctaagggtggcaagaagtctagcagtagtcgttcaatgatgtatgaagctccccttggctacagcattgaggatgttcgacctgccggaggcgtgaagaagttccagtctgctgcttactccaacgtaagaacattgtgttctgattcacctgctccaatggctgttctttctgctgctgatgctcccccggtctcagctatcgggtttgagggctatgagaagcgccttgagatcacattctctgaggcacctgtctttgccgaccctcatgggcgtggtttgcgtgccctctccagggcccagattgactctgttctggatcttgcacggtgcacaattgtgtccgagctctccaacaaggattttgactcctatgtcctctctgagtcaagcttgtttatctatcctctgaagattgtcatcaagacctgtggcactaccaagctcctgctcaccattccaaggatacttgagcttgctgaagagctgtctatgccacttgctgctgtgaagtactcccgtgggacgttcatctttcccggtgcacagccagctcctcacaggagcttctctgaggaagttgctgcgcttaaccgctactttggtggcctgaaatctggtggtaatgcttatgtgattggagatccagcaagacctggacagaagtggcacatctactacgccaccgagtacccagagcaaccagtggttaaccttgagatgtgcatgactggtctggacaagaagaaagcttcagtctttttcaagactaatgctgatggtaacacaacatgtgccaaggaaatgacgaagctctctggtatatctgaaattatccctgagatggagatctgtgattttgactttgaaccctgtggctactccatgaatgcgatccatggctctgcattctcaacaatccatgtgacgcctgaggatggtttcagctacgccagttatgaggttatgggctttgatgccactgctctgtcttatggtgacctcgtcaagagggtccttaggtgctttggccccttggaattttctgttgctgtgaccatcttcggcgggcgtggccaagctgggacgtggggaaagcaacttggtgcagaggtttatgactgtaacaacatggtggagcaggagctgcctggtggcggactcctcatctaccagagcttctgtgctgctgaagacgctgttgctacctcgcccaaatctgttcttcactgcttcgaaggtgtgaacatggagaatgctcctcctgtgaaggaccgcaaactggctaatcttctctgctgggaggaagtggatgccatggagaaggatggagtgcttgatgagtaa

SEQ ID NO: 18311 - protein, 451 aa, Sorghum bicolor
  misc_feature: Useful for making plants with modulated nitrogen use efficiency
  misc_feature: Functional homolog of the protein sequence given in SEQ ID NO 14549
  misc_feature: Ceres ANNOT ID no. 8701731
  misc_feature (56)..(451): SWISSPROT Homolog: EC 4.1.1.50 Adenosylmethionine decarboxylase
  misc_feature (67)..(401): Pfam ID: SAM_decarbox Pfam Description: Adenosylmethionine decarboxylase
  misc_feature (1)..(50): Pfam ID: AdoMetDC_leader Pfam Description: S-adenosyl-l-methionine decarboxylase leader peptide
MESKGGKKSSSSRSMMYEAPLGYSIEDVRPAGGVKKFQSAAYSNVRTLCSDSPAPMAVLSAADAPPVSAIGFEGYEKRLEITFSEAPVFADPHGRGLRALSRAQIDSVLDLARCTIVSELSNKDFDSYVLSESSLFIYPLKIVIKTCGTTKLLLTIPRILELAEELSMPLAAVKYSRGTFIFPGAQPAPHRSFSEEVAALNRYFGGLKSGGNAYVIGDPARPGQKWHIYYATEYPEQPVVNLEMCMTGLDKKKASVFFKTNADGNTTCAKEMTKLSGISEIIPEMEICDFDFEPCGYSMNAIHGSAFSTIHVTPEDGFSYASYEVMGFDATALSYGDLVKRVLRCFGPLEFSVAVTIFGGRGQAGTWGKQLGAEVYDCNNMVEQELPGGGLLIYQSFCAAEDAVATSPKSVLHCFEGVNMENAPPVKDRKLANLLCWEEVDAMEKDGVLDE

SEQ ID NO: 18312 - DNA, 459 bp, Sorghum bicolor
  misc_feature: Ceres ANNOT ID no. 8701745
  misc_feature: Encodes the peptide sequence at SEQ ID NO 18313
atggctcctaaagctgctccggccaagaagggtgatgccaagacccaggccttgaaggttgccaaggctgtgaagtctgggtctgtcaagaagaagaccaagaagatccgcacgtccgtgacatttcaccgccccaagaccctgaagaaggctagggacccgaagtacccaagaatcagcactaccggaaggaacaagctcgatcaataccaaatcctcaagtaccccctcaccacagaatcagcaatgaagaagattgaagataacaacactctggtgttcattgttgacctcaaggcagacaagaagaagatcaaggctgctgtcaagaagatgtatgacattcaggcaaagaaggtcaacaccctgatcaggcccgatgggaagaagaaggcttacgtgaagctgacgcccgactacgatgctcttgatgtggccaacaaaatcggcatcatctaa

SEQ ID NO: 18313 - protein, 152 aa, Sorghum bicolor
  misc_feature: Useful for making plants with modulated nitrogen use efficiency
  misc_feature: Functional homolog of the protein sequence given in SEQ ID NO 13047
  misc_feature: Ceres ANNOT ID no. 8701745
  misc_feature (70)..(149): Pfam ID: Ribosomal_L23 Pfam Description: Ribosomal protein L23
  misc_feature (11)..(64): Pfam ID: Ribosomal_L23eN Pfam Description: Ribosomal protein L23, N-terminal domain
MAPKAAPAKKGDAKTQALKVAKAVKSGSVKKKTKKIRTSVTFHRPKTLKKARDPKYPRISTTGRNKLDQYQILKYPLTTESAMKKIEDNNTLVFIVDLKADKKKIKAAVKKMYDIQAKKVNTLIRPDGKKKAYVKLTPDYDALDVANKIGII

SEQ ID NO: 18314 - DNA, 651 bp, Sorghum bicolor
  misc_feature: Ceres ANNOT ID no. 8701821
  misc_feature: Encodes the peptide sequence at SEQ ID NO 18315
atgtcttctaatttgggatcgtatgcattcgtaggttggttgggtggtggagcatctttactcgtgggcaccgtgggatgcgtgccaaggcggtcatcggatgcggactcgccctcgccctcgccctcgccggtcgccctcgcccgcgtagttgactcacgaggacctactccctacaaccaccccaccacgccatcaccgcaccgccgcagcccttcttcgcgcccccttataaatacgacaggaggacgggtagcggcagagatgggaatcgcctcctcctcatcatccaacccggaatcgagagctatggcgctcgccaaggccaaggagatcgtcgcctccgctcccctcgtcgtcttcagcaagacttcctgccctttctgcgtccgtgtgaagcagttgtttgagaagctgggagcaagctacaaggccattgagttggatgtggaaagtgatgggcctgagctccagaatgccctcaaggagtggactggacagaggactgtcccaaatgtcttcatcaatgggaagcatattggcggctgtgatgatactatggcactgaacaatgatgggaagctggtgcctctgctgactgaggctggagccatcgccggttctacctcaaagacaaccgtcactgcttga

SEQ ID NO: 18315 - protein, 216 aa, Sorghum bicolor
  misc_feature: Useful for biocontainment applications
  misc_feature: Functional homolog of the protein sequence given in SEQ ID NO 14550
  misc_feature: Ceres ANNOT ID no. 8701821
  misc_feature (120)..(185): SWISSPROT Homolog: EC 1.11.1.15 Peroxiredoxin
  misc_feature (118)..(180): Pfam ID: Glutaredoxin Pfam Description: Glutaredoxin
MSSNLGSYAFVGWLGGGASLLVGTVGCVPRRSSDADSPSPSPSPVALARVVDSRGPTPYNHPTTPSPHRRSPSSRPLINTTGGRVAAEMGIASSSSSNPESRAMALAKAKEIVASAPLVVFSKTSCPFCVRVKQLFEKLGASYKAIELDVESDGPELQNALKEWTGQRTVPNVFINGKHIGGCDDTMALNNDGKLVPLLTEAGAIAGSTSKTTVTA

SEQ ID NO: 18316 - DNA, 2070 bp, Sorghum bicolor
  misc_feature: Ceres ANNOT ID no. 8701818
  misc_feature: Encodes the peptide sequence at SEQ ID NO 18317
atggccgggtggagaaaggcgtggctgtcggtgctggaccgggccgccgccgccggcggcggtggcagcaccggctccctgcaggcgcacctgcagggcctcctccacttcccgtccttcctcgtcctcgccagttacaagcggggcggtacgtacgggagcggccacgtgagcggcaaggcggtggcggcctgcttctccgtcgcgctcgcgctcgccttcttctacgcctcggtcaccggctccttaccttccccagccgccgcttcctcctcctccgcgcttctcttgccgtggctgtcgtcgaactcgtactcgtcgtcgccgacgtcaccgaagaaatcgcttcctactaccgtcactgcgggcggcgctgccgatcaccggaccgacgcgcgcaacgccaccgtggtgtcgcgtcgcgtgcagaccggcgcggtgggggactcgtcgggttcggaggtcggattggggcaagagacgtcagcgccccggcacacgggcggcggcagcgcgcagggtctccccgtgccggacgccggaaacgccaccgtgggttccgacgcggaacccaccagtaacagtaaccgcaccagagaagacgaactgcaagtggaaaccgcgatgccgatgctgcagtggcaaaggacagacggagccaatcgtcctttccacgacaccgtcgtcgtcggtgctgccgccggtcagcaagcgagcctggcacggcgagcggctctgccatcacggtcggagcggaaggcggaaaggcgcaggcgcaggagagccgtgaggcacaggcacccgaggcgacggaaggagatcatgctctcggcgcaggatctcgctgtcgctgccgagcggagccacgaggagatggctggcgtcaaaaccagcttcgccgtcgggccaggcaatgacgtggttggcgtgaacgccagcacgggcggcgtggtcggggccggcaacaaccgtgtcgtgtggacgtccggcgtgcaagacctggtttccttcgccaagtgcgacgtgttcagcggaaggtgggtgagggacgagagctacgggttctacccgcccaaatcgtgcgcactcatcgacgacgacttcaactgccacaagaacggccggccggacagtgacttcctcaggtggcggtggcagccgcacggctgtgacattcccaggctgaacgcggctgagttcctggagaggctgagagggcagaggatcatattcgtcggcgactcgctgaaccggaacatgtgggagtcgctggtctgcatccttcgccatggcgtcagggacaagaggaacgtgtatgaggcatcggggaagaaccagttcaagacccgaggatactactccttcaaattcagggagtacaattgctcggttgatttcataagatcaatattcctcgtcaggcagatgatccgcgaggggagaaacggtactgaagatgcaaagctgaaactggatgagctagacgcgacgactccagcataccggactgcagacatcatcgtcttcaacaccggtcactggtggactcactacaaaacatcaagagggctgaactattaccaagagggcaaccatgtgtatcccagccttgacgttttggatgcatacaagagagctctagtcacctgggctagatgggtggacaagaacatcgatccaagaaggactcaggttgtattcagaggatattccctctcacatttcagaggagggcagtggaattcaggagggagatgccacacggagactgagccaatattgaatcagacatatcttactgagtaccctgagaagatggtaatcctggagcaggtcttgaggcagatgaaaactcccgtcatatacctcaacatcagcgcactcaccgattaccgaaaagatggccatccgtcagtctaccgggtacgttatgatacagaggaggaacggatggcaatggtgaaaaggcaggactgtagccactggtgcttgcctggcgtgccagatacgtggaatcaactgctgtatgcttcgctgcttcaagcaggcaaaggctcctggaaattatga

SEQ ID NO: 18317 - protein, 689 aa, Sorghum bicolor
  misc_feature: Useful for making plants with altered cell wall content and/or composition
  misc_feature: Functional homolog of the protein sequence given in SEQ ID NO 13772
  misc_feature: Ceres ANNOT ID no. 8701818
MAGWRKAWLSVLDRAAAAGGGGSTGSLQAHLQGLLHFPSFLVLASYKRGGTYGSGHVSGKAVAACFSVALALAFFYASVTGSLPSPAAASSSSALLLPWLSSNSYSSSPTSPKKSLPTTVTAGGAADHRTDARNATVVSRRVQTGAVGDSSGSEVGLGQETSAPRHTGGGSAQGLPVPDAGNATVGSDAEPTSNSNRTREDELQVETAMPMLQWQRTDGANRPFHDTVVVGAAAGQQASLARRAALPSRSERKAERRRRRRAVRHRHPRRRKEIMLSAQDLAVAAERSHEEMAGVKTSFAVGPGNDVVGVNASTGGVVGAGNNRVVWTSGVQDLVSFAKCDVFSGRWVRDESYGFYPPKSCALIDDDFNCHKNGRPDSDFLRWRWQPHGCDIPRLNAAEFLERLRGQRIIFVGDSLNRNMWESLVCILRHGVRDKRNVYEASGKNQFKTRGYYSFKFREYNCSVDFIRSIFLVRQMIREGRNGTEDAKLKLDELDATTPAYRTADIIVFNTGHWWTHYKTSRGLNYYQEGNHVYPSLDVLDAYKRALVTWARWVDKNIDPRRTQVVFRGYSLSHFRGGQWNSGGRCHTETEPILNQTYLTEYPEKMVILEQVLRQMKTPVIYLNISALTDYRKDGHPSVYRVRYDTEEERMAMVKRQDCSHWCLPGVPDTWNQLLYASLLQAGKGSWKL

SEQ ID NO: 18318 - DNA, 2196 bp, Sorghum bicolor
  misc_feature: Ceres ANNOT ID no. 8701839
  misc_feature: Encodes the peptide sequence at SEQ ID NO 18319
atgccgccgcggggaccggcggcgctgctgctgctcctcctcctcgtgctctgtgtgcaactcggaacatcaagctctacaactacaagtcttgcatcatacttattcggattctggagtagaacccatcagcatcgctttcctgccctagcccctggcccggccccttctccccaacctcaaggccccattattgctcacccagtgcataggcatcacagaagaaggcatcatgcttccccaccaccttcatcgatttcgccagaaagacaagattgcagcagaacaacttgttctgctccacttacgtcgactccaattggttcaccctgtggttgtgtatatcctatgcaaattcagcttgatcttggcgtggcaccttatcaattatttcccagaatcgatgagttagaaattgaggttgcagcaggtacattcctgaaacagagtcaagttcggataatgggtgctgggagtagtcttcaagatcctgaaaagacaacagtaaccatcgatttggtgccattaggccagaaatttgataggacttcagccttactgattagcaacagatttttgcaaaagaaggttccaataaactcatccgtttttggtgactatgttgctacatatgttcattatccaggccttccttctttagtacctattcctggatccttgggtccagtaagcagtaacgaggacccttttggtgcaaatatacacaatagaagccatcacaagattaactctaaaatggttgccataattgctctgtcagctgtggtttttattttgacgtgcttggccattggcatcgtatggagattcaatggacttaaacattctcatgctatgggccctatttcaagttcttccatcactagaaaaggagctatgaggtcatcgttctctggtacaagcagctcggcagcatcatttgcttcaacaataggaacctgcccatccaccgtaaagacatttacaataactgagcttgagaaggctacagaaaacttcagcttcagcaaaataataggcgaagggggttatggacgtgtttatcgtggtgtaattgaagatggtgttgaggttgctgtcaaattgctcacaaggaaacatcacaacagagatcgcgagttcattgcagaggttgagatgctaagtcggttacatcaccgcaatcttgtcaagctgattggtatatgcattgaacggagcacgaggtgcttggtatttgagcttgttccaaacggaagtgttgaatctcatctacatggttcagataaaatatatggcccgattgattttgacactagaatgaaaatagccctcggcgcagcaaggggactagcctatctgcatgaggacgccaaccctcatgtcattcaccgggatttcaaggctagcaatgttctattggaaaacgatttcacccccaaggttgctgattttgggctggcaaaggaagcgtcagacgggatggatcatatttctactcaggtcatggggactttcgggtacgttgccccagagtatgcgatgacagggcatctgcttgtcaagagcgacgtctacagctacggtgtggtgctcctcgagctgctgtcaggccgaaaacccgtggacatgacccagccaccggggtccgagaacctggtcacctgggcgcgcccgctcctcaccacccgggaaggactgcagcggctggtggacccgtcgctcccggctggttacgacttcgagaagctggccaaggcggcagccatcgcgtccatgtgcgtgcacgtcgaggcgtcgcaccggccgttcatgggcgaggtcgtgcaggcgctgaagctgatccacagcggcgggggcggcgacgagacctgcagcggctccttcgggggcggcgcgacggaggagtccccgtggaacgacgtcagcaggagcacgtggaacgacgacgacccgccggccaccccgggccccgcgctccccctgggctacggctcggaccctgccggcgccgacgagcggaggccacggtcggcgtcgagcgcggtgctggacaagatcgagtccctggcgatgtacgactggtcgggcccgctgcgcaccaaagggaagcacagcttctacaggctgagggggagcatgagcgagcacggtcgcccttcggacgacggcagcgtcgaaggttacttgatgtag

SEQ ID NO: 18319 - protein, 731 aa, Sorghum bicolor
  misc_feature: Useful for making plants with modulated drought sensitivity
  misc_feature: Functional homolog of the protein sequence given in SEQ ID NO 14078
  misc_feature: Ceres ANNOT ID no. 8701839
  misc_feature (327)..(615): SWISSPROT Homolog: EC 2.7.11.1 Non-specific serine/threonine protein kinase
  misc_feature (340)..(612): Pfam ID: Pkinase Pfam Description: Protein kinase domain
MPPRGPAALLLLLLLVLCVQLGTSSSTTTSLASYLFGFWSRTHQHRFPALAPGPAPSPQPQGPIIAHPVHRHHRRRHHASPPPSSISPERQDCSRTTCSAPLTSTPIGSPCGCVYPMQIQLDLGVAPYQLFPRIDELEIEVAAGTFLKQSQVRIMGAGSSLQDPEKTTVTIDLVPLGQKFDRTSALLISNRFLQKKVPINSSVFGDYVATYVHYPGLPSLVPIPGSLGPVSSNEDPFGANIHNRSHHKINSKMVAIIALSAVVFILTCLAIGIVWRFNGLKHSHAMGPISSSSITRKGAMRSSFSGTSSSAASFASTIGTCPSTVKTFTITELEKATENFSFSKIIGEGGYGRVYRGVIEDGVEVAVKLLTRKHHNRDREFIAEVEMLSRLHHRNLVKLIGICIERSTRCLVFELVPNGSVESHLHGSDKIYGPIDFDTRMKIALGAARGLAYLHEDANPHVIHRDFKASNVLLENDFTPKVADFGLAKEASDGMDHISTQVMGTFGYVAPEYAMTGHLLVKSDVYSYGVVLLELLSGRKPVDMTQPPGSENLVTWARPLLTTREGLQRLVDPSLPAGYDFEKLAKAAAIASMCVHVEASHRPFMGEVVQALKLIHSGGGGDETCSGSFGGGATEESPWNDVSRSTWNDDDPPATPGPALPLGYGSDPAGADERRPRSASSAVLDKIESLAMYDWSGPLRTKGKHSFYRLRGSMSEHGRPSDDGSVEGYLM

SEQ ID NO: 18320 - DNA, 1491 bp, Sorghum bicolor
  misc_feature: Ceres ANNOT ID no. 8701853
  misc_feature: Encodes the peptide sequence at SEQ ID NO 18321
atgtcgacgtgcgcggcggacctggcgccgctgctgggcccggcggcggcgaacgccacggactacctctgcggccagttcgccgacacggcgtccgcggtggacgccacgtacctgctcttctcggcgtacctcgtcttcgccatgcagctcggcttcgccatgctctgcgccggctccgtccgcgccaagaacaccatgaacatcatgctcaccaacgtgctcgacgccgccgcgggggcgctcttctactacctcttcggcttcgccttcgccttcggcacgccctccaacggcttcatcggcaagcagttcttcggcctccagcacctgcccaagaccggcttcgactacgacttcttcctctaccagtgggccttcgccatcgccgccgcgggcatcacgtcgggctccatcgccgagaggacccagttcgtcgcctacctcatctactccgcgttcctcaccgggttcgtgtaccccgtggtgtcccactggttctggtccgccgacggctgggccgccgccagccgtacctccggcccgctgctcttcgggtccggcgtcatcgacttcgcgggctccggcgtcgtccacatggtcggcggcatcgcggggctgtggggcgcgctcatcgagggcccccgcatcgggcgcttcgaccacgccggccgctccgtggcgctcaagggccacagcgcgtcgctcgtggtgctcggcactttcctgctgtggttcggctggtacggcttcaacccggggtccttcaccaccatcctcaagtcctacggccccgcggggaccgtcaacgggcagtggtcggccgtgggccgcaccgccgtcaccaccaccctcgccggcagcgtcgccgcgctcaccacgctgttcgggaagcggctccagacgggccactggaacgtggtggacgtctgcaacggcctcctcggcgggttcgcggccatcacggccgggtgcagcgtggtggagccgtgggcggccgtcgtctgcgggttcgtgtccgcgtgggtgctcatcggcgccaacgcgctcgccgcgcgcctcaagttcgacgacccgctggaggcggcgcagctgcacggcgggtgcggcgcctggggcgtcctcttcacgggcctcttcgcgagccaaaagtacgtggaggagatctacggctccgggaggccctacgggctgttcatgggcggcggcgggaagctcctcgccgcgcagatcatccagatcctggtgatcgccgggtgggtgagctgcaccatgggcccgctcttctacgcgctcaagaagctggacctgctgcgcatctcggccgacgacgagatgtccggcatggacctcaccaggcacggcggcttcgcctacgtctaccacgacgaggaccccggcgacaagagcggggttggtgggttcatgctcaagtccgcgcagcaccgtgtcgagccggcggcggcgacggcgaccagcaaccaggtgtaa

SEQ ID NO: 18321 - protein, 496 aa, Sorghum bicolor
  misc_feature: Useful for making plants with modulated carbon-nitrogen partitioning
  misc_feature: Functional homolog of the protein sequence given in SEQ ID NO 14551
  misc_feature: Useful for making plants with altered carbon content
  misc_feature: Useful for making plants with altered nitrogen content
  misc_feature: Functional homolog of the protein sequence given in SEQ ID NO 14552
  misc_feature: Ceres ANNOT ID no. 8701853
  misc_feature (36)..(459): Pfam ID: Ammonium_transp Pfam Description: Ammonium Transporter Family
MSTCAADLAPLLGPAAANATDYLCGQFADTASAVDATYLLFSAYLVFAMQLGFAMLCAGSVRAKNTMNIMLTNVLDAAAGALFYYLFGFAFAFGTPSNGFIGKQFFGLQHLPKTGFDYDFFLYQWAFAIAAAGITSGSIAERTQFVAYLIYSAFLTGFVYPVVSHWFWSADGWAAASRTSGPLLFGSGVIDFAGSGVVHMVGGIAGLWGALIEGPRIGRFDHAGRSVALKGHSASLVVLGTFLLWFGWYGFNPGSFTTILKSYGPAGTVNGQWSAVGRTAVTTTLAGSVAALTTLFGKRLQTGHWNVVDVCNGLLGGFAAITAGCSVVEPWAAVVCGFVSAWVLIGANALAARLKFDDPLEAAQLHGGCGAWGVLFTGLFASQKYVEEIYGSGRPYGLFMGGGGKLLAAQIIQILVIAGWVSCTMGPLFYALKKLDLLRISADDEMSGMDLTRHGGFAYVYHDEDPGDKSGVGGFMLKSAQHRVEPAAATATSNQV

SEQ ID NO: 18322 - DNA, 4086 bp, Sorghum bicolor
  misc_feature: Ceres ANNOT ID no. 8701862
  misc_feature: Encodes the peptide sequence at SEQ ID NO 18323
atggcaccatcttccagtactctctccacggttactacgcatggacgttttccttacttgacaccaccaaccatgcattcttccctttctggaatcctgccctccgacatgatatcctcctattctggactacaagaacaaccttcaggtggtagtttctctggactatctcttgaagcaaccaattgtgcagacctacttggtgatggtgtgcagaataacattggcatttccaatgctgagagtcagcaaattcctggttttgtcagaaccatcgatgaatctgacgatagagatgaatggttaacagatttggatgatattattaccactgatataactccgaactgtcaacaactggctgaatctgcacctgttccctcatatccaaattctaagtcatggcaacatgatgtgcacattgtacatcaatcagtctcagttctttctgaacctcaacagttgtatccaactgtttctcctgtggtaactacaaatgctcattgcccccaaagggccaaggcacgcatgcgatggactatggaaatgcatgatcgcttcgtagatgctgtcaatctgcttggtggcagtgaaagtgctaaacctaaagcaattcttgatatcatggatgttgaaggtctgactcgtgatcaggtgaaaagccacttgcagaagtacaaaatggctcaagttaagcatcacccatctgaagttacaggtacatcagtggagacaaccgtgtgtaacgaagtaataccttcagatctttactatttcttgtgcaagttgtcggcgcctatgttgaattttttgggactcgcgcccgatagtggccgctccgttttcccgttctcactttcagttctatccgtctcgtctctctcctgtcctctcgtcttcctcgttggcgacgcgacgggcgattctagggtttcgcaggttaggcttattgagatggttcggaaaagggtggttcgagaacttgattcatccagttcgggaggttctgaaactgattcttcagaggatgtgcagtgttctcaattgccttatatggattatgattcctgtgaatatctttcaaattctcagcttgttggagaagatgattcctctagtgacaattcaagtttggaccatcatttgtatgagaaatgtataaaagatttgcagaaaatgaagaatatgaagagaaagcttgagatggcaatgaagcataagtctaaaaagaagaaagttgtgaagaagagtaatgatggtttcaccagattttctccgactgcattcatgaatgtgatatcttctctttcccctgaaaagaaggctgttattgatggctatggttttggttctttgttgatgttcaataagtgttttgtgcctaataagtttgctacctgggttgcacgtttagttgattccaagtctggtgatattattcgcaatggaaaggttatttcactatctgaggagtctgttcatttcgttcttgatcttcctttgggtaccagagcatttccatctgattcaagtattggcaaggatattgttttatccaagtttggaaaggataggatccctcctgtgtccttttttgctgataagttgatcagtaatgaacaattatctaatgaagacatgttgatatgtttcttggtagttgctttgagtagttttttatgcccaaataccaatattgttcctagccccaagtattttggtgttttcgaagatattgatcacatcaaggatttcaagtggtgtgcttttgtgttggaatggttgctggatcatataaaggcattcaataggggaaagagtgataagctgaaacgttgtcagggtcttggtggttgcttatactaccttgtggttgtttatttggatcacattgactttcgtcaacgtcaagttgcagactttattcctcgaatctctgtatggaagcaagatatgattcagttttattgtagtcttgatcttaaatctcctggtgtttatggttacagaccattgcttgaatttgagaaaacttgctactacaaggctgttcgtcttaattcagttggttgtgctgatgatcttgactctgagttttgcgccaagatggaaagtgtttctggctgtaaacttccttttagtttgaagttaaaaatatcaaagctgattgatgagcattgctttaattgtggtttatctgtgaacatggatatcaattctcttggaaatgtttcaaaagaatttcaagatatgtttgcaaagatgttccgtcatatttgtaaaactgatgttagaacaaaggatcttgttcttgagattatgaaggctattgctgaaactgatccttctgttgatgatggtgctggttcttatgctgctgcggtgcctcccaatgttgctgattctatttctgatggtgctccagaagaacctaatgttgttgctcctaaggtacctgtgaatgcttttgttccatcttcatcaagatcaactcaaaagaatgttgggttctctggtactgataatgttatcgatgttgagttggatgagactatgcgtaacctacgaaagagtagctcagatgttctaagtcaaaagttcaagtctaagcctggtgttacgaatgttgctgttgacaacccattgtgtgatattactaatgttcgttctcgttttggttctcgtggcaaatcttctgatttagataaagatgtgatttatcttgacaatgataatgttattgtacctgattctgtttctccaagtccttttcgtcatcgttctagacttgcatattctaaggtttctcaaggtattttgcatggatctcagaataccaaagatgaggatgttgtgttgatgcagactataccttttactgttgatggatctcctcatattactccaattctacctaggaagtctaatgttttacatagtagtaatggttctgataagagggctcgtatttctgatcataatgattcttccccagttatttgtattggttctagatcgtttgctgaaactgttaaagttgacactaagaaatcagatgatttatacaacttgaagtttgggaaattgagaatgacttcacagacttcttctatttcccttggcaatactcatggatttcctgctgattcttctattgatcctgaaagcttggcgaatcgttctgatttcaaggtcaggaactcgtcaactggtgggaagatccctattcatggtcctagaaggatggttcgtccaagtcgagttcttatagatgattatgatgtaactggagataagttcaaagtttcaaaatcagaaattgcaaactatgaggctatttgtcgtttggcccaatcacgttctagcaatcttgatgctttgtactttggaggtgttcgttgtacgtattggtctcttggtgaatcaatgaagccaggtggtaaagtcaacaattttgttgttgctgcattttgctatcatcttttttgccgacctgatgggcatccagatatttcgaagcggcattacttcttttcaaatatctcagaaaatctcctgaaagatcatgatgaagttgccggtgatgtgatgatgagagcatttgatcgttcttcaaaggcgaggccactttttcaatcaaatatgttgtatttccctacattttatgaagatcattggtttgtatttgttgttgacatcaaggataagaaatttgtgtttctggactcatactattcagaagttcacgcttatcagcaatatgttagggcgaagatgatcccagagtttcaattttggtggaacaagtttgttaagcgtgaaatgaactttgaacagtatggtgttctatacccaagtgtgcctaagcaatctgcagaaaataatgttgattcaggaatttatgctatgatgttcctcgagcattggacttctccaaggtcaagtctattttccctgttcagcagtgatgacattgtaaacataaggatcaaattagcaaatgagatgttgttcaatccaagaaataccggaaacaagacccctgtgattagttttgacttgaatgaggaaggtggttcagagtag

SEQ ID NO: 18323 - protein, 1361 aa, Sorghum bicolor
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
  misc_feature: Ceres ANNOT ID no. 8701862
  misc_feature (176)..(227): Pfam ID: Myb_DNA-binding Pfam Description: Myb-like DNA-binding domain
MAPSSSTLSTVTTHGRFPYLTPPTMHSSLSGILPSDMISSYSGLQEQPSGGSFSGLSLEATNCADLLGDGVQNNIGISNAESQQIPGFVRTIDESDDRDEWLTDLDDIITTDITPNCQQLAESAPVPSYPNSKSWQHDVHIVHQSVSVLSEPQQLYPTVSPVVTTNAHCPQRAKARMRWTMEMHDRFVDAVNLLGGSESAKPKAILDIMDVEGLTRDQVKSHLQKYKMAQVKHHPSEVTGTSVETTVCNEVIPSDLYYFLCKLSAPMLNFLGLAPDSGRSVFPFSLSVLSVSSLSCPLVFLVGDATGDSRVSQVRLIEMVRKRVVRELDSSSSGGSETDSSEDVQCSQLPYMDYDSCEYLSNSQLVGEDDSSSDNSSLDHHLYEKCIKDLQKMKNMKRKLEMAMKHKSKKKKVVKKSNDGFTRFSPTAFMNVISSLSPEKKAVIDGYGFGSLLMFNKCFVPNKFATWVARLVDSKSGDIIRNGKVISLSEESVHFVLDLPLGTRAFPSDSSIGKDIVLSKFGKDRIPPVSFFADKLISNEQLSNEDMLICFLVVALSSFLCPNTNIVPSPKYFGVFEDIDHIKDFKWCAFVLEWLLDHIKAFNRGKSDKLKRCQGLGGCLYYLVVVYLDHIDFRQRQVADFIPRISVWKQDMIQFYCSLDLKSPGVYGYRPLLEFEKTCYYKAVRLNSVGCADDLDSEFCAKMESVSGCKLPFSLKLKISKLIDEHCFNCGLSVNMDINSLGNVSKEFQDMFAKMFRHICKTDVRTKDLVLEIMKAIAETDPSVDDGAGSYAAAVPPNVADSISDGAPEEPNVVAPKVPVNAFVPSSSRSTQKNVGFSGTDNVIDVELDETMRNLRKSSSDVLSQKFKSKPGVTNVAVDNPLCDITNVRSRFGSRGKSSDLDKDVIYLDNDNVIVPDSVSPSPFRHRSRLAYSKVSQGILHGSQNTKDEDVVLMQTIPFTVDGSPHITPILPRKSNVLHSSNGSDKRARISDHNDSSPVICIGSRSFAETVKVDTKKSDDLYNLKFGKLRMTSQTSSISLGNTHGFPADSSIDPESLANRSDFKVRNSSTGGKIPIHGPRRMVRPSRVLIDDYDVTGDKFKVSKSEIANYEAICRLAQSRSSNLDALYFGGVRCTYWSLGESMKPGGKVNNFVVAAFCYHLFCRPDGHPDISKRHYFFSNISENLLKDHDEVAGDVMMRAFDRSSKARPLFQSNMLYFPTFYEDHWFVFVVDIKDKKFVFLDSYYSEVHAYQQYVRAKMIPEFQFWWNKFVKREMNFEQYGVLYPSVPKQSAENNVDSGIYAMMFLEHWTSPRSSLFSLFSSDDIVNIRIKLANEMLFNPRNTGNKTPVISFDLNEEGGSE

SEQ ID NO: 18324 - DNA, 1779 bp, Sorghum bicolor
  misc_feature: Ceres ANNOT ID no. 8701896
  misc_feature: Encodes the peptide sequence at SEQ ID NO 18325
atggcgggcgtgataattgtgctcgtcttctttcttgctcaccagctcttaccgtgcgcttcatcagctattgatcgcaaccagttccctccagacttcctgtttgggacctctacctctgcttaccagtttgcacataaagatgctcatacagatgagcgctgggagcagggaacaagggcattgccgacgtactacgccagctccttcctcaggcataatccgaatccgaaacgtttctctaagaataatctagattcctaccaaatgcaccatttaaatggtaggcttgggctaaccgggacacgtgttcatgtgggtttgctaagtcaagaaactaccttccaaactgctagagtcatgcagtatatttttatagttaatatatttgaagacattgaaggtggatatttggagggtaataaaggcttaagcaattgggatattttcacccataagcaaggtacagttgaggatgggaccaatggtgacactgctgatgatcactatcatcgttacatggaagatattgaattgattcattccttgggtgtcaactcatatcgattttccattgcatgggcaaggattctaccaaaaggccgctttgggcatgttaatccagatggtgtagcattctacaatgctcttattgatgctcttctacaaagaggtatagaaccatttgtgacgatatctcattatgacattccatatgaactagagaagcgatatggtggatggttgagccccaaaattcggatgtttggtgaccgagtaaaattttggataacatttaatgagccaaatatatttgcaaagctcagctatatctatggacggtaccctcctggtcactgctcaaggccatttgggaactgtacttctggaaattcttcaactgagccatacatagtgggtcacaacatggtattgtctcatgcaaatgtggtcagcatttacaaggaaaaatatcaggggaaacaaggtggttatattggaattacagttctctcaagatggtacgaaccattccgaaatatcccaacagatatcttagcagttgatcggggtctatcttttggcgctccatggtttctggaccccataattcttggtgattacccctctccgatgcgcaagatgttgggtccaaacctacctgaattcacatcaaaacaaaagaagatactacaaccatccaagttggatttcattggtttaaatcattattcaacatcctatttgaaggactgtatctactcatcaccatgtgaattggatccatttgatggggatgcccaaattagtacttcaatagacagagatggaatacttattggtgaaaggacagggtcgccatacttgaatgtcgttccatatgggatggagaaagtggtcatgtatttcaaaaggagatataataacacaccaatgtatatcactgaaaatggttatgcccaagcaagcaatagcaacatgtctgccaaggattttactaatgacacaggaagagtagattatcttcaaggctaccttacctttctggcctcagcgataaggaaaggggctgatgtgcgtggctacttcgtgtggtctcttctcgacaacttcgagtggaactctgggtacacacaaagatttgggctctaccatgtcgacttcaagacacaaaaacgaaccccaaaactatccgcgaaatggtatagtgagttcctcaaggggtcacccctgagaacaaggccccaaaatggaaattcctaccagtacactgcctaa

SEQ ID NO: 18325 - protein, 592 aa, Sorghum bicolor
  misc_feature: Useful for making plants with altered carbohydrate content
  misc_feature: Functional homolog of the protein sequence given in SEQ ID NO 14617
  misc_feature: Useful for making plants with altered cell wall content and/or composition
  misc_feature: Functional homolog of the protein sequence given in SEQ ID NO 14618
  misc_feature: Ceres ANNOT ID no. 8701896
  misc_feature (123)..(573): SWISSPROT Homolog: EC 3.2.1.147 Thioglucosidase
  misc_feature (126)..(578): Pfam ID: Glyco_hydro_1 Pfam Description: Glycosyl hydrolase family 1
MAGVIIVLVFFLAHQLLPCASSAIDRNQFPPDFLFGTSTSAYQFAHKDAHTDERWEQGTRALPTYYASSFLRHNPNPKRFSKNNLDSYQMHHLNGRLGLTGTRVHVGLLSQETTFQTARVMQYIFIVNIFEDIEGGYLEGNKGLSNWDIFTHKQGTVEDGTNGDTADDHYHRYMEDIELIHSLGVNSYRFSIAWARILPKGRFGHVNPDGVAFYNALIDALLQRGIEPFVTISHYDIPYELEKRYGGWLSPKIRMFGDRVKFWITFNEPNIFAKLSYIYGRYPPGHCSRPFGNCTSGNSSTEPYIVGHNMVLSHANVVSIYKEKYQGKQGGYIGITVLSRWYEPFRNIPTDILAVDRGLSFGAPWFLDPIILGDYPSPMRKMLGPNLPEFTSKQKKILQPSKLDFIGLNHYSTSYLKDCIYSSPCELDPFDGDAQISTSIDRDGILIGERTGSPYLNVVPYGMEKVVMYFKRRYNNTPMYITENGYAQASNSNMSAKDFTNDTGRVDYLQGYLTFLASAIRKGADVRGYFVWSLLDNFEWNSGYTQRFGLYHVDFKTQKRTPKLSAKWYSEFLKGSPLRTRPQNGNSYQYTA

SEQ ID NO: 18326 - DNA, 1269 bp, Sorghum bicolor
  misc_feature: Ceres ANNOT ID no. 8701886
  misc_feature: Encodes the peptide sequence at SEQ ID NO 18327
atggcgacgtggcctcagaccattatcatcgatacaagattctcattgtcctggtcaagaatacttccaaagggtcgcttcggaggtgttaatccggcaggcgttaaattctacagcagcctcatcaacggcctgctaggaaaagggatacaaccatttgtgacgatcaaccactatgacttacccgaggaactcgaagaaagatatggctcctggttgagcccagagattcaggaggacttcacctactttgctgagctttgcttcaagatgtttggtgaccgagtaaagcactgggctacattcaatgagccaaatattttggctaagctcgcatactcggccgggatatttccacccaaccgttgttccaggtcatatggaacatgcgactctgggaattcatcaaccgagccctatattgcagcgcataacatgatattagctcatgcaaaggcggtgaacatctacagaaagaattacaaggccaagcaaggtggctctgttggaattacactatcaatgatgtggtttgaaccactgaggaatgtcacagaggaccacgtggcagtaggccgagctctgtctttcgatgctgcgtggttcctggatcccttgttctttggtgactatcctcaacaaatgcgcaaaatcttaggtccaaacttgccaaaaatcacagaaggagagaagcaactaattaaaaaccaaattgacttcatcggagtaaatcactacaataccttctatgtcaaggattgcatatattctctatgtgattcggacaccgaagctttagtttctcaatcaacagaacgaaatgggatacccatcggaaaactgacaccggacaacagctatgtggttccaggctctatggagaagttggtcatgtatttagagcagagatataaaagcatacctttgtacatcacagagaatggttatgcccaaataggcaatagcagcaccacaacagaagaattaataaatgataatggaaggtcaagttacattggtgactacctcacttacttgagctttgcaataaggaaaggagcagatgtgagaggttattttgtgtggtctttgatggataccttcgaatggaactccggttacaccgtaaagtatggtctttttgacgtggatttgaagtcactaaagcgaacaccaagactgtccgctaaatggtacagcaagtttatcaagggctatgaacagatagagatggtctctgaagaatcacctaagcatatggtttcctag

SEQ ID NO: 18327 - protein, 422 aa, Sorghum bicolor
  misc_feature: Useful for making plants with altered carbohydrate content
  misc_feature: Functional homolog of the protein sequence given in SEQ ID NO 14617
  misc_feature: Useful for making plants with altered cell wall content and/or composition
  misc_feature: Functional homolog of the protein sequence given in SEQ ID NO 14619
  misc_feature: Ceres ANNOT ID no. 8701886
  misc_feature (13)..(402): SWISSPROT Homolog: EC 3.2.1.21 Beta-glucosidase
  misc_feature (2)..(408): Pfam ID: Glyco_hydro_1 Pfam Description: Glycosyl hydrolase family 1
MATWPQTIIIDTRFSLSWSRILPKGRFGGVNPAGVKFYSSLINGLLGKGIQPFVTINHYDLPEELEERYGSWLSPEIQEDFTYFAELCFKMFGDRVKHWATFNEPNILAKLAYSAGIFPPNRCSRSYGTCDSGNSSTEPYIAAHNMILAHAKAVNIYRKNYKAKQGGSVGITLSMMWFEPLRNVTEDHVAVGRALSFDAAWFLDPLFFGDYPQQMRKILGPNLPKITEGEKQLIKNQIDFIGVNHYNTFYVKDCIYSLCDSDTEALVSQSTERNGIPIGKLTPDNSYVVPGSMEKLVMYLEQRYKSIPLYITENGYAQIGNSSTTTEELINDNGRSSYIGDYLTYLSFAIRKGADVRGYFVWSLMDTFEWNSGYTVKYGLFDVDLKSLKRTPRLSAKWYSKFIKGYEQIEMVSEESPKHMVS

SEQ ID NO: 18328 - DNA, 1533 bp, Sorghum bicolor
  misc_feature: Ceres ANNOT ID no. 8701902
  misc_feature: Encodes the peptide sequence at SEQ ID NO 18329
atggcgggcgtaataattgtgctcgctttctttcttgctcaccagctcttactgccgtgcgcttcatcagctattgatcgcaaccagttccctccagacttcctgtttgggacctctacctctgcttaccagattgaaggtggatatttggagggtaacaaaggcttaagcaattgggatattttcacccacacacaaggtaaagttgaggatgggaccaatggtgataccgctgatgatcactatcatcattatatggaagacattgaattgatgcattccatgggtgtcaactcatacagattttccattgcatgggcaaggattctaccaaaaggccgcttcgggcatgttaatcctgatggtgtagcattgtacaatgctcttattgatgctcttctacaaagaggcatagaaccatttgtgacaatatctcattttgacattccatatgaactggaagaacgatatggtggatggttgagcccaaaaattcggatgtttggtgaccgagtaaaattttggataacatttaatgagccaaatatgttcacaaagcttggctatatctatggacggttccctcctggtcactgttctaggccatttgggaactgtacttttggaaattcttcaactgagccatacatagcaggtcacaatataatattgtctcatgcaaatgtggtcaacatttacaagaaaaagtaccaggggaaacaaggtggccgtattggaattactgttcaatcaagatggtatgaaccattccggaataccccaacagacatcttaggtgttgagcgggctctgtcttttggcgctccatggtttttggaccccataattcttggccattacccctctgcgatgcgcaagatcttgggtccaaatctacctgaattcacattgaaacaaaagaagatactacagacatccaagttggatttcattggtttaaatcattattcaacaaattatttgaaggatagcatctcctcatcatcaccatgtgaattggatcaatatgatggggatgcccaaattagtacttcggcagaaagagatggaatacttattggtgaaaggacagggtcgccatacattaatacagttccatacgggattgaaaaagtggtcacatatttgaatacaagatacaataacacaccaatttatgtcactgaaaatggttatgctcaagcaagcaatagcagcatgtctgccaaggattttactaatgacacaggaagagtcaattatcttcaaggctacctcacctctttggcctcagcaataaggaaaggagccgatgtgcatggttactttgtgtggtctcttctcgacaactttgagtggaataatggatacacacagagatttgggctctactatgtcgactacaatacacagaaaaggacccctaaactttcaacaaaatggtatcgtgagttccttatgggatcaaccctgagaacaagtccccaaaatggaaactcccactattctcctcaaaagattagtgatatgtag

SEQ ID NO: 18329 - protein, 510 aa, Sorghum bicolor
  misc_feature: Useful for making plants with altered carbohydrate content
  misc_feature: Functional homolog of the protein sequence given in SEQ ID NO 14617
  misc_feature: Useful for making plants with altered cell wall content and/or composition
  misc_feature: Functional homolog of the protein sequence given in SEQ ID NO 14618
  misc_feature: Ceres ANNOT ID no. 8701902
  misc_feature (25)..(467): SWISSPROT Homolog: EC 3.2.1.21 Beta-glucosidase
  misc_feature (26)..(491): Pfam ID: Glyco_hydro_1 Pfam Description: Glycosyl hydrolase family 1
MAGVIIVLAFFLAHQLLLPCASSAIDRNQFPPDFLFGTSTSAYQIEGGYLEGNKGLSNWDIFTHTQGKVEDGTNGDTADDHYHHYMEDIELMHSMGVNSYRFSIAWARILPKGRFGHVNPDGVALYNALIDALLQRGIEPFVTISHFDIPYELEERYGGWLSPKIRMFGDRVKFWITFNEPNMFTKLGYIYGRFPPGHCSRPFGNCTFGNSSTEPYIAGHNIILSHANVVNIYKKKYQGKQGGRIGITVQSRWYEPFRNTPTDILGVERALSFGAPWFLDPIILGHYPSAMRKILGPNLPEFTLKQKKILQTSKLDFIGLNHYSTNYLKDSISSSSPCELDQYDGDAQISTSAERDGILIGERTGSPYINTVPYGIEKVVTYLNTRYNNTPIYVTENGYAQASNSSMSAKDFTNDTGRVNYLQGYLTSLASAIRKGADVHGYFVWSLLDNFEWNNGYTQRFGLYYVDYNTQKRTPKLSTKWYREFLMGSTLRTSPQNGNSHYSPQKISDM

SEQ ID NO: 18330 - DNA, 1527 bp, Sorghum bicolor
  misc_feature: Ceres ANNOT ID no. 8701882
  misc_feature: Encodes the peptide sequence at SEQ ID NO 18331
atggcgcgtctcttcttcctcctcctcctctttcccctcctctgctcctccgtcaccgggctcaggcgcagcgacttcccgccgtccttcctcttcggcgccggcacgtcggcttaccaggttgaaggcgcctacctagaagacaacaagggcccaagcaattgggatgtcttcacccatattcaaggcggctccgtgcacgcctggcgacattgcccgcactcacccagcgatgactcccacatgcgcatgacggtggcccctacgcacgctcgacaacccctctccctctccctgagcgtgtcatcctcaagccgattctcattgtcctggtcaagaatacttccaagcgttcaattctacaacagcctcatcaacggcctgctgggaaaagggatacagccatttgtgacaatcaaccactatgacataccccaggaactccaagaaagatacggctcctggttgagcccagagattcaggaggacttcatctactttgctgagctttgcttcaagatgtttggtgaccgagtaaagcactgggttacatttaatgagccaaatcttatggtaaagctcgcatacttcgctgggggatttccacccagccactgttctgagccgtacgggaaatgcgattccgggaattcatcaactgagccctacattgcagcgcataacatgatattagctcatgcaaaggcggtgaacatctacagaaagaattacaaggccaagcaaggtggctctattggaattacactacacatgagatggtatgaaccactgaggaatatcacagaggaccacttggcagtaagccgagctctgtctttcgaagctcaatggttcctagatcccttgttctttggtgaatatcctcaacaaatgcacaaaatcttaggtccaaacttgccgaaattcacagaaggagagaagcaactactgaaaaaacaaattgacttcatcggagtaaatcactacgaaacatactacgtcaaggattgcatatattctcaatgtgatttggacctctacacttgtgtagctttagtttctgaatcatcagaacgaaatgggatgccaattggaaaactgacaccagcaaatagctatgtggttccaagctctatggagaagttggtcatgtatttagagcagagatataaaagcatacctttgtacatcacagagaatggttatgcccaaataggcaatagcagcaccacaacagaagaattaataaatgataatggaaggtcaggttacattggtgactacctcacttacttgagctttgcaataaggaaaggagcagatgtgagaggttattttgtgtggtctttgatggataccttcgaatggaactccggttacaccgcaaagtatggtctttttcacgtggatttcaagtcactaaagcgaacaccaagactgtccgctaaatggtacagcaagtttatcaagggctatgaacagatagagatggtctctgaagaatcacctaagcatatggtttcctag

SEQ ID NO: 18331 - protein, 508 aa, Sorghum bicolor
  misc_feature: Useful for making plants with altered cell wall content and/or composition
  misc_feature: Functional homolog of the protein sequence given in SEQ ID NO 14620
  misc_feature: Ceres ANNOT ID no. 8701882
  misc_feature (117)..(489): SWISSPROT Homolog: EC 3.2.1.147 Thioglucosidase
  misc_feature (22)..(494): Pfam ID: Glyco_hydro_1 Pfam Description: Glycosyl hydrolase family 1
MARLFFLLLLFPLLCSSVTGLRRSDFPPSFLFGAGTSAYQVEGAYLEDNKGPSNWDVFTHIQGGSVHAWRHCPHSPSDDSHMRMTVAPTHARQPLSLSLSVSSSSRFSLSWSRILPSVQFYNSLINGLLGKGIQPFVTINHYDIPQELQERYGSWLSPEIQEDFIYFAELCFKMFGDRVKHWVTFNEPNLMVKLAYFAGGFPPSHCSEPYGKCDSGNSSTEPYIAAHNMILAHAKAVNIYRKNYKAKQGGSIGITLHMRWYEPLRNITEDHLAVSRALSFEAQWFLDPLFFGEYPQQMHKILGPNLPKFTEGEKQLLKKQIDFIGVNHYETYYVKDCIYSQCDLDLYTCVALVSESSERNGMPIGKLTPANSYVVPSSMEKLVMYLEQRYKSIPLYITENGYAQIGNSSTTTEELINDNGRSGYIGDYLTYLSFAIRKGADVRGYFVWSLMDTFEWNSGYTAKYGLFHVDFKSLKRTPRLSAKWYSKFIKGYEQIEMVSEESPKHMVS

SEQ ID NO: 18332 - DNA, 231 bp, Sorghum bicolor
  misc_feature: Ceres ANNOT ID no. 8701887
  misc_feature: Encodes the peptide sequence at SEQ ID NO 18333
atggcgcgtctcttcttcctcctcctatttcccctcctccactcttccgtcgccgggctcaagcgcagcgacttcccaccgtccttcctcttcggcgccggcacgtcggcttaccaggttgagggcgcctacctagaagacaacaagggcctgagcaattgggatgtcttcacccatattcaaggaccagctgcaaacgaggaagacgaagacgaagtcatcttgggctga

SEQ ID NO: 18333 - protein, 76 aa, Sorghum bicolor
  misc_feature: Useful for making plants with altered carbohydrate content
  misc_feature: Functional homolog of the protein sequence given in SEQ ID NO 14617
  misc_feature: Useful for making plants with altered cell wall content and/or composition
  misc_feature: Functional homolog of the protein sequence given in SEQ ID NO 14325
  misc_feature: Ceres ANNOT ID no. 8701887
  misc_feature (25)..(69): SWISSPROT Homolog: EC 3.2.1.21 Beta-glucosidase
MARLFFLLLFPLLHSSVAGLKRSDFPPSFLFGAGTSAYQVEGAYLEDNKGLSNWDVFTHIQGPAANEEDEDEVILG

SEQ ID NO: 18334 - DNA, 1608 bp, Sorghum bicolor
  misc_feature: Ceres ANNOT ID no. 8701903
  misc_feature: Encodes the peptide sequence at SEQ ID NO 18335
atggcggccgaggtggtgtggctgctgctcttgctcgctcacgagctcctgccgtgcccctgcgcggcctcggccgttgaccgcggccagttccctgacagcttcctgttcgggacctccacctccgcataccagatcatcatcatcatcatcaacaacaacaacaacaaaaacaagcctattaatcccaaacaaattgggattgaaggcgcatatttggagggtaacagaggcctcagcacttgggatgtattctcccataagctaggtacaatcgaggatggaagcaacggtgagactactgctgatcactatcatcattacttggaagacattgaattgatgcattccttgggtgtcaactcataccggttctctatacgtggacaagaattctaccaattacttcttgttgcaggaggccaattcggacatgttaacctggatggcatagcattctacaatgatctgattgatgcacttctgcaaaaaggcatacaaccgtttgttacaatatcacattacgacattccacaagaactggaaatgcgatatggtggatggctgagccccgaaattcagaaggactttggctactttgcagaagtatgcttcaagatgtttggtgatcgagtaaaattttggataacatttaatcaggcaaatctgtccttgaagttcagttatatggatggatggtacccacccagtcgctgctctcagccatttggtaattgtggctttgggaattccacaacagagccatacatagcaggacacaatatgatattgtcgcatgcaaatgcagtcagtgtctacagaaaaagatatcaggagaaacaaggtggtcatattggaatttctatttgcgcaatatggtatgaaccattcgggaataccacagcagacatcttagcagttgaacgtgctttatcttttggtggtccatggtttttggatcctttaattcttggtgattatcccatagagatgcgcaagatcttaggttcaaacttacctgaattcaaatccaaacagaagaagctgctaaaggccacaggattggatttcattggactaaatcattatacgacattatatttgaaggactgcatcttctcaccatgtgaagtagatcctgttgatggggatgctcgagtttttagttcagcaacaggagcgccgttctattattctgttccagatgggatggaacaagtggtcatgtattacaaagaaagatacaataacacaccaatctatattacagaaaatggttatgctcaaggaagcaatagcagcatgagtgccaaggattttaccaacgatactccaaggattaactacattcgtgactacctgacctttttagcctcagccataagaaacggtgccgacgtgcgcggttacttcatatggtctttgttggattgctttgagtggacgtctgggtacacgctaaggttggggctctgtcatgtcgacttcaacacgctgaagaggactccaaaactttcggccaactggttcaggaagtttctcaagggatcacttgttgggacaaggctccgagacaaaagttcccagctgcagcactacacggcataa

SEQ ID NO: 18335 - protein, 535 aa, Sorghum bicolor
  misc_feature: Useful for making plants with altered carbohydrate content
  misc_feature: Functional homolog of the protein sequence given in SEQ ID NO 14617
  misc_feature: Useful for making plants with altered cell wall content and/or composition
  misc_feature: Functional homolog of the protein sequence given in SEQ ID NO 14621
  misc_feature: Ceres ANNOT ID no. 8701903
  misc_feature: Up-regulated in root tissues in response to salicylic acid treatment
  misc_feature (68)..(497): SWISSPROT Homolog: EC 3.2.1.21 Beta-glucosidase
  misc_feature (27)..(519): Pfam ID: Glyco_hydro_1 Pfam Description: Glycosyl hydrolase family 1
MAAEVVWLLLLLAHELLPCPCAASAVDRGQFPDSFLFGTSTSAYQIIIIIINNNNNKNKPINPKQIGIEGAYLEGNRGLSTWDVFSHKLGTIEDGSNGETTADHYHHYLEDIELMHSLGVNSYRFSIRGQEFYQLLLVAGGQFGHVNLDGIAFYNDLIDALLQKGIQPFVTISHYDIPQELEMRYGGWLSPEIQKDFGYFAEVCFKMFGDRVKFWITFNQANLSLKFSYMDGWYPPSRCSQPFGNCGFGNSTTEPYIAGHNMILSHANAVSVYRKRYQEKQGGHIGISICAIWYEPFGNTTADILAVERALSFGGPWFLDPLILGDYPIEMRKILGSNLPEFKSKQKKLLKATGLDFIGLNHYTTLYLKDCIFSPCEVDPVDGDARVFSSATGAPFYYSVPDGMEQVVMYYKERYNNTPIYITENGYAQGSNSSMSAKDFTNDTPRINYIRDYLTFLASAIRNGADVRGYFIWSLLDCFEWTSGYTLRLGLCHVDFNTLKRTPKLSANWFRKFLKGSLVGTRLRDKSSQLQHYTA

SEQ ID NO: 18336 - DNA, 276 bp, Sorghum bicolor
  misc_feature: Ceres ANNOT ID no. 8701893
  misc_feature: Up-regulated in root tissues in response to salicylic acid treatment
  misc_feature: Encodes the peptide sequence at SEQ ID NO 18337
atggcgcgtctcttcttcttcctcctcctcctctttcccctcctctgctcctccgtcaccgggctcaggcgcagcgacttcccgccgtccttcctcttcggcgccggcacgtcggcttaccagattgaaggcgcctacctagaagacaacaagggcctgagcgattgggatgtcttcactcatattcaaggtctcagttgtgcatacgatgatctaagccatttaattaagcaactcaataataaggggtataagcaaactatatggccgccttga

SEQ ID NO: 18337 - protein, 91 aa, Sorghum bicolor
  misc_feature: Useful for making plants with altered cell wall content and/or composition
  misc_feature: Functional homolog of the protein sequence given in SEQ ID NO 14336
  misc_feature: Ceres ANNOT ID no. 8701893
  misc_feature (27)..(90): SWISSPROT Homolog: EC 3.2.1.21 Beta-glucosidase
MARLFFFLLLLFPLLCSSVTGLRRSDFPPSFLFGAGTSAYQIEGAYLEDNKGLSDWDVFTHIQGLSCAYDDLSHLIKQLNNKGYKQTIWPP

SEQ ID NO: 18338 - DNA, 1551 bp, Sorghum bicolor
  misc_feature: Ceres ANNOT ID no. 8701907
  misc_feature: Encodes the peptide sequence at SEQ ID NO 18339
atggcggcggccggtagctggcccagggccagtgcgcggcggctcttgctcgccggcgcttattattcgctcctgtggctgctggatctcccttgggccacggcggcggtccgcaggagcgacttcccggcgtcgttcctcttcggcaccgccacctcctcctaccagatcgaaggtgcgtacctcgagggcaacaaaagcttaagcaactgggatgtcttcactcatgcacctggaagaatcaaagacagaagcaccggagatgttgcggatgatcactatcatcgttacgaggaagacattgagctcatgcactccctcggcacgaacgcctacagattctcgatatcatgggccagagttcttccaaaaggaagatttggcaaagtcaacccagcaggcatcgcgttctacaacaaactcatcgattctctcctgctcaaaggaatagagccattcgtgacgctgacccactacgacaccccgcaagagctggaggacaggtacggggcgtggctcagcgccgaggcgcggcgcgacttcggccacctggcggacgtgtgcttcgcggcgttcggcgaccgcgtcaagtactggagcaccttcaacgagcccaacgtggtggtgaccaggggctacatggtcggcacctacccgccggagcgctgctcgccgccgctgggctcctgcgcccgggggaactccgacgccgagccctacgtcgccacgcacaacgtcgtcctcgcccacgccaccgccgtcgagatctacaagaggaagtaccagagcaagcagaaaggcatgatcggcattgtgatgtccgccctctggttggtgccgctgacggacacgccagtggaccggctggcgaccgaacgggcactggccttcgacgctccatggtttcttgatccgataatctacggagactaccctccggagatgcgacagctgctgggctccaagctgccgaccttctcgccggaggagaggaggaagctgggttacaagctggacttcatcgggatcaaccactacacgacgctgtacgccaaggactgcatgttctcgtcaggctgcccgtcgtcggggcaggagatccatcatgcgctggcggccttcaccggagaaagaaatggaattccaatcggacccccgacagcgatgccaaagttctactttgttcctgatgggatagagaaaatggtcacctacatcatgaagagatacaacaatcttcccatgttcattaccgaaaatggttatgcacaaggtggagatagttataccaatgtcgaagattggcttgacgaccagggcaggatacagtacctcgatggttacctcacaaaacttgccaaagtcatcagggacggcgccgatgttcgtggctacttcgtctggtctctcattgacaattttgagtggttatacgggtacaccctccgctttgggcttcactacgttgactaccaaacacaggaaagaaagcccaagtcatccgcgctctggtacaaacggtttctccaaagttttgttgaagctcagtag

SEQ ID NO: 18339 - protein, 516 aa, Sorghum bicolor
  misc_feature: Useful for making plants with altered carbohydrate content
  misc_feature: Functional homolog of the protein sequence given in SEQ ID NO 14617
  misc_feature: Useful for making plants with altered cell wall content and/or composition
  misc_feature: Functional homolog of the protein sequence given in SEQ ID NO 14621
  misc_feature: Ceres ANNOT ID no. 8701907
  misc_feature (38)..(508): SWISSPROT Homolog: EC 3.2.1.21 Beta-glucosidase
  misc_feature (38)..(514): Pfam ID: Glyco_hydro_1 Pfam Description: Glycosyl hydrolase family 1
MAAAGSWPRASARRLLLAGAYYSLLWLLDLPWATAAVRRSDFPASFLFGTATSSYQIEGAYLEGNKSLSNWDVFTHAPGRIKDRSTGDVADDHYHRYEEDIELMHSLGTNAYRFSISWARVLPKGRFGKVNPAGIAFYNKLIDSLLLKGIEPFVTLTHYDTPQELEDRYGAWLSAEARRDFGHLADVCFAAFGDRVKYWSTFNEPNVVVTRGYMVGTYPPERCSPPLGSCARGNSDAEPYVATHNVVLAHATAVEIYKRKYQSKQKGMIGIVMSALWLVPLTDTPVDRLATERALAFDAPWFLDPIIYGDYPPEMRQLLGSKLPTFSPEERRKLGYKLDFIGINHYTTLYAKDCMFSSGCPSSGQEIHHALAAFTGERNGIPIGPPTAMPKFYFVPDGIEKMVTYIMKRYNNLPMFITENGYAQGGDSYTNVEDWLDDQGRIQYLDGYLTKLAKVIRDGADVRGYFVWSLIDNFEWLYGYTLRFGLHYVDYQTQERKPKSSALWYKRFLQSFVEAQ

SEQ ID NO: 18340 - DNA, 1917 bp, Sorghum bicolor
  misc_feature: Ceres ANNOT ID no. 8701890
  misc_feature: Encodes the peptide sequence at SEQ ID NO 18341
atggccgcacgcaccgacaccacgccgaccatgggcgcgtcctcctcgagcggcaacctgtccccgaggcgcaagagcagcgggagcaggagaccatcgcctccgccgccctctgcctcccgctcctccgcgccgccttctcccgctccgccgccgccgccaacgccaacgcgcagccggatgctctcgcgcgtcctgttcgtcagggggttcaaccactgctgcgcgcgcgtgccagcctcctgctcgctcgcgctgctcctccgtgtgtacgccgccgcctgcgccggcgcgggagcaccgtgcggcgtccagctccagtcggacgagggcggtggcgaggacgggaaggtcgttggggagctcacgcgggaggagatggtggtgttcctctggatgtgttgggtcatggcgtggagcacttcggcctcgagggtggccggtgacggaggggaaaagtcggagcccgtcgcggtcaatggcattggggacaatttttttttttgttgtcgagaccgtacaggggcatttaagtctattgtcagtattgactattttaaccaaaaatcaggaaagattgaggatggaagcaatggcgacgtggccactgaccattatcatcgatacaaggaggacatagaaataatgcattcgcttggcctcgactgctacagattctcattgtcctggtcgagaatacttccaaagggtcgcttcggaggtgttaatccggcaggcgtcaaattctacaatagcctcatcaacggcctgctaggaaaagggatacaaccatttgtgacgatcaaccactatgacataccccaggaactccaagaaagatacggctcctggttgagcccagagattcaggaggacttcacctactttgctgagctttgcttcaagatgtttggtgaccgagtaaagcactgggctacattcaatgaggcaaattttctgacaaagctcaaatactccatggggaagtttccacccagccactgttccgagccgtatgggaaatgcaattctggcaattcatcgactgagccctacattgcagcgcataacatgatattagctcatgcaatggcagtcaacatctacagaaaaaattacaaggtcaagcaaggtggctctattggaatttcactatatatgagatggtatgaaccactgaggaatatcacagaggaccacttggcagtaagccgagctctgtctttccaagctccatggttcctggatcccttgttctttggtgactatcctcaccaaatgcgccaaatcttaggtccaaacttgccgaaattcactaaaggagagaagcaactactgaaaaaccaaattgacttcattggcataaatcactacgaaacattatacatcaaggattgcatacattctctatgtgatttggacacctacgctggtgatgctttagttactgaatcagcagaacgaaatgggatactcattggaaaaccgacaccggttgcaaacacctgtgtggttccaagctctatggagaagctggtcatgtatttaaagcagagatataaaagcatacctttgtacatcacagagaatggttatgcgcaaataggcaatagcagcaccacaacagaagaattaattaatgatactgaaagatcaagttacattcatgactacctcacttacttgagcttagctataaggaaaggagcagatgtgagaggttatttcgtgtggtctttgatggataacttcgaatggctctctggttacaccacaaagtacggtctttattatgtggactttaagtcactaaagcgaacaccaaaactgtctgctaaatggtacagcaagtttatcaagggcaatgaacatatagagatggcctctgacgaatcacctaagcatatggtttcctag

SEQ ID NO: 18341 - protein, 638 aa, Sorghum bicolor
  misc_feature: Useful for making plants with altered cell wall content and/or composition
  misc_feature: Functional homolog of the protein sequence given in SEQ ID NO 14621
  misc_feature: Ceres ANNOT ID no. 8701890
  misc_feature (184)..(618): SWISSPROT Homolog: EC 3.2.1.21 Beta-glucosidase
  misc_feature (175)..(624): Pfam ID: Glyco_hydro_1 Pfam Description: Glycosyl hydrolase family 1
MAARTDTTPTMGASSSSGNLSPRRKSSGSRRPSPPPPSASRSSAPPSPAPPPPPTPTRSRMLSRVLFVRGFNHCCARVPASCSLALLLRVYAAACAGAGAPCGVQLQSDEGGGEDGKVVGELTREEMVVFLWMCWVMAWSTSASRVAGDGGEKSEPVAVNGIGDNFFFCCRDRTGAFKSIVSIDYFNQKSGKIEDGSNGDVATDHYHRYKEDIEIMHSLGLDCYRFSLSWSRILPKGRFGGVNPAGVKFYNSLINGLLGKGIQPFVTINHYDIPQELQERYGSWLSPEIQEDFTYFAELCFKMFGDRVKHWATFNEANFLTKLKYSMGKFPPSHCSEPYGKCNSGNSSTEPYIAAHNMILAHAMAVNIYRKNYKVKQGGSIGISLYMRWYEPLRNITEDHLAVSRALSFQAPWFLDPLFFGDYPHQMRQILGPNLPKFTKGEKQLLKNQIDFIGINHYETLYIKDCIHSLCDLDTYAGDALVTESAERNGILIGKPTPVANTCVVPSSMEKLVMYLKQRYKSIPLYITENGYAQIGNSSTTTEELINDTERSSYIHDYLTYLSLAIRKGADVRGYFVWSLMDNFEWLSGYTTKYGLYYVDFKSLKRTPKLSAKWYSKFIKGNEHIEMASDESPKHMVS

SEQ ID NO: 18342 - DNA, 1458 bp, Sorghum bicolor
  misc_feature: Ceres ANNOT ID no. 8701906
  misc_feature: Encodes the peptide sequence at SEQ ID NO 18343
atggcgggcagggccagggcacggcggctcatgctcgccggggctttattgctcctcctggggctgctggatctcccatgggccacggcggcagtccgccggagcgacttcccggcgtcgttcctcttcggcaccgccacctcctcctaccagatcgaaggtgcgtacctcgagggcaacaaaagcttaagcaactgggatgtcttcactcacataccaggaagaatcgaagatggaagcaccggggataccgcggatgatcactatcatcgtttcgaggatgatgttgagctcatgcactctctcggaacgaacgcctacagattctcgatatcatgggccagaattcttccaagaatagagccattcgtgacgctggcccactacgacatcccacaagagctggtggacaggtacggtgcgtggctcagcaccgaggtccagcgcgacttcggctacctggcggacgtgtgcttcgcggcgttcggcgaccgcgtcaagcactgggccaccttcaacgagcccaacgtcgccatgaccaagggctacatgctcggcacctacccgccgggccgctgctcgccgccgttcggctcctgcgcccagggaaactccgacgccgagccctacgtcgccacgcacaacgtcgtcctgtcccacgccaccgccgttgagatttacaagaggaagtaccagaggaagcagaagggcatgattggcattgtgatggccgccttctggttcgttccactgacggacacacctgtggaccggatggcgactgaacgggcattggccttcagcgttccatggtatcttgatccgatagtctacggcgactacccaccggagatgcgacagctcctgggctccaagctgccgaccttctcgccggtggagaagaggaagctgggttacaagctggacttcatcgggatcaaccactacacgacgctgtacgtgaaggactgcatgttcacgtcaggttgcccatcgggacaggatatccaatacgcgttggcggcctacaccggagaaagaaatggaattcccatcggacctccaacagcgatgccactgttcttcgatgttcctgacgggatagagaagatggtcacctacatcatgaagagatacaacaatctacccatgttcataaccgaaaatggttatgcacaaggtggagttggttacaaccaagtcgaagattggcttgacgaccagagtaggatacagtacctcgatggttacctcacaaaacttgccaaagttatcagggacggcgccgacgttcgaggttacttcatctggtctctcattgacaattttgagtggacatacggatacaccctccgctttgggcttcactatgttgactaccaaacacaggaaagaaagcccaagtcatccgcgctctggtacaaacggttcctccaaagtttacatgaagctcaatag

SEQ ID NO: 18343 - protein, 485 aa, Sorghum bicolor
  misc_feature: Useful for making plants with altered carbohydrate content
  misc_feature: Functional homolog of the protein sequence given in SEQ ID NO 14617
  misc_feature: Useful for making plants with altered cell wall content and/or composition
  misc_feature: Functional homolog of the protein sequence given in SEQ ID NO 14620
  misc_feature: Ceres ANNOT ID no. 8701906
  misc_feature (120)..(477): SWISSPROT Homolog: EC 3.2.1.21 Beta-glucosidase
  misc_feature (33)..(483): Pfam ID: Glyco_hydro_1 Pfam Description: Glycosyl hydrolase family 1
MAGRARARRLMLAGALLLLLGLLDLPWATAAVRRSDFPASFLFGTATSSYQIEGAYLEGNKSLSNWDVFTHIPGRIEDGSTGDTADDHYHRFEDDVELMHSLGTNAYRFSISWARILPRIEPFVTLAHYDIPQELVDRYGAWLSTEVQRDFGYLADVCFAAFGDRVKHWATFNEPNVAMTKGYMLGTYPPGRCSPPFGSCAQGNSDAEPYVATHNVVLSHATAVEIYKRKYQRKQKGMIGIVMAAFWFVPLTDTPVDRMATERALAFSVPWYLDPIVYGDYPPEMRQLLGSKLPTFSPVEKRKLGYKLDFIGINHYTTLYVKDCMFTSGCPSGQDIQYALAAYTGERNGIPIGPPTAMPLFFDVPDGIEKMVTYIMKRYNNLPMFITENGYAQGGVGYNQVEDWLDDQSRIQYLDGYLTKLAKVIRDGADVRGYFIWSLIDNFEWTYGYTLRFGLHYVDYQTQERKPKSSALWYKRFLQSLHEAQ

SEQ ID NO: 18344 - DNA, 1398 bp, Sorghum bicolor
  misc_feature: Ceres ANNOT ID no. 8701889
  misc_feature: Encodes the peptide sequence at SEQ ID NO 18345
atggcgcgtctcttcttcttcgtcctcctctatcccctcctctgcccctccatcaccgggctcaggcgcagcgacttcccgccgtccttcctcttcggcgccggcacgtcgtcttaccagattgaaggcgcctaccgagaagacaacaagggtctgagcaattgggatgtcttcacccatattcaagagggtcgcttcggagatgttaatccggcaggcgttaaattctacaatagtctcatcaacggcatgctacaaaaagggatagaaccatttgtgacgatcaatcactatgacatacccgaggaactccaacaaagatacggttcctggttgagcccagagattcaggaggacttcacctactttgctgagatatgcttcaagatgtttggtgaccgagtaaagcattgggctacattcaatgagccaaaccttatggcaaagctcgcgtacttcaacggcaaatttccaccaagccactgttccaagccatttgggaaatgcaattctgggaattcatcaactgagccctacattgcagcgcataacatgatactagctcatgcaaagacggtcaatatctacaaaaagaattacaagaccaagcaaggtggctctgttggaattacagtatatatgagatggtatgaaccactgaggaatatcacagacgaccacttggcagtaagccgagctcagtctttcgaagctccatggttcctggatcccttgttctttggtgactatcctcaccaaatgcgccaaatcttaggtccaaacttgccggaattcacagaaggagagaagcaactaatgaaaaaccaaattgacttcatcggagtaaatcactacaaaacattatacgtcaaggattgcgtatattctctatgtgacttggacacctatgctggtgatgctttagtttctgaatcagcagaacgaaatgggatacccattggaaagccgacaccggttgcaaacaactatgtggttccaagctctatggagaagctggtcatgtatttaacgcagagatataaaagcatacctttgtacatcacagagaatggttatgcccaaataggcaatagcagtaccacaacagaagaattaattaatgatactgaaagatcaagttacattcgtgactacctcacttacttgagctttgcaataaggaaaggagcagatgtgagaggttatttcgtgtggtctttgatggataacttcgaatggctctctggttacaccataaagtacggtctttatcatgtggatttcaagtcactaaagcgaacaccaaaattgtctgctaaatggtacagcaattttatcaagggctatgaacagatagagatggcctctgaagaatcacctaagcatatggtttcctag

SEQ ID NO: 18345 - protein, 465 aa, Sorghum bicolor
  misc_feature: Useful for making plants with altered carbohydrate content
  misc_feature: Functional homolog of the protein sequence given in SEQ ID NO 14617
  misc_feature: Useful for making plants with altered cell wall content and/or composition
  misc_feature: Functional homolog of the protein sequence given in SEQ ID NO 14621
  misc_feature: Ceres ANNOT ID no. 8701889
  misc_feature: Up-regulated in shoot tissues in response to methyl jasmonate treatment
  misc_feature: Up-regulated in root tissues in response to methyl jasmonate treatment
  misc_feature (67)..(445): SWISSPROT Homolog: EC 3.2.1.21 Beta-glucosidase
  misc_feature (22)..(451): Pfam ID: Glyco_hydro_1 Pfam Description: Glycosyl hydrolase family 1
MARLFFFVLLYPLLCPSITGLRRSDFPPSFLFGAGTSSYQIEGAYREDNKGLSNWDVFTHIQEGRFGDVNPAGVKFYNSLINGMLQKGIEPFVTINHYDIPEELQQRYGSWLSPEIQEDFTYFAEICFKMFGDRVKHWATFNEPNLMAKLAYFNGKFPPSHCSKPFGKCNSGNSSTEPYIAAHNMILAHAKTVNIYKKNYKTKQGGSVGITVYMRWYEPLRNITDDHLAVSRAQSFEAPWFLDPLFFGDYPHQMRQILGPNLPEFTEGEKQLMKNQIDFIGVNHYKTLYVKDCVYSLCDLDTYAGDALVSESAERNGIPIGKPTPVANNYVVPSSMEKLVMYLTQRYKSIPLYITENGYAQIGNSSTTTEELINDTERSSYIRDYLTYLSFAIRKGADVRGYFVWSLMDNFEWLSGYTIKYGLYHVDFKSLKRTPKLSAKWYSNFIKGYEQIEMASEESPKHMVS

SEQ ID NO: 18346 - DNA, 600 bp, Sorghum bicolor
  misc_feature: Ceres ANNOT ID no. 8701919
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 18347
atggacatgtcgccgaaccccgacagcccctcgtcaggagggggcaacggcatcgggccgagcagcggtggcgcgtcgccgtccgttggctccatgacggcgccgcagtcgccgagccggtacgaggcgcagaagcggcgcgactggaacacgttcgggcagtacctgcggaaccaccggccgccactgagcctggcgcagtgcagcggggctcacgtcctcgagttcctccgctacctggaccagttcggcaagactaaggtgcacggcccggcgtgccccttcttcggccacccgaacccgccggcgccgtgcccctgcccgctccgccaggcctggggcagcctcgacgccctcgtgggccgcctccgcgccgccttcgaggagaacggaggccgcccggagtccaaccccttcgccgcgcgcgccgtgcgcctctacctccgcgaggtccgcgagcaccaggcccgcgcccggggcgtcagctacgagaagaagaagcgcaagaagccgcagcagctgccgggcgacagcagcggcggccttcacggccacacgcaccagccgccgccaccaccgcccgccggcgccgcctgctga

SEQ ID NO: 18347 - protein, 199 aa, Sorghum bicolor
  misc_feature: Useful for making plants with modulated low light sensitivity
  misc_feature: Functional homolog of the protein sequence given in SEQ ID NO 14143
  misc_feature: Useful for making plants with modulated nitrogen use efficiency
  misc_feature: Functional homolog of the protein sequence given in SEQ ID NO 13437
  misc_feature: Useful for making plants with modulated flowering time
  misc_feature: Functional homolog of the protein sequence given in SEQ ID NO 13982
  misc_feature: Useful for making plants with modulated biomass
  misc_feature: Functional homolog of the protein sequence given in SEQ ID NO 13338
  misc_feature: Useful for biocontainment applications
  misc_feature: Functional homolog of the protein sequence given in SEQ ID NO 13983
  misc_feature: Ceres ANNOT ID no. 8701919
MDMSPNPDSPSSGGGNGIGPSSGGASPSVGSMTAPQSPSRYEAQKRRDWNTFGQYLRNHRPPLSLAQCSGAHVLEFLRYLDQFGKTKVHGPACPFFGHPNPPAPCPCPLRQAWGSLDALVGRLRAAFEENGGRPESNPFAARAVRLYLREVREHQARARGVSYEKKKRKKPQQLPGDSSGGLHGHTHQPPPPPPAGAAC

SEQ ID NO: 18348 - DNA, 1527 bp, Sorghum bicolor
  misc_feature: Ceres ANNOT ID no. 8701904
  misc_feature: Encodes the peptide sequence at SEQ ID NO 18349
atggccacggcgagagccattgccgcagcggcggccgtgttggtggcggcgctcctcgcgccggccgcgcgcggggtcgatcgcggcgagttcccgccggggttcctcttcggcgccgcgacgtcggcgtaccagattgaaggcgcgtacctggaggacggcaagggcctctgcaactgggatgtcttcacccacacacacactggagcgatcatggacggacgcactggggacgtagctgacgaccactaccatcgctacatgggagatgtggagatcctgcaatcgctgggcgtcaacgcctacagattctccatctcatgggcgaggattctaccaagtgggatagccttctacaaccgcctgattgatgcgctcctgcagaaagggatccagccattcgtgactctgaaccatttcgacatgccgcacgagctggacgtccgatacgtgggctggctgggcgctgggatccgggacgagttcgagtactacgcggacgtctgcttcgcggcgttcggcgaccgggtgaggttctggacgacgttcaacgagcccaacctgtccaccaagttccagtacatgctgggcgtgtaccctcccagacactgctcgccgccgttcggcagctgcaacagcggcaactcgcaccgggagccgtacgtcgccgcgcacaacatcatcatgtcccacgccgctgccgtccgcaactacaaggagagctaccaggcgaagcagggcggctccatcgggatcgtgaccgccatgaaatggtacgagccgctgacgaataccacggaggacattctggcggcgcgacgcgcgcagtctttcgaaaccgagtggtttttggacccaatatttttcggtgattacccgagagcgatgcgagagatcttgcaatcaaacttgccaaccttcaccgcggaggagaagaagctgctgctacaatacaagccggatttcatcgggctgaatcattacacggcgatttacgctaaggactgcatccattccccgtgcaaccttcagacatacgaagggaacgcgtttgtcttggcgaccggggaaaaggacggggtgaagatcgggagagatacggcgctgtcaggtttctacgatgtcccagaagccatagagccggctatcatgtttgtgaacgggaggtacaaggacacgccggtgtatatcactgagaacggtttctcacaatggagtgatgccaacagggaagggctgatcaacgacgtggcaagaaagaactacctgcagggctacgtcacatgcctatccaaagcagtcaggaacggagcaaacgtgcggggctacttcgtgtggacgctcctggacaacttcgagtggacgttcggttacaccgtgaggttcggcctgtaccacgtcgactacgacacccaggagaggacgccccggatgtctgcgacgtggtaccagggcttcctcaccgcaggcaacaccagcctggtgacccacgaagacgaagcgcaggcacggagagcagacgcgtga

SEQ ID NO: 18349 - protein, 508 aa, Sorghum bicolor
  misc_feature: Useful for making plants with altered carbohydrate content
  misc_feature: Functional homolog of the protein sequence given in SEQ ID NO 14617
  misc_feature: Useful for making plants with altered cell wall content and/or composition
  misc_feature: Functional homolog of the protein sequence given in SEQ ID NO 14621
  misc_feature: Ceres ANNOT ID no. 8701904
  misc_feature (26)..(468): SWISSPROT Homolog: EC 3.2.1.21 Beta-glucosidase
  misc_feature (27)..(492): Pfam ID: Glyco_hydro_1 Pfam Description: Glycosyl hydrolase family 1
MATARAIAAAAAVLVAALLAPAARGVDRGEFPPGFLFGAATSAYQIEGAYLEDGKGLCNWDVFTHTHTGAIMDGRTGDVADDHYHRYMGDVEILQSLGVNAYRFSISWARILPSGIAFYNRLIDALLQKGIQPFVTLNHFDMPHELDVRYVGWLGAGIRDEFEYYADVCFAAFGDRVRFWTTFNEPNLSTKFQYMLGVYPPRHCSPPFGSCNSGNSHREPYVAAHNIIMSHAAAVRNYKESYQAKQGGSIGIVTAMKWYEPLTNTTEDILAARRAQSFETEWFLDPIFFGDYPRAMREILQSNLPTFTAEEKKLLLQYKPDFIGLNHYTAIYAKDCIHSPCNLQTYEGNAFVLATGEKDGVKIGRDTALSGFYDVPEAIEPAIMFVNGRYKDTPVYITENGFSQWSDANREGLINDVARKNYLQGYVTCLSKAVRNGANVRGYFVWTLLDNFEWTFGYTVRFGLYHVDYDTQERTPRMSATWYQGFLTAGNTSLVTHEDEAQARRADA

SEQ ID NO: 18350 - DNA, 1611 bp, Sorghum bicolor
  misc_feature: Ceres ANNOT ID no. 8701928
  misc_feature: Encodes the peptide sequence at SEQ ID NO 18351
atgcggtcgccggcgctcctggccgccgccctagtcgcggcggtgctcctcgctgccggtgccggggtcgcggcggccgcgacggaggaggcctacgtcacgctgctgtacggcgacgagttcgtgctcggcgtgcgcgtcctgggcaagtccctccgcgacaccggcacgcggcgcgacatggtcgtgctcgtctccgacggcgtctccgagtactcgaggaagctcctccaggcagatggttggattgtgaatcgtataacattactggctaatccgaaccaagttagaccaaagagattttggggtgtctacaccaagctaaagatatttaacatgacaaactacaaaaaagttgtttaccttgatgcagatactatagttgtgaaaagtatcgaggatcttttcaagtgtggcaagttttgtggaaacctgaagcattctgaaagaatgaattctggtgtgatggttgttgaaccctctgaaactcttttcaatgatatgatcaacaaagtgggtcaattgccttcttacactggtggggaccaaggttttctaaattcatattattctgattttgccaactcccgtgtctatgagccagactcgcctttaactcctgaaccggagacacaacgcctttctaccttgtataatgctgatgttggtctttacatgctagcaaacaagtggatggttgatgagaaggaattaagaatcatccattacacgctgggtcccctaaaaccctgggactggttcacagcgtggcttgtaaaacctgttgaaacatggcaggatattaggcaaaaacttgaagaatctcttccaggaactggtgggggaaggaaccctcatgaccagctggttgtcaaaatattgttcattctcccattttgcttgctgttatttggttattaccaatcatgttttcagacaaacaaggagttgataagtataagatcactatgtgcatttgctagaagagctcgccacaaatacaagtctgaagagtcacttccatcttattcagtggtgggttcatcgtctgtatttggtatttcaaaccaaaggttatcaaatggacatttgaagctaccttcttattttggggtaatcgcggtgctagtctgcttcatgtctgctggtttctctctcgcatttgctttcattatcattccacggcaggttatgccatggacaggtttgctactgatgcttgagtggacctttgtggcattcttcttattgtttgggagttatctccgttttgtctaccggtggggaagtattagtgcaaaccatgtgggctttagcaattccgatgcatcagagaatcatatgggtccaggccatcagcgaaatatgtctgactgcgacatggatgcaacattttactggatagggatggcaactatagctactattactgtattgttaccaactatcttgggcataactgcactgttcacaaagctaggattaatggtcgctggtggtattgtgctggcatcttttatgacatacgcagcggagcatcttgcaatctcagccttcaacaagggtcagaaagacagaaatgcgtcaagaactcgaagcttttgtttttaa

SEQ ID NO: 18351 - protein, 536 aa, Sorghum bicolor
  misc_feature: Useful for making plants with altered carbohydrate content
  misc_feature: Functional homolog of the protein sequence given in SEQ ID NO 13947
  misc_feature: Useful for making plants with altered cell wall content and/or composition
  misc_feature: Functional homolog of the protein sequence given in SEQ ID NO 13948
  misc_feature: Ceres ANNOT ID no. 8701928
  misc_feature: Up-regulated in shoot tissues in response to salicylic acid treatment
  misc_feature (28)..(253): SWISSPROT Homolog: EC 2.4.1.186 Glycogenin glucosyltransferase
  misc_feature (32)..(255): Pfam ID: Glyco_transf_8 Pfam Description: Glycosyl transferase family 8
MRSPALLAAALVAAVLLAAGAGVAAAATEEAYVTLLYGDEFVLGVRVLGKSLRDTGTRRDMVVLVSDGVSEYSRKLLQADGWIVNRITLLANPNQVRPKRFWGVYTKLKIFNMTNYKKVVYLDADTIVVKSIEDLFKCGKFCGNLKHSERMNSGVMVVEPSETLFNDMINKVGQLPSYTGGDQGFLNSYYSDFANSRVYEPDSPLTPEPETQRLSTLYNADVGLYMLANKWMVDEKELRIIHYTLGPLKPWDWFTAWLVKPVETWQDIRQKLEESLPGTGGGRNPHDQLVVKILFILPFCLLLFGYYQSCFQTNKELISIRSLCAFARRARHKYKSEESLPSYSVVGSSSVFGISNQRLSNGHLKLPSYFGVIAVLVCFMSAGFSLAFAFIIIPRQVMPWTGLLLMLEWTFVAFFLLFGSYLRFVYRWGSISANHVGFSNSDASENHMGPGHQRNMSDCDMDATFYWIGMATIATITVLLPTILGITALFTKLGLMVAGGIVLASFMTYAAEHLAISAFNKGQKDRNASRTRSFCF

SEQ ID NO: 18352 - DNA, 2067 bp, Sorghum bicolor
  misc_feature: Ceres ANNOT ID no. 8701939
  misc_feature: Up-regulated in shoot tissues in response to salicylic acid treatment
  misc_feature: Encodes the peptide sequence at SEQ ID NO 18353
atggagtgcgagaacggacacgccgccggcgccagcggcaatggtgtctgcctggccacgccgcgggcggccgaccctctcaactgggggaaggcggccgaggacctcaccgggagccacctggaagccgtgaagcggatggtggaggagtacaggaggcctctggtgaagatcgagggcgccagcctcaccgtcgctcaggtcgccgccgtggccgccgccggcgaggcccgggtggagctcgacgagtccgcgcgcggccgcgtcaaggccagcagcgactgggtcatgaacagcatgatgaacggcaccgacagctacggcgtcaccaccggcttcggcgccacctcccaccggagaaccaaggagggcggcgctctccagagggagctcatccgattccttaatgccggagcgttcgggaccggcgacgacgggcacgtgctgccggcggcggccacgcgcgccgcgatgctcgtccgcatcaacaccctgctgcagggctactccgggatccgcttcgagatcttggagacgatcgcggcgctgctcaacgccaacgtgacgccgtgccttcctctcaggggcaccatcaccgcgtcgggcgacctggtcccgctctcctacatcgcgggactcgtcaccggccggccgaactcgacggcggtggcgcccgacggcaggaaggtgggcgccgcggaggcgttcaagatcgccggcatccagcacggcttcttcgagctgcagcccaaggaagggctcgccatggtgaacggcacggccgtcggctccgggctcgcgtccatggtgctgttcgaggcgaacgtgctcgccgtcctcgccgaggtcatgtccgccgtgttctgcgaggtgatgaacggcaagcccgagtacaccgaccacctgacccacaagctgaagcaccacccggggcagatcgagtccgcggccatcatggagcacatcctggacggcagctcctacatgatgctcgcgaagaagatgggcgagctggacccgttgatgaagccgaagcaggacaggtacgcgctccgcacgtcgccgcagtggctgggaccccagatcgaggtcatccgcgccgccaccaagtcgatcgagcgcgagatcaactccgtcaacgacaacccgctcatcgacgtctcccgtggcaaggcgctccacggcggcaacttccagggcacgcccatcggcgtgtccatggacaacaccaggcttgccgtcgcggcgatcggcaagctcatgttcgcgcagttctcggagctgggcgccgagatcgccatggcgtcctactgctcggagctccagttcctggccaaccccgtgaccaaccacgtccagagcgcggagcagcacaaccaggacgtgaactccctgggcctcatctcgtccaggaagaccgccgaggccgtcgacgtgctgaagctcatgtcgtcgacgttcctgatcgcgctgtgccaggccgtggacctgcgccacctcgaggagaacctcaagagcgccgtgaagagctgcgtgacgacggtggccaagaagacgctgagcaccagcgccacgggtggcctccacaacgcgcgcttctgcgagaaggacctgctgacggcgatcgaccgcgaggcggtgttcgcgtacgcggacgacccctgcagcgccaactacccgctgatgcagaagatgcggtcggtgctggtggagcacgcgctggccaacggcgaggcggagcgcgacccggagacgtcggtgttcgccaaggtggccacgttcgaggaggagctccgcgcggcgctgccccgggaggtggacgcggcccgcgcggccgtggagaacggcacggccgcggtaccgaacaggatcgccgagtgccggtcgtacccgctgtacaggttcgtgcgcgaggagctcggcacggagtacctgaccggggagaagacgaggtcgcccggcgaggaggtgaacaaggtgttcgtggcgatgaacctgggcaagcacatcgacgccgtgctcgagtgcctcaaggagtggaacggtgagcccctgccgatctgctga

SEQ ID NO: 18353 - protein, 688 aa, Sorghum bicolor
  misc_feature: Useful for making plants with altered cell wall content and/or composition
  misc_feature: Functional homolog of the protein sequence given in SEQ ID NO 14622
  misc_feature: Useful for making plants with altered lignin content
  misc_feature: Functional homolog of the protein sequence given in SEQ ID NO 14131
  misc_feature: Ceres ANNOT ID no. 8701939
  misc_feature (1)..(428): SWISSPROT Homolog: EC 4.3.1.5 Phenylalanine ammonia-lyase
  misc_feature (55)..(525): Pfam ID: PAL Pfam Description: Phenylalanine and histidine ammonia-lyase
MECENGHAAGASGNGVCLATPRAADPLNWGKAAEDLTGSHLEAVKRMVEEYRRPLVKIEGASLTVAQVAAVAAAGEARVELDESARGRVKASSDWVMNSMMNGTDSYGVTTGFGATSHRRTKEGGALQRELIRFLNAGAFGTGDDGHVLPAAATRAAMLVRINTLLQGYSGIRFEILETIAALLNANVTPCLPLRGTITASGDLVPLSYIAGLVTGRPNSTAVAPDGRKVGAAEAFKIAGIQHGFFELQPKEGLAMVNGTAVGSGLASMVLFEANVLAVLAEVMSAVFCEVMNGKPEYTDHLTHKLKHHPGQIESAAIMEHILDGSSYMMLAKKMGELDPLMKPKQDRYALRTSPQWLGPQIEVIRAATKSIEREINSVNDNPLIDVSRGKALHGGNFQGTPIGVSMDNTRLAVAAIGKLMFAQFSELGAEIAMASYCSELQFLANPVTNHVQSAEQHNQDVNSLGLISSRKTAEAVDVLKLMSSTFLIALCQAVDLRHLEENLKSAVKSCVTTVAKKTLSTSATGGLHNARFCEKDLLTAIDREAVFAYADDPCSANYPLMQKMRSVLVEHALANGEAERDPETSVFAKVATFEEELRAALPREVDAARAAVENGTAAVPNRIAECRSYPLYRFVREELGTEYLTGEKTRSPGEEVNKVFVAMNLGKHIDAVLECLKEWNGEPLPIC

SEQ ID NO: 18354 - DNA, 2112 bp, Sorghum bicolor
  misc_feature: Ceres ANNOT ID no. 8701937
  misc_feature: Encodes the peptide sequence at SEQ ID NO 18355
atggcgagcaacacggccatcctcgagagcgacccgctcagctggggcaaggcggccgcggagctgacggggagccacctcgacgaggtgaagcgcatggtggcgcagttccgcgaccccgtcgtcaagatcgagggctccacgctccgcgtcggccaggtggccgccgtggccgcggccaaggacgcgtccggcgtggccgtcgagctggacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaggcatctcaatgccggaatcttcggcaatggctccgacggccacacgctcccgtccgaggtttcgcgcgcggccatgctcgtccgcatcaacaccctcctccagggctactcgggcatccgcttcgagatcctcgaggccatcaccaagctcctcaacaccggcgtcagcccgtgcctgccgctgcggggcaccatcacggcgtcgggcgacctcgtcccgctgtcctacatcgccggcctcatcacgggccgccccaacgcgcaggccgtcaccgtggacgggaggaaggtggacgccgccgaggcgttcaaggtggccggcatccagggcggcttcttcaagctcaaccccaaggagggcctggccatcgtcaacggcacgtccgtggggtcggcgctcgccgccatggtgtgcttcgacgccaacgtgctcgccgtcctgtcctcggtcctgtccgccgtcttctgcgaggtgatgaacggcaagcctgagtacaccgaccacctcacccacaagctgaagcaccacccggggtccatcgagtccgccgccatcatggagcacatcctggacggcagctccttcatgaagcacgccaaggaggtgaacgccatggacccgctgctgaagccgaagcaggacaggtacgcgctccgcacgtcgccgcagtggctgggcccccagatcgaggtcatccgcgccgccaccaagtccatcgagcgcgaggtcaactcggtgaacgacaacccggtcatcgacgtccaccgcggaaaggcgctgcacggcggcaacttccagggcaccccgatcggtgtctccatggacaacgcccgcctcgccatcgccaacatcggcaagctcatgtttgcccagttctcggagctggtgaacgagttctacaacaacgggctgacctccaacctggccggcagccgcaacccgagcctggactacgggttcaagggcaccgagatcgccatggcgtcctactgctcggagctccagtacctggcgaaccccatcaccaaccacgtccagagcgcggagcagcacaaccaggacgtcaactccctgggcctcgtctccgccaggaagaccgccgaggccgtggacatcctcaagctcatgtcgtccacgtacatggtggcgctgtgccaggccgtcgacctgcgccacctcgaggagaacctcaagagcgccgtcaagaactgcgtgatggcggcggccaggaaagtgctcaccactagcctcgacggcgacctccacagcgcgcgcttcagcgagaaggccctgctcaccgccatcgaccgcgaggccgtgtacgggtactacgacgacccctgcagcgccaactcgcccctgatgaagaagatccgcgccgtgctggtggaccacgccctcgccagcggcgaggccgagaaggacgccagcgcgtccgtcttctccaagatcaacaggttcgaggaggcgctaagggaggcgctgcccagggagatggaggccgcccgcgtggcgttcgagacgggcacggcgccgatcggcaacaggatcaaggacagccggtcgtacccgctgtaccgcttcatccgccaggacctcggcgccgtgtacctgaccggcgagaagctcaagtcccccggcgaggagtgcaacaaggtgttcctggcgctcagcgagggcaagctcatcgaccccatgctcgagtgcctcaaggagtgggacggcaagcccctgcccatctgctaa

SEQ ID NO: 18355 - protein, 703 aa, Sorghum bicolor
  misc_feature: Useful for making plants with altered cell wall content and/or composition
  misc_feature: Useful for making plants with altered lignin content
  misc_feature: Functional homolog of the protein sequence given in SEQ ID NO 14131
  misc_feature: Ceres ANNOT ID no. 8701937
  misc_feature: Down-regulated in shoot tissues in response to aminocyclopropane carboxylic treatment
  misc_feature (1)..(702): SWISSPROT Homolog: EC 4.3.1.5 Phenylalanine ammonia-lyase
  misc_feature (41)..(540): Pfam ID: PAL Pfam Description: Phenylalanine and histidine ammonia-lyase
MASNTAILESDPLSWGKAAAELTGSHLDEVKRMVAQFRDPVVKIEGSTLRVGQVAAVAAAKDASGVAVELDEEARPRVKASSEWILDCIAHGGDIYGVTTGFGGTSHRRTKDGPALQVELLRHLNAGIFGNGSDGHTLPSEVSRAAMLVRINTLLQGYSGIRFEILEAITKLLNTGVSPCLPLRGTITASGDLVPLSYIAGLITGRPNAQAVTVDGRKVDAAEAFKVAGIQGGFFKLNPKEGLAIVNGTSVGSALAAMVCFDANVLAVLSSVLSAVFCEVMNGKPEYTDHLTHKLKHHPGSIESAAIMEHILDGSSFMKHAKEVNAMDPLLKPKQDRYALRTSPQWLGPQIEVIRAATKSIEREVNSVNDNPVIDVHRGKALHGGNFQGTPIGVSMDNARLAIANIGKLMFAQFSELVNEFYNNGLTSNLAGSRNPSLDYGFKGTEIAMASYCSELQYLANPITNHVQSAEQHNQDVNSLGLVSARKTAEAVDILKLMSSTYMVALCQAVDLRHLEENLKSAVKNCVMAAARKVLTTSLDGDLHSARFSEKALLTAIDREAVYGYYDDPCSANSPLMKKIRAVLVDHALASGEAEKDASASVFSKINRFEEALREALPREMEAARVAFETGTAPIGNRIKDSRSYPLYRFIRQDLGAVYLTGEKLKSPGEECNKVFLALSEGKLIDPMLECLKEWDGKPLPIC

SEQ ID NO: 18356 - DNA, 879 bp, Sorghum bicolor
  misc_feature: Ceres ANNOT ID no. 8701953
  misc_feature: Down-regulated in shoot tissues in response to aminocyclopropane carboxylic treatment
  misc_feature: Encodes the peptide sequence at SEQ ID NO 18357
atggccaaggacatcgaggcggcggcggcggcgcacgggggcgggggggagtacacggcgaaggactactcggacccgccgccggcgccgctggtggacgcggaggagctgaccaagtggtcgctgtaccgcgcggtgatcgccgagttcgtggcgacgctgctgttcctctacatcacggtggcgacggtgatcgggtacaagcaccagacggacgcgtcgtcgtcgggcccggacgcggcgtgcggcggcgtggggatcctcggcatcgcctgggccttcggcggcatgatcttcatcctcgtctactgcaccgcgggggtgtcgggcgggcacatcaacccggccgtcaccttcggcctcttcctggcgcgcaaggtctccctggtgcgcgcgctgctctacatcgtcgcgcagtgcctgggcgccatctgcggcgtggggctcgtcaagggattccagagcgccttctacgtgcgctacggcggcggcgccaacgggctcagcgacggctactccaagggcaccggactcgccgccgagatcatcggcaccttcgtgctcgtctacactgtcttctccgccaccgaccccaagcgcaacgcccgtgactcccacgtccccgtgcttgctcctctcccaatcgggttcgcggtgttcatggtccacctagccaccatcccgatcaccggcaccggcatcaacccggccaggagcttgggcgctgctgtcatctacaacaacgacaagacctgggatgaccactggatcttctgggtgggtcccttcatcggcgccgccattgccgcggcgtatcaccagtacgtgctgagggccagcgccgccaagctgggatcgtctgcctccttcagccgctag

SEQ ID NO: 18357 - protein, 292 aa, Sorghum bicolor
  misc_feature: Useful for making plants with modulated drought sensitivity
  misc_feature: Functional homolog of the protein sequence given in SEQ ID NO 14287
  misc_feature: Useful for making plants with modulated cold sensitivity
  misc_feature: Functional homolog of the protein sequence given in SEQ ID NO 14288
  misc_feature: Useful for making plants with modulated water use efficiency
  misc_feature: Functional homolog of the protein sequence given in SEQ ID NO 14289
  misc_feature: Ceres ANNOT ID no. 8701953
  misc_feature (36)..(273): Pfam ID: MIP Pfam Description: Major intrinsic protein
MAKDIEAAAAAHGGGGEYTAKDYSDPPPAPLVDAEELTKWSLYRAVIAEFVATLLFLYITVATVIGYKHQTDASSSGPDAACGGVGILGIAWAFGGMIFILVYCTAGVSGGHINPAVTFGLFLARKVSLVRALLYIVAQCLGAICGVGLVKGFQSAFYVRYGGGANGLSDGYSKGTGLAAEIIGTFVLVYTVFSATDPKRNARDSHVPVLAPLPIGFAVFMVHLATIPITGTGINPARSLGAAVIYNNDKTWDDHWIFWVGPFIGAAIAAAYHQYVLRASAAKLGSSASFSR

SEQ ID NO: 18358 - DNA, 120 bp, Sorghum bicolor
  misc_feature: Ceres ANNOT ID no. 8701974
  misc_feature: Encodes the peptide sequence at SEQ ID NO 18359
atggctagggactgccccagcggcagcggcggtggaggagggaggtttggcgttgacggcaattgctcctgctacaactgcggcgaggttggccacattgcctgtgactgccccacatga

SEQ ID NO: 18359 - protein, 39 aa, Sorghum bicolor
  misc_feature: The sequence is a functional homolog of SEQ ID NO 1126 in the 11/479,226 US patent application
  misc_feature: The sequence is a functional homolog of SEQ ID NO 2410 in the 10/374,780 US patent application
  misc_feature: The sequence is a functional homolog of SEQ ID NO 492 in the 10/412,699 US patent application
  misc_feature: The sequence is a functional homolog of SEQ ID NO 552 in the 10/225,066 US patent application
  misc_feature: The sequence is a functional homolog of SEQ ID NO 1041 in the 10/374,780 US patent application
  misc_feature: The sequence is a functional homolog of SEQ ID NO 851 in the 10/666,642 US patent application
  misc_feature: Ceres ANNOT ID no. 8701974
  misc_feature (22)..(39): Pfam ID: zf-CCHC Pfam Description: Zinc knuckle
MARDCPSGSGGGGGRFGVDGNCSCYNCGEVGHIACDCPT

SEQ ID NO: 18360 - DNA, 627 bp, Sorghum bicolor
  misc_feature: Ceres ANNOT ID no. 8702025
  misc_feature: Encodes the peptide sequence at SEQ ID NO 18361
atgggttcctcgcgcgccctcgctctcttcctcctctgcgctctgctgcccgcgccccccatctcagtctcagccgcattgctgttcggcggcggcaagtcggccaaggcggcgggagccgacatggagtggcggccggcgaccgcgacgtggtacggcgaggccgagggcgacggcagcgacggcggcgcgtgcgggtacgggacgctggtggacgtggtgccgatgaaggcgcgggtcgggtcggtgagccccgtgctgttcaaggacggcgagggctgcggcgcctgctacaaggtcaagtgcctggaccgcggcatctgctcccgccgggccgtcacggtgatcgtcacggacgagtgccccggcgggctctgcgccttcggccgcacccacttcgacctcagcggcgccgcctacagcaggatggcagtcgcgggcgccggcggccgcctgcgtgaccggggccagctgaacgtcgtgtaccggaggacggcctgcaagtacggcgggaagaacatagcgttccgtgtgaacgagggctcgactaacttctggctctcgctcctcgtcgagttcgaggacggcgaaggcgacatcggatccatgcagatgaagcaggagtaa

SEQ ID NO: 18361 - protein, 208 aa, Sorghum bicolor
  misc_feature: Useful for making plants with altered carbohydrate content
  misc_feature: Functional homolog of the protein sequence given in SEQ ID NO 14553
  misc_feature: Useful for making plants with altered cell wall content and/or composition
  misc_feature: Functional homolog of the protein sequence given in SEQ ID NO 14554
  misc_feature: Ceres ANNOT ID no. 8702025
  misc_feature (80)..(162): Pfam ID: DPBB_1 Pfam Description: Rare lipoprotein A (RlpA)-like double-psi beta-barrel
MGSSRALALFLLCALLPAPPISVSAALLFGGGKSAKAAGADMEWRPATATWYGEAEGDGSDGGACGYGTLVDVVPMKARVGSVSPVLFKDGEGCGACYKVKCLDRGICSRRAVTVIVTDECPGGLCAFGRTHFDLSGAAYSRMAVAGAGGRLRDRGQLNVVYRRTACKYGGKNIAFRVNEGSTNFWLSLLVEFEDGEGDIGSMQMKQE

SEQ ID NO: 18362 - DNA, 1029 bp, Sorghum bicolor
  misc_feature: Ceres ANNOT ID no. 8702037
  misc_feature: Encodes the peptide sequence at SEQ ID NO 18363
atgcgcgtcctcgccgtggtcctcctcgccgcagcgtgcgcggcggcggccggaggcggcggggagcttccggagttccgcgaggctccggcgttccgcaacggcgcggcctgcgcgggcgcgccgacgatccacatcgcgatgacgctggacgccacctacctgcggggctccctcgcgggcgtcctctccgtgctccgccacgccgcctgcccggagtccatcgccttccacttcgtcgcctcctcggcctccccggcgcgccgcctcgactcgctccgccgcgcgctggcggccgccttccccacgctcccggccaccgtgcaccgcttcgacgcacgcctcgtccggggcaagatctcatcctccgtccggcgcgcgctcgaccagcccctcaactacgcccgcatctacctcgcggacctcctgccgcgctccgtctcccgcgtcctctacctcgactccgacctcctcgtggtcgacgacgtcgcccgtctctgggccaccgacctcggccccgacgccgccctcgccgcccccgagtactgccacgccaacttcacctcctatttcaccgacacgttctggcgccaccccgagtacgccgccgtattcgccaaccggacgcgcgtcccctgctacttcaacaccggggtcatggtcatcgacctggacaggtggcgctccggcgggtacactgcgaagctggagtactggatggaggtgcagaagcaggaggccaggatttacgagctgggctccctcccgccgttcctcctggtgtttgccggcgaggtgaaggccgtggagcaccggtggaaccagcacgggctcggcggcgacaacgtggccgggcagtgccgggagctgcaccccggtccggtcagcttgctgcactggagcgggaaggggaagccgtggctgcggctggacgccggccggccgtgcccgctcgacgcgctctgggcaccctacgacctccttcgccaccgcggcgcccgggacgacctcctcgccgccgtcgcctga

SEQ ID NO: 18363 - protein, 342 aa, Sorghum bicolor
  misc_feature: Useful for making plants with altered cell wall content and/or composition
  misc_feature: Functional homolog of the protein sequence given in SEQ ID NO 14623
  misc_feature: Useful for making plants with altered carbohydrate content
  misc_feature: Functional homolog of the protein sequence given in SEQ ID NO 14185
  misc_feature: Ceres ANNOT ID no. 8702037
  misc_feature (45)..(311): Pfam ID: Glyco_transf_8 Pfam Description: Glycosyl transferase family 8
MRVLAVVLLAAACAAAAGGGGELPEFREAPAFRNGAACAGAPTIHIAMTLDATYLRGSLAGVLSVLRHAACPESIAFHFVASSASPARRLDSLRRALAAAFPTLPATVHRFDARLVRGKISSSVRRALDQPLNYARIYLADLLPRSVSRVLYLDSDLLVVDDVARLWATDLGPDAALAAPEYCHANFTSYFTDTFWRHPEYAAVFANRTRVPCYFNTGVMVIDLDRWRSGGYTAKLEYWMEVQKQEARIYELGSLPPFLLVFAGEVKAVEHRWNQHGLGGDNVAGQCRELHPGPVSLLHWSGKGKPWLRLDAGRPCPLDALWAPYDLLRHRGARDDLLAAVA

SEQ ID NO: 18364 - DNA, 408 bp, Sorghum bicolor
  misc_feature: Ceres ANNOT ID no. 8702038
  misc_feature: Encodes the peptide sequence at SEQ ID NO 18365
atggcgcagcaggggacgctggaggtgctgctcgtcggagccaagggcctcgagaacaccgattacctgagtaacatggatccctacgcgcttctgcaatgtcgctcccatgagcagaagagcagcgttgcatctggcaaaggatgtgagccagaatggaacgagacctttgtgttcaccgtctccgatggcgcaacagagctattcatcaagctcctcgacagtgacggtggcactgatgacgattttgttggtgaagcaacgattcccctggaagcagtttatacagaaggaagcatccctccaactgtttacaatgttgtgaaagacgaagaataccgcggagaaatcaaagttggtctcacattcactccagagcctgctgaaactgaaatgtcccttctatga

SEQ ID NO: 18365 - protein, 135 aa, Sorghum bicolor
  misc_feature: Useful for making plants with modulated nitrogen use efficiency
  misc_feature: Functional homolog of the protein sequence given in SEQ ID NO 14624
  misc_feature: Ceres ANNOT ID no. 8702038
  misc_feature (7)..(88): Pfam ID: C2 Pfam Description: C2 domain
MAQQGTLEVLLVGAKGLENTDYLSNMDPYALLQCRSHEQKSSVASGKGCEPEWNETFVFTVSDGATELFIKLLDSDGGTDDDFVGEATIPLEAVYTEGSIPPTVYNVVKDEEYRGEIKVGLTFTPEPAETEMSLL

SEQ ID NO: 18366 - DNA, 2031 bp, Sorghum bicolor
  misc_feature: Ceres ANNOT ID no. 8702068
  misc_feature: Encodes the peptide sequence at SEQ ID NO 18367
atgatcccggccgttgctgatccggcgacgttggacgacgtgggcgcgagcacaccgttgctcccggagacggaccctcgggggcgtgccggcgcagggcagaagcggccgccgccgccggcggcgacgacgaccgttctccccgccgtcgtctccgccgtgctcctgctcgtcctcgttgcggtcaccgtcctcgcgtcgcagcacgtcgacgacgggcaggccgggggcgtcgccgtcgtcgttcccgcgggcggcagcggcggcggcggccatgccgtcgtgcaggaggtggccgcctcccgtggcgtggccgagggcgtgtcggagaaatccacggccccgctcctcggcgccggcgccggcgcggtcgaggacttttcctggaccaacgcgatgctggcgtggcagcgcacggcgttccatttccagccccccaagaactggatgaacggtcctctgtaccacaagggctggtaccacctgttctaccagtggaacccggactcggcggtgtggggcaacatcacctggggccacgccgtgtcgcgcgacctcctccactggctgcacctaccgctggccatggtgccggatcacccgtacgacgccaacggcgtctggtcgggatccgccacgcggctcccggacggccggatcgtcatgctctacacgggctccacggcggagtcggtgcaggtgcagaacctcgcggagcccgccgacgcgtcggacccgctgctgcgggagtgggtcaagtcggacgccaacccggtgctggtgccgccgccgggcatcggggcgacggacttccgcgacccgacgacggcgtggcgggcggccaacgacgacacgaattcgaagcaggcgtggcgggtcgccatcgggtccaaggaccgggaccacgccggcctggcgctggtgtaccggacggaggacttcgtgcggtacgacccggtgccggcgctgatgcacgtcgtccccggcaccggcatgtgggagtgcgtcgacttctacccggtggccgtggcggccaacaacggggacgggctggagacgtccgtgccgccggggcccggcgtgaagcacgtggtcaaggccagcctcgacgacgacaagcacgactactacgccatcggcacctacgacccggcgacggacacgtggacgcccgacgacgcggagaacgacgtcgggatcggactccggtacgactacggcaagtactacgcgtccaagaccttctacgaccccgtgcttcgccggcgggtgctctgggggtgggtcggcgagaccgacagcgagcgcgctgacatcctcaagggctgggcatccgtgcagtcaatccccaggacggtcctcctggacacgaagacgggcagcaaccttctccagtggccggtggtggaggtggagaacctccggatgagcggcaagcgcttcgacgacgtcgcgctgcaccgcggatcggtcgtgcccctcgacgtcggcaaggcgacacagttggacatcgaggccgtgttcgaggtggacgcggcggccgtggagggcgtgacggaggccgacgtgacgttcaactgcagcaccagcgccggcgcggcggggcggggcctgctcggcccgttcggccttctcgtgctggcggacgaggacttgtccgagcagaccgccgtgtacttctacctggtcaagggcacggacggcagcctccaaacgttcttctgccaagacgagctcagggcatccaaggcgaacgatctggttaagagagtatacggaagcttggtccctgtgctagatggggagaatctttcagtcagaatactggttgaccactccatcgtggagagctttgctcaaggcggaaggacgtgcatcacgtcgcgcgtgtaccctacacgagccatctacgactccgcccgcgtgttcctcttcaacaacgccacagatgtgcacgtcaaagcaaaatccgtcaagatctggcagctcaactccgcctacatccggccgtatgaagcgagttctctatga

SEQ ID NO: 18367 - protein, 676 aa, Sorghum bicolor
  misc_feature: Useful for making plants with altered carbohydrate content
  misc_feature: Functional homolog of the protein sequence given in SEQ ID NO 13945
  misc_feature: The sequence is a functional homolog of SEQ ID NO 4 in US patent 7253335
  misc_feature: Ceres ANNOT ID no. 8702068
  misc_feature (1)..(675): SWISSPROT Homolog: EC 3.2.1.26 Beta-fructofuranosidase
  misc_feature (142)..(467): Pfam ID: Glyco_hydro_32N Pfam Description: Glycosyl hydrolases family 32 N terminal
  misc_feature (508)..(622): Pfam ID: Glyco_hydro_32C Pfam Description: Glycosyl hydrolases family 32 C terminal
MIPAVADPATLDDVGASTPLLPETDPRGRAGAGQKRPPPPAATTTVLPAVVSAVLLLVLVAVTVLASQHVDDGQAGGVAVVVPAGGSGGGGHAVVQEVAASRGVAEGVSEKSTAPLLGAGAGAVEDFSWTNAMLAWQRTAFHFQPPKNWMNGPLYHKGWYHLFYQWNPDSAVWGNITWGHAVSRDLLHWLHLPLAMVPDHPYDANGVWSGSATRLPDGRIVMLYTGSTAESVQVQNLAEPADASDPLLREWVKSDANPVLVPPPGIGATDFRDPTTAWRAANDDTNSKQAWRVAIGSKDRDHAGLALVYRTEDFVRYDPVPALMHVVPGTGMWECVDFYPVAVAANNGDGLETSVPPGPGVKHVVKASLDDDKHDYYAIGTYDPATDTWTPDDAENDVGIGLRYDYGKYYASKTFYDPVLRRRVLWGWVGETDSERADILKGWASVQSIPRTVLLDTKTGSNLLQWPVVEVENLRMSGKRFDDVALHRGSVVPLDVGKATQLDIEAVFEVDAAAVEGVTEADVTFNCSTSAGAAGRGLLGPFGLLVLADEDLSEQTAVYFYLVKGTDGSLQTFFCQDELRASKANDLVKRVYGSLVPVLDGENLSVRILVDHSIVESFAQGGRTCITSRVYPTRAIYDSARVFLFNNATDVHVKAKSVKIWQLNSAYIRPYEASSL

SEQ ID NO: 18368 - DNA, 528 bp, Sorghum bicolor
  misc_feature: Ceres ANNOT ID no. 8702076
  misc_feature: Encodes the peptide sequence at SEQ ID NO 18369
atgctaaggaggtcccgccacggcggggtccgtctcggccggaagctgctcggcctgtggcggcgggcgctctgcggccggtgccggcgccggggaggctaccgccgcctgcagcagcagcagccgcaggagcagcccggcgactccacgcccgagcgcgccgcgaggaagctcgcgccggtgctgcggtggggccggtcgctggcgcggcgtctgagccgcctcggttggagggccggcgggcaccggatgctgggcgacggctgcggcggcgggcaggcggtgaccacgcccaaggggcaggtggccgtgtacgtcggcggcggcggggaggcgtcgccgtcgctgcggtacgtggtccccgtggtgtacttcaaccaccccatgttcggcgagctgctcagggaggccgaggaggagttcgggttccagcaccccggcgtcatcaccatcccctgccccgccgcgcggttcgagcaggccgccgccctggccgccgcggggaagaagggcttcggcaggtggtag

SEQ ID NO: 18369 - protein, 175 aa, Sorghum bicolor
  misc_feature: Useful for making plants with modulated cold sensitivity
  misc_feature: Functional homolog of the protein sequence given in SEQ ID NO 13454
  misc_feature: Ceres ANNOT ID no. 8702076
  misc_feature (58)..(166): Pfam ID: Auxin_inducible Pfam Description: Auxin responsive protein
MLRRSRHGGVRLGRKLLGLWRRALCGRCRRRGGYRRLQQQQPQEQPGDSTPERAARKLAPVLRWGRSLARRLSRLGWRAGGHRMLGDGCGGGQAVTTPKGQVAVYVGGGGEASPSLRYVVPVVYFNHPMFGELLREAEEEFGFQHPGVITIPCPAARFEQAAALAAAGKKGFGRW

SEQ ID NO: 18370 - DNA, 1023 bp, Sorghum bicolor
  misc_feature: Ceres ANNOT ID no. 8702071
  misc_feature: Encodes the peptide sequence at SEQ ID NO 18371
atggacgctttcacacatgttcctcccggctttcgtttccaccctaccgatgaggaactcgttgattactaccttaggaaaaaggtagcaatgaagaagatagatttggatgttataaaagatgtggacttgtacaaaattgagccttgggatctgcaagaaaaatgcaggattggagctgaagagcagaacgagtggtacttcttcagccacaaggacaagaagtacccaaccggcactcgcaccaacagagcgacgacggctggtttctggaaggccacagggagagacaagccgatctatgtgaagaactgcctcgtagggatgaggaagacactagttttctacaaaggccgagcgcccaacgggcagaagtcagactggatcatgcacgagtatcgcttggagaccaacgaaaatggaatcccacacgaagaaggatgggttgtctgcagggtgttcaggaagcgactcgcgactgtccaaagaatggttggggactcaccttactggttcaacgaccacgcagggttcatgccaccggagctcggctcgccgaggcaggcggcacaccaccagcagagcgccatgatgtaccataggcaacagagcagctacccttgcaaggtggagctagagtaccaccacctccttccccaggagcacttcttgcagcagctccctccgctggagagccccaagctccctgaccttattggccaagtagatgctactctccagccatgcggccttacaccggagcatggtctcgttcgctacaccgtgcaagagctccaagccgagccgctctatctgacggctaggaatgtgtctggcacagattggcgagctctcgacaagttcgtggcgtcccagctcagcaacgacaccactctgaaggagtcaactagctactccaatccgacacaggtgtttcagcagtctgaggagaaagaggaggcattagactacgtgtcaacatcagcttcttgtggaggtgacaatgatttctggaaattataa

SEQ ID NO: 18371 - protein, 340 aa, Sorghum bicolor
  misc_feature: Useful for biocontainment applications
  misc_feature: Functional homolog of the protein sequence given in SEQ ID NO 13684
  misc_feature: The sequence is a functional homolog of SEQ ID NO 2590 in the 10/374,780 US patent application
  misc_feature: The sequence is a functional homolog of SEQ ID NO 286 in the 10/225,066 US patent application
  misc_feature: Useful for making plants with modulated biomass
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: Useful for making plants with altered carbohydrate content
  misc_feature: Functional homolog of the protein sequence given in SEQ ID NO 13622
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Ceres ANNOT ID no. 8702071
  misc_feature (7)..(136): Pfam ID: NAM Pfam Description: No apical meristem (NAM) protein
MDAFTHVPPGFRFHPTDEELVDYYLRKKVAMKKIDLDVIKDVDLYKIEPWDLQEKCRIGAEEQNEWYFFSHKDKKYPTGTRTNRATTAGFWKATGRDKPIYVKNCLVGMRKTLVFYKGRAPNGQKSDWIMHEYRLETNENGIPHEEGWVVCRVFRKRLATVQRMVGDSPYWFNDHAGFMPPELGSPRQAAHHQQSAMMYHRQQSSYPCKVELEYHHLLPQEHFLQQLPPLESPKLPDLIGQVDATLQPCGLTPEHGLVRYTVQELQAEPLYLTARNVSGTDWRALDKFVASQLSNDTTLKESTSYSNPTQVFQQSEEKEEALDYVSTSASCGGDNDFWKL

SEQ ID NO: 18372 - DNA, 1062 bp, Sorghum bicolor
  misc_feature: Ceres ANNOT ID no. 8702179
  misc_feature: Encodes the peptide sequence at SEQ ID NO 18373
atggccttcaccggagacgccgacggtttcgccctcgacttcatccgcgagcacctgctcggcggcggcggcggccctgtggatagcaccgtagaccccgacgacctcaccttcccggttccgccacctcaaccagaattcgagcccaccatgccgttcttgccgccgccgctgccgccgcagcagcatgggtacatcgacatggacccgaccaacgagtacatgggcgaggcggcggtcgcgttcccggatccggagccgccagcgccaccggtggtaatagcgtttggaagccagccctcgtcccccgtcagacagcctctgaccatcgccgtgcccccgaggccgtacgcttcggcggcagcaacggcgccgcccgccgccgcggccgaggccgtggaggacttccgcaagtaccgcggcgtccggcagcggccctggggcaagtacgcggcggagatccgcgacccgaagcggcggggctcgcgcgtgtggctcggcacctacgacacgcccatcgaggccgcgcgcgcctacgaccgcgccgccttccgcatgcgcggcgccaaggccatcctcaactttcccaacgacgtcggcacccgcggcgccgacttctgggcaccgccgccgcccgctccggcgaagtcgaagaacgcagccacggcgaccaccgcgacgaacaagaggaagcggcagcagctgctggtggtggaggaccccgacgacgacgacgtcgaggtgatcgccgtggtgaaaaaagaagcgtacgaccatggccaggtggtccctgcttactcgtcgtcgacgtcccagggccaggtgtactcctccgcctctcagtcgtcgtccatgtcgacgcgcgagaccaccgcgaccgcctcgtcgacggtgacgtcgtctcctacggaagagacgggaccgggtgctgtggggatccccatgacgccgtcgagcgggaactgggagcagtactgggaggcattgctcggcaccctgccgctgctctcgccgcagtcgccccatccggcgttgggctttccccagcttaccgttacctga

SEQ ID NO: 18373 - protein, 353 aa, Sorghum bicolor
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: Useful for making plants with altered lignin content
  misc_feature: Functional homolog of the protein sequence given in SEQ ID NO 13219
  misc_feature: Ceres ANNOT ID no. 8702179
  misc_feature (137)..(189): Pfam ID: AP2 Pfam Description: AP2 domain
MAFTGDADGFALDFIREHLLGGGGGPVDSTVDPDDLTFPVPPPQPEFEPTMPFLPPPLPPQQHGYIDMDPTNEYMGEAAVAFPDPEPPAPPVVIAFGSQPSSPVRQPLTIAVPPRPYASAAATAPPAAAAEAVEDFRKYRGVRQRPWGKYAAEIRDPKRRGSRVWLGTYDTPIEAARAYDRAAFRMRGAKAILNFPNDVGTRGADFWAPPPPAPAKSKNAATATTATNKRKRQQLLVVEDPDDDDVEVIAVVKKEAYDHGQVVPAYSSSTSQGQVYSSASQSSSMSTRETTATASSTVTSSPTEETGPGAVGIPMTPSSGNWEQYWEALLGTLPLLSPQSPHPALGFPQLTVT

SEQ ID NO: 18374 - DNA, 999 bp, Sorghum bicolor
  misc_feature: Ceres ANNOT ID no. 8702177
  misc_feature: Encodes the peptide sequence at SEQ ID NO 18375
atggacttcaccggagacgccgacggcttcgccctcgacttcatccgcgacctcatgctcggcggcgacggcagcgtccccgtggacagccctgtcgtcgtagtttccgacgacgtcaccttccccgtcctgccgcctcaaccggagttccagcccgtgtcgttgttaccgcagcagcagcaacatcaaggctacatagatatagacctgacgacggccgagtgcgtgggagctgctccgaccgcggctgctgtcgttggcgaggcggcggcgttccgggcgcacgagccggcgccaccggtgatgataaagttcgggagcgagccgtcgtcgcccacggccatgaggcagccgccgctcaccatctccgtgcccccgagctcgtacgcctgggtgtcgtcggccggcatgccggccgcggccgttgaggaggacttccgcaagtaccgcggcgtccggcagcggccctggggaaagtacgcggcggagatccgcgatccgaagcggcgtggctcgcgcgtgtggctcggcacctacgacacgcccgtcgaggccgcgcgcgcctacgaccgcgccgccttccgcatgcgcggcgccaaggccatcctcaacttccccaacgaggtcggcacccgcggcgctgacctctgggccgcgccagcgacggcgagcaaacggaggcggcagcagatggagggtggtcaggacgaccccgaggtcgaggtggtcgcggtggtgaacaaggtggtgaagatcgaggcgccgccgccgccgtcgacccaggtgtcctcaacctcgccgtcgcctgtgtctacacccgagaccaccgcctcatcgacggtgacgtcagctacgacagagacgggtggaggtgctgagtggctccccgtgacaccatcgagcgggagctcggagcagtactgggaggcgttgctccgcgatctgccgccgctgtcgccgcacccagcgttggggtttccgctgctcagcgtaaattga

SEQ ID NO: 18375 - protein, 332 aa, Sorghum bicolor
  misc_feature: Useful for making plants with altered alkaloid content
  misc_feature: Functional homolog of the protein sequence given in SEQ ID NO 13268
  misc_feature: The sequence is a functional homolog of SEQ ID NO 1448 in the 10/666,642 US patent application
  misc_feature: The sequence is a functional homolog of SEQ ID NO 1789 in the 11/479,226 US patent application
  misc_feature: The sequence is a functional homolog of SEQ ID NO 1862 in the 10/412,699 US patent application
  misc_feature: The sequence is a functional homolog of SEQ ID NO 274 in the 10/374,780 US patent application
  misc_feature: The sequence is a functional homolog of SEQ ID NO 998 in the 10/225,066 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 1464 in the 10/666,642 US patent application
  misc_feature: The sequence is a functional homolog of SEQ ID NO 170 in the 10/225,066 US patent application
  misc_feature: The sequence is a functional homolog of SEQ ID NO 2 in the 10/903,236 US patent application
  misc_feature: The sequence is a functional homolog of SEQ ID NO 278 in the 10/666,642 US patent application
  misc_feature: The sequence is a functional homolog of SEQ ID NO 332 in the 10/374,780 US patent application
  misc_feature: The sequence is a functional homolog of SEQ ID NO 46 in the 10/225,068 US patent application
  misc_feature: The sequence is a functional homolog of SEQ ID NO 8 in the 10/714,887 US patent application
  misc_feature: The sequence is a functional homolog of SEQ ID NO 8 in the 11/435,388 US patent application
  misc_feature: The sequence is a functional homolog of SEQ ID NO 1462 in the 10/666,642 US patent application
  misc_feature: The sequence is a functional homolog of SEQ ID NO 2134 in the 10/374,780 US patent application
  misc_feature: The sequence is a functional homolog of SEQ ID NO 34 in the 10/714,887 US patent application
  misc_feature: The sequence is a functional homolog of SEQ ID NO 34 in the 11/435,388 US patent application
  misc_feature: The sequence is a functional homolog of SEQ ID NO 364 in the 10/225,066 US patent application
  misc_feature: The sequence is a functional homolog of SEQ ID NO 4 in the 10/903,236 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: Useful for making plants with altered lutein content
  misc_feature: Useful for making plants with modulated biomass
  misc_feature: Useful for making plants with modulated flowering time
  misc_feature: Functional homolog of the protein sequence given in SEQ ID NO 13470
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: The sequence is a functional homolog of SEQ ID NO 10 in the 10/903,236 US patent application
  misc_feature: The sequence is a functional homolog of SEQ ID NO 1735 in the 10/374,780 US patent application
  misc_feature: The sequence is a functional homolog of SEQ ID NO 2125 in the 10/666,642 US patent application
  misc_feature: The sequence is a functional homolog of SEQ ID NO 690 in the 10/666,642 US patent application
  misc_feature: The sequence is a functional homolog of SEQ ID NO 70 in the 10/714,887 US patent application
  misc_feature: The sequence is a functional homolog of SEQ ID NO 70 in the 11/435,388 US patent application
  misc_feature: The sequence is a functional homolog of SEQ ID NO 151 in the 11/479,226 US patent application
  misc_feature: The sequence is a functional homolog of SEQ ID NO 32 in the 10/412,699 US patent application
  misc_feature: Useful for making plants with altered lignin content
  misc_feature: Functional homolog of the protein sequence given in SEQ ID NO 13219
  misc_feature: The sequence is a functional homolog of SEQ ID NO 172 in the 11/375,241 US patent application
  misc_feature: The sequence is a functional homolog of SEQ ID NO 800 in the 11/435,388 US patent application
  misc_feature: Ceres ANNOT ID no. 8702177
  misc_feature (147)..(199): Pfam ID: AP2 Pfam Description: AP2 domain
MDFTGDADGFALDFIRDLMLGGDGSVPVDSPVVVVSDDVTFPVLPPQPEFQPVSLLPQQQQHQGYIDIDLTTAECVGAAPTAAAVVGEAAAFRAHEPAPPVMIKFGSEPSSPTAMRQPPLTISVPPSSYAWVSSAGMPAAAVEEDFRKYRGVRQRPWGKYAAEIRDPKRRGSRVWLGTYDTPVEAARAYDRAAFRMRGAKAILNFPNEVGTRGADLWAAPATASKRRRQQMEGGQDDPEVEVVAVVNKVVKIEAPPPPSTQVSSTSPSPVSTPETTASSTVTSATTETGGGAEWLPVTPSSGSSEQYWEALLRDLPPLSPHPALGFPLLSVN

SEQ ID NO: 18376 - DNA, 699 bp, Sorghum bicolor
  misc_feature: Ceres ANNOT ID no. 8702195
  misc_feature: Encodes the peptide sequence at SEQ ID NO 18377
atggagagggtcgaggacttagggctcagcctcagcctcagctcgtccctcgcgtctcctcgcactcaccatgtcgccaccatgctgctacgcgctccaccagagaagaggttcctggagatgccgctgctgctccccgcgaagcgaagcgagctggccacgggcgaggagggcctgcgaggcggcggcagcgacgaggaggacggcggctgcggcatcgacggctccaggaagaagctccggctgtccaaggaccagtcggccgtgctcgaggatagcttccgggagcacccaactctcaaccctcggcagaaggcagccttggcgcagcagctgggcctgcggccccgccaggtggaggtgtggttccagaacaggcgcgccaggacgaagctgaagcagacggaggtggactgcgagtacctgaagcgctgctgcgagacgctgacggaggagaaccggcggctgcacaaggaggtgcaggagctccgcgcgctcaagctcgtctcgccgcacctctacatgcacatgcccccgcccaccaccctcaccatgtgcccctcctgcgagcgcgtctcctcctccaacgcgtccaacgccaactccgccgccgctgaccgcaaggcgggcgccggcgtcgccgacggtggcgccatcgtctgccaccgcccgatcgccgtccggccgcagcagtcatga

SEQ ID NO: 18377 - protein, 232 aa, Sorghum bicolor
  misc_feature: The sequence is a functional homolog of SEQ ID NO 1674 in the 10/374,780 US patent application
  misc_feature: Ceres ANNOT ID no. 8702195
  misc_feature (133)..(177): Pfam ID: HALZ Pfam Description: Homeobox associated leucine zipper
  misc_feature (78)..(132): Pfam ID: Homeobox Pfam Description: Homeobox domain
MERVEDLGLSLSLSSSLASPRTHHVATMLLRAPPEKRFLEMPLLLPAKRSELATGEEGLRGGGSDEEDGGCGIDGSRKKLRLSKDQSAVLEDSFREHPTLNPRQKAALAQQLGLRPRQVEVWFQNRRARTKLKQTEVDCEYLKRCCETLTEENRRLHKEVQELRALKLVSPHLYMHMPPPTTLTMCPSCERVSSSNASNANSAAADRKAGAGVADGGAIVCHRPIAVRPQQS

SEQ ID NO: 18378 - DNA, 951 bp, Sorghum bicolor
  misc_feature: Ceres ANNOT ID no. 8702204
  misc_feature: Encodes the peptide sequence at SEQ ID NO 18379
atggacgctccagcccaacgagccatggcagtggacacaggcaatgcacccaccacatcttgctcttcttcgtcctctacatcctcctcctcggtcgtcaatgacgcgccgcaagaggttgttcccaagaactcctgcaaaggcacgaacaagcggaagagagcctcttcgccggactcccaggaacaggaagtagaagccaacggcagcaccaacaatgggcaccaccaaggcgaggagagcagcagctgctgctgcagcaccgacgacaccgaggcgagcgtcggcgacgacaaggccgaagaggcggcagcggccaccgccaccagaagcagccggagcgggtacaagcacccgtcgtaccgcggggtgcggcgccggagctggggcaagtgggtctccgagatccgggagccccgcaagaagtcgcgcatctggctgggcacgttcccgacggcggagatggcggcgcgcgcgcacgacgtggcggcgctggccatcaagggccgcgccgcgcacctcaacttcccggaccgcgcccacgagctgccccggccggccgcggcggcgcaggctgccgcgggggccgcggacgtgcagtgcgacgcgccgccgtccccgtcgccatcaccgtcgccgtcgtcgtcggccgagctgctgctgccgtcgtcccccgcggccgacgccgacgcgtcgccggagcaggctgctgccgcatgctgcctctgccccgaggcaacaatgacgacgacgcacggcgacggcggtggcgggcagggccagggccagggccaggagagcgcgctgttcgacctgccggacctcctcctggacctgagggacgggctgtggtggccaccggtgtggccggcggcggcaatggccgccgaggagtacgacggctgcgacgtcgtcgggatgcacgatgagccgctcctgtgggccgagtag

SEQ ID NO: 18379 - protein, 316 aa, Sorghum bicolor
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: Useful for making plants with altered lignin content
  misc_feature: Functional homolog of the protein sequence given in SEQ ID NO 13219
  misc_feature: The sequence is a functional homolog of SEQ ID NO 10 in the 10/903,236 US patent application
  misc_feature: The sequence is a functional homolog of SEQ ID NO 1735 in the 10/374,780 US patent application
  misc_feature: The sequence is a functional homolog of SEQ ID NO 2125 in the 10/666,642 US patent application
  misc_feature: The sequence is a functional homolog of SEQ ID NO 690 in the 10/666,642 US patent application
  misc_feature: The sequence is a functional homolog of SEQ ID NO 70 in the 10/714,887 US patent application
  misc_feature: The sequence is a functional homolog of SEQ ID NO 70 in the 11/435,388 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: Ceres ANNOT ID no. 8702204
  misc_feature (119)..(170): Pfam ID: AP2 Pfam Description: AP2 domain
MDAPAQRAMAVDTGNAPTTSCSSSSSTSSSSVVNDAPQEVVPKNSCKGTNKRKRASSPDSQEQEVEANGSTNNGHHQGEESSSCCCSTDDTEASVGDDKAEEAAAATATRSSRSGYKHPSYRGVRRRSWGKWVSEIREPRKKSRIWLGTFPTAEMAARAHDVAALAIKGRAAHLNFPDRAHELPRPAAAAQAAAGAADVQCDAPPSPSPSPSPSSSAELLLPSSPAADADASPEQAAAACCLCPEATMTTTHGDGGGGQGQGQGQESALFDLPDLLLDLRDGLWWPPVWPAAAMAAEEYDGCDVVGMHDEPLLWAE

SEQ ID NO: 18380 - DNA, 972 bp, Sorghum bicolor
  misc_feature: Ceres ANNOT ID no. 8702176
  misc_feature: Encodes the peptide sequence at SEQ ID NO 18381
atgaacatggacttcaccggagacgccgacggcttcgccctcgacttcatcggcgacctcatgttcggcgtcgacggcggcagcgtccccgtggccagccctgtcgtagtttccgacgacctcaccttccccgtcctgctgccacctcatcagccggagttccagcccgtgtcgttcttaccacagcagcagcagcatcaaggatacatagacgtgggagctgctccgaccgccgcttcggtcgttggcgaggcgccggcggcgttccgggcgcaggagccggcgcgaccggtgatgataaagttcgggagcgagccgtcgtcgcccgtggccaccaccatgaggcagccgctcaccatctccgtgccgccgagctcatacgcctgggccgccgcgccggccgtcgaggacttccgcaagtaccgcggcgtccggcagcggccctggggcaagtacgcggcggagatccgcgacccgaagcggcgcggctcgcgcgtgtggctcggcacgtacgacacgcccgtggaggccgcgcgcgcctacgaccgcgccgcgttccgcatgcgcggcgccaaggccatcctcaatttcccgaacgaggttggcacccgcggcgctgatgacctctgggcggcgccgccggcccctcccgcgacggcgaacaagcggaagcggcagcagatggtggagggtgaggaccccgacgtcgaggtggccgcggtggtgggcaaggcagtgaagatggaggcgccgtcgtcgtcgtcgttgacccaggcgtcctccgcctcgccgtcatcgacggtgacgtcgtcgactacgacagggaagggcggaggtgctgagtggctgcccgtgacaccgtcgagcgggagctcggagcagtactgggaggcgctgctccgaggtctaccgccgctgtcgccgctgtcaccgcacccagcgttggggtttccgctgcttagcgtaaactaa

SEQ ID NO: 18381 - protein, 323 aa, Sorghum bicolor
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: Useful for making plants with altered lignin content
  misc_feature: Functional homolog of the protein sequence given in SEQ ID NO 13219
  misc_feature: Ceres ANNOT ID no. 8702176
  misc_feature (139)..(191): Pfam ID: AP2 Pfam Description: AP2 domain
MNMDFTGDADGFALDFIGDLMFGVDGGSVPVASPVVVSDDLTFPVLLPPHQPEFQPVSFLPQQQQHQGYIDVGAAPTAASVVGEAPAAFRAQEPARPVMIKFGSEPSSPVATTMRQPLTISVPPSSYAWAAAPAVEDFRKYRGVRQRPWGKYAAEIRDPKRRGSRVWLGTYDTPVEAARAYDRAAFRMRGAKAILNFPNEVGTRGADDLWAAPPAPPATANKRKRQQMVEGEDPDVEVAAVVGKAVKMEAPSSSSLTQASSASPSSTVTSSTTTGKGGGAEWLPVTPSSGSSEQYWEALLRGLPPLSPLSPHPALGFPLLSVN

SEQ ID NO: 18382 - DNA, 699 bp, Sorghum bicolor
  misc_feature: Ceres ANNOT ID no. 8702206
  misc_feature: Encodes the peptide sequence at SEQ ID NO 18383
atggacatggacgacgctcaggagcctgcctccccgacctccccgtccccgtcctcctcctcctcctcctcttcctcgtcgtcctccgtgggcccgaagaagcgggcgcgcaaggacggcagccgtcacccgacgtaccgcggcgtgcgcatgcggagctggggcaagtgggtgtcggagatcagggagccccgcaagaagtcccgcatctggctgggcaccttcgccaccgcggagatggcggcgcgcgcgcacgacgtggcggcgctcgccatcaagggcgcccgcgacgcgcacctcaacttcccgtcccaggcgcacctgctcccgcgcccggcctccgcggcgcccaaggacgtgcaggccgcggccgcgctcgccgccgccgccgacttccctcctctgccgtcgtcgtgcccctgccccggtgaaggcgcaggcaatgccaagagccccgagagcagcagctccgacgacgccagcgccagcgccgcgtcgccgcccccgcccccgcccccgccgccgccggccccgcaggaggacgccgagcccaacccggacgacgcgctgttcgacctcccggacctgctcctggacctgagatgctgcggcccgtcgtcgtgggccgttgccgacgacgacgtggccggcggcggcgcgttccggctcatcgaggagccgctgctgtgggagtactga

SEQ ID NO: 18383 - protein, 232 aa, Sorghum bicolor
  misc_feature: The sequence is a functional homolog of SEQ ID NO 1234 in the 10/374,780 US patent application
  misc_feature: The sequence is a functional homolog of SEQ ID NO 1248 in the 10/374,780 US patent application
  misc_feature: Useful for making plants with altered lutein content
  misc_feature: Useful for making plants with modulated biomass
  misc_feature: Useful for making plants with modulated flowering time
  misc_feature: Functional homolog of the protein sequence given in SEQ ID NO 13470
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: Useful for making plants with altered lignin content
  misc_feature: Functional homolog of the protein sequence given in SEQ ID NO 13219
  misc_feature: The sequence is a functional homolog of SEQ ID NO 166 in the 11/375,241 US patent application
  misc_feature: The sequence is a functional homolog of SEQ ID NO 2231 in the 10/666,642 US patent application
  misc_feature: The sequence is a functional homolog of SEQ ID NO 94 in the 10/714,887 US patent application
  misc_feature: The sequence is a functional homolog of SEQ ID NO 94 in the 11/435,388 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: Ceres ANNOT ID no. 8702206
  misc_feature (44)..(95): Pfam ID: AP2 Pfam Description: AP2 domain
MDMDDAQEPASPTSPSPSSSSSSSSSSSSVGPKKRARKDGSRHPTYRGVRMRSWGKWVSEIREPRKKSRIWLGTFATAEMAARAHDVAALAIKGARDAHLNFPSQAHLLPRPASAAPKDVQAAAALAAAADFPPLPSSCPCPGEGAGNAKSPESSSSDDASASAASPPPPPPPPPPAPQEDAEPNPDDALFDLPDLLLDLRCCGPSSWAVADDDVAGGGAFRLIEEPLLWEY

SEQ ID NO: 18384 - DNA, 1503 bp, Sorghum bicolor
  misc_feature: Ceres ANNOT ID no. 8702216
  misc_feature: Encodes the peptide sequence at SEQ ID NO 18385
atggggaggaagcctgacgcggcagccaaatcgtactactccggtggcggcggcgccggcgcctcctcgccgagggcagcgaggaaggcgccgccttctccggtgttcctgggaactgcgctgttcgttctagggttcgtgtccctctttacgggacacgtggtcactgacgctgactgggcgcggatccggagtcggtggcgatccaagcagcatagaaactacgagcctatcgatatttgggaatccaagtattccagcatgtactatggatgcagtgggagaagcgcagatttcagatctgctgtgccagagaacagttccactggttacttgttgatagctacaagcgggggcctgaatcagcagcgcatagggataacagatgctgttgtagttgcctggattttgaatgccacacttgttgtacctgagttagaccaccactcattctggaaggatgacagtgacttctctgatatttttgacgtggattggttcatttcctacctatcaaaggatgtaagtattgtcaaaaggatcccttatgaagtaatgatgtcaatggataaactaccgtggaccatgcgtgcacctaggaaatcaatgcctgagttttacattgatgaagttttgccaatactcatgcgaaggcgagctttgcaattaacaaagtttgattatagactcagtagcgatcttgatgaagatttgcaaaagttgcgttgccgagtaaattttcatgctttgaaattcacgagttctatacacgccatgggtcaaaaacttgttcaaaagctgagactcatgaacacgcgatatgtcgccattcatttgaggtttgaacctgacatgcttgcattttctggctgttactacggtggcggtgaaaaagaaagaaaggaattgggtgaaattaggaaacgatgggatacattacctgagttgagtgctgaagaggaacgcagcagggggaaatgcccactgactccacatgaagttgggttaatgctccgagctcttggttttgacaatgatacacttctgtatgttgcttctggagaaatatatggtggagatgaaactctccaacctcttagggaactcttcccaaatttctacactaaggagaaacttgctggggatgatttgaatcccttccttcctttttcttcacggctggctgcaattgacttcattgtttgtgatgagagtgatgtctttgttacaaataataatgggaacatggccaaagttttagctggccggaggcgatacatgggccacaagagaactattcgcccaaatgcaaagaaactcaatgtactatttcagacacggaatcagttgggctgggataccttttcacggaaggtacagaaagttcagaggggtcttatgggtgagccggatgatatcagaccaaaacaggatgacttccatgaatttccatcatcttgcatctgcttaagaaaacctagaaatatatcggtcacaacctga

SEQ ID NO: 18385 - protein, 500 aa, Sorghum bicolor
  misc_feature: Useful for making plants with modulated nitrogen use efficiency
  misc_feature: Functional homolog of the protein sequence given in SEQ ID NO 14347
  misc_feature: Ceres ANNOT ID no. 8702216
MGRKPDAAAKSYYSGGGGAGASSPRAARKAPPSPVFLGTALFVLGFVSLFTGHVVTDADWARIRSRWRSKQHRNYEPIDIWESKYSSMYYGCSGRSADFRSAVPENSSTGYLLIATSGGLNQQRIGITDAVVVAWILNATLVVPELDHHSFWKDDSDFSDIFDVDWFISYLSKDVSIVKRIPYEVMMSMDKLPWTMRAPRKSMPEFYIDEVLPILMRRRALQLTKFDYRLSSDLDEDLQKLRCRVNFHALKFTSSIHAMGQKLVQKLRLMNTRYVAIHLRFEPDMLAFSGCYYGGGEKERKELGEIRKRWDTLPELSAEEERSRGKCPLTPHEVGLMLRALGFDNDTLLYVASGEIYGGDETLQPLRELFPNFYTKEKLAGDDLNPFLPFSSRLAAIDFIVCDESDVFVTNNNGNMAKVLAGRRRYMGHKRTIRPNAKKLNVLFQTRNQLGWDTFSRKVQKVQRGLMGEPDDIRPKQDDFHEFPSSCICLRKPRNISVTT

SEQ ID NO: 18386 - DNA, 1866 bp, Sorghum bicolor
  misc_feature: Ceres ANNOT ID no. 8702211
  misc_feature: Encodes the peptide sequence at SEQ ID NO 18387
atgcacgccgccgtgcaccaccaccaccctggccaccgcgcaccgccgcctcgccgctgctctcgcggccacgggcgcagcagcgtcgccgtccgcgccgcggccgccaccaccgtcaccagcaccccgggcgccgcggcgacagcgccggactcgccgtccgcgtcgttctgggactacaacctcctgttccggtcgcagcgcgccgagtgccgcgaccccgtcgcgctccgcgtcaccgagggcgcgatcccggcggacttcccgtcgggcacctactacctcgccggtccggggatgttcaccgacgaccacgggtccaccgtgcacccgctcgacggccacggctacctccgctcgttccgcttcggctccgacggcgcgccggcgcgctactccgcgcggtacgtggagacggcggcgaagcgggaggagcacgacgcgccgcgctcgtcgtggcggttcacgcaccggggccccttctcggtgctgcagggcgggacccgggtgggcaacgtgaaggtgatgaagaacgtggccaacaccagcgtgctgcgctggggcggccgcgtgctctgcctctgggaaggcggcgagccgtacgagctggacccgcggacgctggagaccatcggcccgttcgacatcctcggccgcctcgccaccggcggcgaagcggcacgagacgacgacagcagcgaggctgcgcgtctcgggcgccggcggccgtggctgcaggaggcagggatcgacgtggccgcgcgcctgctgcgaccggtcctcggtggtgtcttcagcatgccggccaagcggctgctcgcgcactacaagatcgaccaggagaggaaccggctgctcatggtggcctgcaacgccgaggacatgctcctcccgcgctccaacttcactttctacgagttcgacgccgacttcgcgctggtgcagacgcgggagtttgtcttgccggaccacctgatgatccacgactggaccttcacggacagccactacgtcctcctcggcaacagaatcaggctggacattccaggttcgctgctggcgctcacgggcactcacccaatgatcgcggccctcgccgtggacccgagccggcagtccacgcccgtctacctgctgccgcgctccccggaggccgaggcccccggccgcgactggagcgtgcccatcgaggcgccatcgcagatgtggtccatgcacgtcggcaacgccttcgaggagcgcaacgcccggggcggcatcaacattcagctccacatgtccggctgctcttaccagtggttcaacttccacaggatgtttggttacaattggcagaacaagaagctggacccgtccttcatgaacatagccaagggcagggaatggctacctcgtcttgtacaggtgtccatcgacctcgacaagagaggaacgtgccgaggatgctccgtccggagattgtccgaccagtggaccaggccggcggacttcccggcgatcaacccaggcttcgccaaccggaggaaccggttcatctacgccggcggcgcctccggttcacgcagattcttgccgtacttccccttcgacagcgtcgtcaaggtagacgtcgctgatggatcagcgcggtcgtggtcagtcgccgggcgcaagttcgttggtgagccggtcttcgtcccgaccggcagtagcgaggatgacggctatgttctgcttgtcgagtatgcagtgtctgatcacaggtgccatctggtggtgctggacgcaaggaagatcggggaaagggacgcagttgtggcaaaacttgaggtgcccaagcacctcaccttcccaatgggattccatgggttctgggcagatgaatga

SEQ ID NO: 18387 - protein, 621 aa, Sorghum bicolor
  misc_feature: Useful for making plants with modulated biomass
  misc_feature: Functional homolog of the protein sequence given in SEQ ID NO 13425
  misc_feature: Ceres ANNOT ID no. 8702211
  misc_feature (500)..(621): SWISSPROT Homolog: EC 1.13.11.51 9-cis-epoxycarotenoid dioxygenase
  misc_feature (45)..(621): Pfam ID: RPE65 Pfam Description: Retinal pigment epithelial membrane protein
MHAAVHHHHPGHRAPPPRRCSRGHGRSSVAVRAAAATTVTSTPGAAATAPDSPSASFWDYNLLFRSQRAECRDPVALRVTEGAIPADFPSGTYYLAGPGMFTDDHGSTVHPLDGHGYLRSFRFGSDGAPARYSARYVETAAKREEHDAPRSSWRFTHRGPFSVLQGGTRVGNVKVMKNVANTSVLRWGGRVLCLWEGGEPYELDPRTLETIGPFDILGRLATGGEAARDDDSSEAARLGRRRPWLQEAGIDVAARLLRPVLGGVFSMPAKRLLAHYKIDQERNRLLMVACNAEDMLLPRSNFTFYEFDADFALVQTREFVLPDHLMIHDWTFTDSHYVLLGNRIRLDIPGSLLALTGTHPMIAALAVDPSRQSTPVYLLPRSPEAEAPGRDWSVPIEAPSQMWSMHVGNAFEERNARGGINIQLHMSGCSYQWFNFHRMFGYNWQNKKLDPSFMNIAKGREWLPRLVQVSIDLDKRGTCRGCSVRRLSDQWTRPADFPAINPGFANRRNRFIYAGGASGSRRFLPYFPFDSVVKVDVADGSARSWSVAGRKFVGEPVFVPTGSSEDDGYVLLVEYAVSDHRCHLVVLDARKIGERDAVVAKLEVPKHLTFPMGFHGFWADE

SEQ ID NO: 18388 - DNA, 1257 bp, Sorghum bicolor
  misc_feature: Ceres ANNOT ID no. 8702217
  misc_feature: Encodes the peptide sequence at SEQ ID NO 18389
atggaaggaaacggtggcgctggcggcggcagcggaagcgcggcaccgccctgggatctcgccatgcactgggctccctccgccggctcgtcctacccgcagcaacccttggcgctgcgtcctggcggcgtgcccagcagccagctccagctgctgcaccagcagcagcagcagcagcagcaggagctgacctgcctgaagctggggaagcggcccgcctgctgctgggccggggcggcgttgggcagccaagtggtggcggcgcaggctggcgcgggcctgccgcatcatctccacggcaatggcggcggcgccgccgctggttgtggtggtggtgcgagtgggaaagctgctgagggtaagaggaaggagaagcaggcggcggcggcggcgccgggcgcggcggccgtgccgaggtgccaggtggaggggtgccacgtggcgctggcggacgccaaggactaccaccggcggcacaaggtgtgcgaggcgcactccaaagcgccccgggtcgtcgtgctcggcgccgagcagcgcttctgccagcagtgcagccggttccacgcgatctcggagttcgacgaagcgaagcggagctgccgccggcggctggccgggcacaacgagcggcggcggaagagcaacgccagcgaggccatggctagaggcgctgcgcacccacacggagtgacggctttcggccacggcttcctgccaccgtgcggcggcctctcggggtcctcggctggtgctctctctcttctgtcatcagccagaagcggcgcgacgagcgccgccccctggcaggtcacgacgtcggacatctctgcgcgctccagtgcggcgctcgacgaccttatcgccgagaaccgcgccgcactcctcgcgtggcagtacttctcggaccgctcgtcgtcggcgcccggccgccattttgcctcttcgtcgtcgacggcgacgggttgcgccctcccgccggccgacgatcagcacgcagcagccagctggcgcccgcacccccacagcggcgttggcggtggccggcaccacatggcgccgcccggtgtgtggcacacgacgctggaccttatgcagacagcaagctccgcagctccggccacctccaccggcgcaccgttccggccagtgccggagagggcgggcgccaggcctcgcggtaagagcaaggacggcgacgacgcctcaggatgtagcttggacgcgtgggcacccgcgggtggagctcgtgtgctgtga

SEQ ID NO: 18389 - protein, 418 aa, Sorghum bicolor
  misc_feature: Useful for making plants with altered terpenoid content
  misc_feature: Useful for making plants with modulated flowering time
  misc_feature: Functional homolog of the protein sequence given in SEQ ID NO 13706
  misc_feature: Ceres ANNOT ID no. 8702217
  misc_feature (139)..(217): Pfam ID: SBP Pfam Description: SBP domain
MEGNGGAGGGSGSAAPPWDLAMHWAPSAGSSYPQQPLALRPGGVPSSQLQLLHQQQQQQQQELTCLKLGKRPACCWAGAALGSQVVAAQAGAGLPHHLHGNGGGAAAGCGGGASGKAAEGKRKEKQAAAAAPGAAAVPRCQVEGCHVALADAKDYHRRHKVCEAHSKAPRVVVLGAEQRFCQQCSRFHAISEFDEAKRSCRRRLAGHNERRRKSNASEAMARGAAHPHGVTAFGHGFLPPCGGLSGSSAGALSLLSSARSGATSAAPWQVTTSDISARSSAALDDLIAENRAALLAWQYFSDRSSSAPGRHFASSSSTATGCALPPADDQHAAASWRPHPHSGVGGGRHHMAPPGVWHTTLDLMQTASSAAPATSTGAPFRPVPERAGARPRGKSKDGDDASGCSLDAWAPAGGARVL

SEQ ID NO: 18390 - DNA, 792 bp, Sorghum bicolor
  misc_feature: Ceres ANNOT ID no. 8702220
  misc_feature: Encodes the peptide sequence at SEQ ID NO 18391
atggcttccaagtcccagctcctgtccttcattgcgattgcggctctagcctcgatcatcatccacccttgtgcatccgtcgagtttcaccgcaagctctccagctggtccagcggcggcgcgacgtggtacggcgccgctactggggctggaagtgatggtggtgcatgcgggtaccgaggtgccgtcgaccaggcgcccttctcgtccatgatcgccgcgggaagcccttccatctacaactccggcaagggctgcggctcttgcttccaggtcaaatgcaccggcaatggcgcgtgctccggcaacccagtgaccgtcgtcatcaccgatgaatgccctggcggtgcgtgcctcaacgagccgggccacttcgacatgagcggaacggcattcggcgccatggcgaaccccggccaggccgacaagctgcgcaacgccggcgtcctccaaatccagtacacccgtgtgccatgcaactggcctggcgtgaagctaaccttcgtggtcgacgccggctcgaacccggagtacttcgccgtgctcattaagtacgtgaacggcgacggcgacctctccgccgtcgacctcatgcagaccggggctggggcgttgtgggcgtccatgcagccgtcgtggggcgccgtctggaagttcaacgccgggtcggccttgcaggcgcccttgtccatccgcctgacgtcgagctccggcaagcagctcgtcgccagcaacgtcatccccgccgggtggacgcccggcgccacctaccagtcctctgtcaactactaa

SEQ ID NO: 18391 - protein, 263 aa, Sorghum bicolor
  misc_feature: Useful for making plants with altered carbohydrate content
  misc_feature: Functional homolog of the protein sequence given in SEQ ID NO 13767
  misc_feature: Useful for making plants with altered cell wall content and/or composition
  misc_feature: Functional homolog of the protein sequence given in SEQ ID NO 13995
  misc_feature: Ceres ANNOT ID no. 8702220
  misc_feature (72)..(154): Pfam ID: DPBB_1 Pfam Description: Rare lipoprotein A (RlpA)-like double-psi beta-barrel
  misc_feature (166)..(248): Pfam ID: Pollen_allerg_1 Pfam Description: Pollen allergen
MASKSQLLSFIAIAALASIIIHPCASVEFHRKLSSWSSGGATWYGAATGAGSDGGACGYRGAVDQAPFSSMIAAGSPSIYNSGKGCGSCFQVKCTGNGACSGNPVTVVITDECPGGACLNEPGHFDMSGTAFGAMANPGQADKLRNAGVLQIQYTRVPCNWPGVKLTFVVDAGSNPEYFAVLIKYVNGDGDLSAVDLMQTGAGALWASMQPSWGAVWKFNAGSALQAPLSIRLTSSSGKQLVASNVIPAGWTPGATYQSSVNY

SEQ ID NO: 18392 - DNA, 876 bp, Sorghum bicolor
  misc_feature: Ceres ANNOT ID no. 8702221
  misc_feature: Encodes the peptide sequence at SEQ ID NO 18393
atggcggctagtccgagcacattccgatttgctgccgtagtggccgtgctgtcgaccctgtcacttcttgcaagccctacctccggctacgagaacgccgagcccatggtgatcagggactcgccgcagaacgacaccagcaggaggtacctgtgggcgtcgtcggcgcgaggctacggctggtcctccggcggcgcgacgtggtacggcaacgctaacggcgccggcagcgacggtggtgcttgtggttataaaggtgatgtcagccagcgcccattcaggtcgatgatcgcggccggcggcccttccctcttcaagaacggcaaaggatgcggcgcatgctaccaaattaagtgcacgggcaacagagcctgctccggccggccagtgacggtcaccatcaccgactcctgccccggcggtgcgtgccttgccgagtcggcgcactttgacatgagcggcacggccttcggcgccatggccaaccgcggcatggctgaccgcctccgctccgccggaatcctcaagatccagtacaagagggtgccctgcaagtacaacggcaggaccgtcaacttcaaggtggacgcggggtccaacccgtactacctcgccgtgctgatcgagtacgtggccggagacggcgagatctccgcggtggacatcatgcaagccggctacaactcgtggacgccgatgcagcagtcgtggggcgccgtgtggcgggtcaactcgaacaacggccagccgctccgcgtgcccttctcggtccgcatcacctcgggcgccggcaaggtcctcgtcgccaggaacgccatccccgccggatggagcgccgggaggacctaccgctccgcagtgaactttggctactga

SEQ ID NO: 18393 - protein, 291 aa, Sorghum bicolor
  misc_feature: Useful for making plants with altered carbohydrate content
  misc_feature: Functional homolog of the protein sequence given in SEQ ID NO 13769
  misc_feature: Useful for making plants with altered cell wall content and/or composition
  misc_feature: Functional homolog of the protein sequence given in SEQ ID NO 13995
  misc_feature: Ceres ANNOT ID no. 8702221
  misc_feature (97)..(179): Pfam ID: DPBB_1 Pfam Description: Rare lipoprotein A (RlpA)-like double-psi beta-barrel
  misc_feature (191)..(274): Pfam ID: Pollen_allerg_1 Pfam Description: Pollen allergen
MAASPSTFRFAAVVAVLSTLSLLASPTSGYENAEPMVIRDSPQNDTSRRYLWASSARGYGWSSGGATWYGNANGAGSDGGACGYKGDVSQRPFRSMIAAGGPSLFKNGKGCGACYQIKCTGNRACSGRPVTVTITDSCPGGACLAESAHFDMSGTAFGAMANRGMADRLRSAGILKIQYKRVPCKYNGRTVNFKVDAGSNPYYLAVLIEYVAGDGEISAVDIMQAGYNSWTPMQQSWGAVWRVNSNNGQPLRVPFSVRITSGAGKVLVARNAIPAGWSAGRTYRSAVNFGY

SEQ ID NO: 18394 - DNA, 1029 bp, Sorghum bicolor
  misc_feature: Ceres ANNOT ID no. 8702233
  misc_feature: Encodes the peptide sequence at SEQ ID NO 18395
atggctctggctcgcatcctcttgttgctgctggtcaccgtcgcgagcctcctgccgccgatcgcgagccagcaggcagcagcgacgaagtgcgagtacagaaagcactcgggccaccggtacaggcacccggtgggcgtgcggaagatcgtggtagacgcgagcggcgccggcgacttcgtctccatccaacaggccgtcgactcggtgccggagggcaacaccatgcgcgtcatcatgcagatcaacgccggcacgtacatagagaaggtggtggtgccagcgtcgaagccgtacgtgacgttccagggcgccgggcgcgacgtgacggtggtggagtggcacgaccgggccagcgaccgcggccccgacgggaagccgctccgcacctacaacaccgcctcagtaaccattctcgctaactatttcaacgctaagaacatcagcttcaagaacacagctccggcaccaatgcccggcacgcaaggagggcaggcggtggcgttccgcatctccggcgacaaggccttcttcttcggctgcgggttctacggcgcgcaggacacgctgtgcgacgacgccggccggcactacttccgcgactgctacatccagggctccatcgacttcgtcttcggcaacgcccgctccctctacaaggactgcgagctgcactcgacggcgcagcggttcgggtcggtggcggcgcacgggcggcacgacccgtgcgagcgcacgggcttcgccttcgtcaactgccgtgtgaccggcacggggaggctctacgtagggcgagccatgggccagtactcgcgcatcgtctacgcctacacctacttcgacagcgtcatcgcgcccggcggatgggatgactgggatcacaccagcaacaagagcatgaactggggccccggagtcgacgccgtgcacggcgtgtcgtgggcgcgggagctcgactacttcgccgcccgccccttcctcggcaagagcttcgtcaacggataccactggctcacacctgatgtctga

SEQ ID NO: 18395 - protein, 342 aa, Sorghum bicolor
  misc_feature: Useful for making plants with altered cell wall content and/or composition
  misc_feature: Functional homolog of the protein sequence given in SEQ ID NO 14625
  misc_feature: Useful for making plants with altered carbohydrate content
  misc_feature: Functional homolog of the protein sequence given in SEQ ID NO 14626
  misc_feature: Ceres ANNOT ID no. 8702233
  misc_feature (50)..(293): SWISSPROT Homolog: EC 3.1.1.11 Pectinesterase
  misc_feature (49)..(335): Pfam ID: Pectinesterase Pfam Description: Pectinesterase
MALARILLLLLVTVASLLPPIASQQAAATKCEYRKHSGHRYRHPVGVRKIVVDASGAGDFVSIQQAVDSVPEGNTMRVIMQINAGTYIEKVVVPASKPYVTFQGAGRDVTVVEWHDRASDRGPDGKPLRTYNTASVTILANYFNAKNISFKNTAPAPMPGTQGGQAVAFRISGDKAFFFGCGFYGAQDTLCDDAGRHYFRDCYIQGSIDFVFGNARSLYKDCELHSTAQRFGSVAAHGRHDPCERTGFAFVNCRVTGTGRLYVGRAMGQYSRIVYAYTYFDSVIAPGGWDDWDHTSNKSMNWGPGVDAVHGVSWARELDYFAARPFLGKSFVNGYHWLTPDV

SEQ ID NO: 18396 - DNA, 1002 bp, Sorghum bicolor
  misc_feature: Ceres ANNOT ID no. 8702226
  misc_feature: Encodes the peptide sequence at SEQ ID NO 18397
atggccaagaacacatgcaagctatgctcccgccgcttcgccagcccgcgcgccctcgccggccacatgcgcgcccactccgttgccgccgctaagtcgcagatctcctcggcgtcgtcggcttcgacctccatcgcggccggcggcggcatcgacgacgacgctgccgacgcaaagaagaagcccagccccatccagggggggcacgtgctgcgggagaagaatcccaagcgccgcgtccgcctcgacgacgactccgacttctcggatcgcgagagcgagacgacggactactactccccggcgtcgccggacgccaagcgctcgcacgccggatcgggggacgcggagccggtgagctcggtctccgacgcggccacgccggaggaggacgtcgcgctgtccctgatgatgctctcccgcgactcctggcccgcgccgccgccgtcgccgtacccgtacccgttccgcctcgactccgacgacgacgacgacgacgcccgccgcgtggtggccgccgccaccgccgccgccgccgcggcgcagcagaagcggacgcggtacgagtgccccgcgtgcaagaaggtgttccgatcgtaccaggccctcgggggccaccgtgccagcaacgtgcgcggcggcaggggcggctgctgcgcgccgccgctcagcactcctccgcctcccggcccggccccgctgcagccattgccagaatgcgagggcagcgaggaggactccaaggcgcagcagccgcacgagtgcccctactgcttccgcgtgttcccgtccgggcaagctctcggcggccacaagcggtctcacctctgctcggctgcggcggcggcagcagcagcagccgtcacatcaagcgctgatccttcgtcgatcacaatgaagagcctggatttcattgatctgaacctccccgcgcccttcgacgacgtggaagtctccgccttttcagatcccttcctctcgtccaagccagcaggttcttga

SEQ ID NO: 18397 - protein, 333 aa, Sorghum bicolor
  misc_feature: The sequence is a functional homolog of SEQ ID NO 831 in the 10/666,642 US patent application
  misc_feature: The sequence is a functional homolog of SEQ ID NO 830 in the 10/666,642 US patent application
  misc_feature: Ceres ANNOT ID no. 8702226
MAKNTCKLCSRRFASPRALAGHMRAHSVAAAKSQISSASSASTSIAAGGGIDDDAADAKKKPSPIQGGHVLREKNPKRRVRLDDDSDFSDRESETTDYYSPASPDAKRSHAGSGDAEPVSSVSDAATPEEDVALSLMMLSRDSWPAPPPSPYPYPFRLDSDDDDDDARRVVAAATAAAAAAQQKRTRYECPACKKVFRSYQALGGHRASNVRGGRGGCCAPPLSTPPPPGPAPLQPLPECEGSEEDSKAQQPHECPYCFRVFPSGQALGGHKRSHLCSAAAAAAAAAVTSSADPSSITMKSLDFIDLNLPAPFDDVEVSAFSDPFLSSKPAGS

SEQ ID NO: 18398 - DNA, 204 bp, Sorghum bicolor
  misc_feature: Ceres ANNOT ID no. 8702234
  misc_feature: Encodes the peptide sequence at SEQ ID NO 18399
atgaagaatccgctggaggagctgctcaaggagcgcgacctccccataggcctggtcctgtgggaggcaaccatcttcaagctgctgacggagtcgcgacgcctgatggtgttttttccgtcctcctgcgaggtcgggttctgcgcctattcttttaattttattttttatgtctcctatattaatattttatttaaaaaatag

SEQ ID NO: 18399 - protein, 67 aa, Sorghum bicolor
  misc_feature: Useful for making plants with modulated nitrogen use efficiency
  misc_feature: Functional homolog of the protein sequence given in SEQ ID NO 14627
  misc_feature: Ceres ANNOT ID no. 8702234
MKNPLEELLKERDLPIGLVLWEATIFKLLTESRRLMVFFPSSCEVGFCAYSFNFIFYVSYINILFKK

SEQ ID NO: 18400 - DNA, 390 bp, Sorghum bicolor
  misc_feature: Ceres ANNOT ID no. 8702241
  misc_feature: Encodes the peptide sequence at SEQ ID NO 18401
atggcaggcaaggccacgatcgtgctgttcctcgccgtcaacctggcggtgttcgccatggcaagcgcctgcggtggcaactgccccaccccatccaccccgtcgacgccgaccccgacgccggcctcgttcggcaagtgcccccgtgacgcgctcaagttgggcgtgtgcgccaatgttctaggcctgatcaaggccaaggtgggcgtgccgcccacggagccatgctgcccgctgctggaggggctcgtcgacctcgaggccgcactctgtctctgcaccgccatcaagggcaacatcctcggcattaacctcaacctgcccatcgacctcagtctcatcctcaaccactgcggcaagagcgtgcccaccggcttcaagtgcctctaa

SEQ ID NO: 18401 - protein, 129 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated oxidative stress sensitivity
  misc_feature: Functional homolog of the protein sequence given in SEQ ID NO 13086
  misc_feature: Useful for making plants with modulated salt sensitivity
  misc_feature: Functional homolog of the protein sequence given in SEQ ID NO 13766
  misc_feature: Ceres ANNOT ID no. 8702241
  misc_feature (47)..(128): Pfam ID: Tryp_alpha_amyl Pfam Description: Protease inhibitor/seed storage/LTP family
MAGKATIVLFLAVNLAVFAMASACGGNCPTPSTPSTPTPTPASFGKCPRDALKLGVCANVLGLIKAKVGVPPTEPCCPLLEGLVDLEAALCLCTAIKGNILGINLNLPIDLSLILNHCGKSVPTGFKCL

SEQ ID NO: 18402 - DNA, 1401 bp, Sorghum bicolor
  misc_feature: Ceres ANNOT ID no. 8702279
  misc_feature: Encodes the peptide sequence at SEQ ID NO 18403
atggcggttgacacgatggaatcggttgccgtggtggccgtgccgttcccggcgcagggccatctgaaccagctgctccacctgtcgctgctgctcgcctcgcggggcctctccgtgcactacgcggcgccgccgccgcacgtccggcaggcgcgcgcgcgcgtgcacggctgggaccccaaggcgctgggctccatcgagttccacgacctcgacgtgccggcgtacgactctccgcccccggaccttgccgcgccgtcgccgttcccgaaccacctcatgcccatgttcgaggccttcgccgccgccgcgcgcgccccgctcgcggcgctcctccagcgcctctccgccacccaccgccgcgtggccgtcgtgttcgaccgcctcaaccccttcgccgccacggaggcggcgcggctgggcaacggcgaggcgttcgggctgcagtgcgtcgccatctcctacgacctcgggtggctggaccccgggcaccggctcatccgcgactacggcctccagttcctcgcccccgacgcctgcatgtccaaggagttcgtggatttcgtcctccggatggaggaggccgagcagggcgcgcccgtcgccggcctggtcatgaacacgtgccgcgcgctcgagggcgagttcatcgacgtggtcgccgcgcagccgtcgttccagggccagaggttcttcgcggtcgggccgttgaacccgctgctgctcgacgcggacgcacggacgacgccgggacgacgacatcaggccctggagtggctcgacaagcagccgccggcgtcggtgctctacgtctcgttcggcacgacgtcgtgcctccacgccgagcaggtcgcggagctcgccgcggcgatcaagggcagcaagcagcggttcatctgggtgctgcgcgacgccgaccgcgccgacatatacgccgacgcgtccggcgagagccggcacgccaagttcctgtccgagttcaccgaggaaactcgaggcatcgggctgctgatcaccgggtgggcgccgcagctggagatcctggcgcacggcgccacggcggcgttcatgagccactgcggctggaactcgaccatggagagcctgagccacgggaagccagtgctggcctggcccatgcactccgaccagccctgggactcggagctgctgtgcaagtacctcaaggcggggctcctggtgaggccatgggagaagcacgcggacatcataccggcgcaggccatccagaaggtgatcgaggaggcgatgctatctgacagcggcatggcggtgcggcagcgggcaaaggagctcggggaggcggttcgcgcctccgtggccgacggcgggaactcccgtaaggatctcgacgacttcattggctacatcacgaggtga

SEQ ID NO: 18403 - protein, 466 aa, Sorghum bicolor
  misc_feature: The sequence is a functional homolog of SEQ ID NO 8 in US patent 7148405
  misc_feature: Ceres ANNOT ID no. 8702279
  misc_feature (1)..(466): SWISSPROT Homolog: EC 2.4.1.215 Cis-zeatin O-beta-D-glucosyltransferase
  misc_feature (10)..(466): Pfam ID: UDPGT Pfam Description: UDP-glucoronosyl and UDP-glucosyl transferase
MAVDTMESVAVVAVPFPAQGHLNQLLHLSLLLASRGLSVHYAAPPPHVRQARARVHGWDPKALGSIEFHDLDVPAYDSPPPDLAAPSPFPNHLMPMFEAFAAAARAPLAALLQRLSATHRRVAVVFDRLNPFAATEAARLGNGEAFGLQCVAISYDLGWLDPGHRLIRDYGLQFLAPDACMSKEFVDFVLRMEEAEQGAPVAGLVMNTCRALEGEFIDVVAAQPSFQGQRFFAVGPLNPLLLDADARTTPGRRHQALEWLDKQPPASVLYVSFGTTSCLHAEQVAELAAAIKGSKQRFIWVLRDADRADIYADASGESRHAKFLSEFTEETRGIGLLITGWAPQLEILAHGATAAFMSHCGWNSTMESLSHGKPVLAWPMHSDQPWDSELLCKYLKAGLLVRPWEKHADIIPAQAIQKVIEEAMLSDSGMAVRQRAKELGEAVRASVADGGNSRKDLDDFIGYITR

SEQ ID NO: 18404 - DNA, 1389 bp, Sorghum bicolor
  misc_feature: Ceres ANNOT ID no. 8702275
  misc_feature: Encodes the peptide sequence at SEQ ID NO 18405
atggaatccgttaccgtcgtagcggtgccgttcccggcgcaaggccacctgaaccagctcctgcacctatcgctgctgctcgcagcgcgcggtctccccgtgcactacgcggcgcccgcggagcacgtgcgccaggcccgcgcgcgcgtgcacggctggggcgacgccgccgccgccgcccgcggcgtcgagttccacgagctcgccatctccgagtacgtctccccgctccctgaccccgccgcggactcgcccttcccgtcccacctcatgctcctctgggaggccttcgccgccagcgcgcccgccgcgctcgcggcgctcctcggcgcgatctccgcctcccaccgccgcgtcgtggtcctgtacgacctcatgaacgccttcgccgccaaggaggccgcgcggctgcccaacggcgaggggtacacgctgcactgcaccgccgtttcgtccatcctcggccggatggaaggcggcagcgaccttctgcgcgaacgcggcctcgagtacctccccatcaacccctacgtgacggaggagtttctcgagttcgcgggcaagcgggcgagagccgcgcaaacgatcccttccagcgccggcatcgtcatgaactcgtgccacgcgctcgagggtgagttcatcgacttcgtcgcccagaagctggccgccggcgggaagaaggtcttctgtatcggcccgttaaacccactgctggactcgagcgcgcacgagcagggcgcaaggcgtcacgagtgcctcgtctggctcgacaggcagccgccggcatctgtgctctacgtgtcgttcggttcgacgtcctccctccgcggcgagcaaatcgcggagcttgcagcggcactgcgtggcagcaaccagaggttcatctgggtcctgcgtgatgccgaccgcggcaacatatttgcggacaacggcgagagccggcacgctaagttcctgtctgagttcgccaaggaaacggaggggacagggctggtgatcaccggatgggcgccgcagctggagatactggcgcacggcgccacggcggcgttcatgagccactgcggctggaactcgaccgtggagagcatgagccacgggaagcccatcctggcgtggcccatgcactccgaccaaccgtgggacgccgagctggtgtgcgagtacctcaaggcaggcttcctggtgaggccatgcgagaagcacgccgaggtgataccggcggcaaccatacaggaggtgatcgagaggatgatggtctctgacgaagggctacccgtgcggcagcgggcaacggcgattggcgaggccgtccgttcgtccgcggctgatggcgggacatccttcagggacctcgaaaacttcattgctcacatcacaaggtga

SEQ ID NO: 18405 - protein, 462 aa, Sorghum bicolor
  misc_feature: The sequence is a functional homolog of SEQ ID NO 8 in US patent 7148405
  misc_feature: Ceres ANNOT ID no. 8702275
  misc_feature (1)..(462): SWISSPROT Homolog: EC 2.4.1.215 Cis-zeatin O-beta-D-glucosyltransferase
  misc_feature (24)..(462): Pfam ID: UDPGT Pfam Description: UDP-glucoronosyl and UDP-glucosyl transferase
MESVTVVAVPFPAQGHLNQLLHLSLLLAARGLPVHYAAPAEHVRQARARVHGWGDAAAAARGVEFHELAISEYVSPLPDPAADSPFPSHLMLLWEAFAASAPAALAALLGAISASHRRVVVLYDLMNAFAAKEAARLPNGEGYTLHCTAVSSILGRMEGGSDLLRERGLEYLPINPYVTEEFLEFAGKRARAAQTIPSSAGIVMNSCHALEGEFIDFVAQKLAAGGKKVFCIGPLNPLLDSSAHEQGARRHECLVWLDRQPPASVLYVSFGSTSSLRGEQIAELAAALRGSNQRFIWVLRDADRGNIFADNGESRHAKFLSEFAKETEGTGLVITGWAPQLEILAHGATAAFMSHCGWNSTVESMSHGKPILAWPMHSDQPWDAELVCEYLKAGFLVRPCEKHAEVIPAATIQEVIERMMVSDEGLPVRQRATAIGEAVRSSAADGGTSFRDLENFIAHITR

SEQ ID NO: 18406 - DNA, 1428 bp, Sorghum bicolor
  misc_feature: Ceres ANNOT ID no. 8702272
  misc_feature: Encodes the peptide sequence at SEQ ID NO 18407
atggctctacccaaatccgaaatgtccgtggaatccgttgccgtcgtggcggtgccgtacccggcgcagggccacctcaacggcatgctacacatgtcgctgctgctcgcgtcccggggtctccccgtgcactacgcggcgcctgggccgcacgtccgccaggcgcgcgcgcgcgtgcacggctggggcgacgacgccctccgccgcatcgagttccacgagctcgaggtccccgcgtacgccaccccgccgccggacccggccgcgccctcgccgttcccgacccacctcatccccatgggcgaggccttcgtcgctggcgcgcgcgccccggtcgccaccctcctcgcgaatgtctccgcgcgccaccgccgcgtggtcgtcctgtacgatcgcctcagctccttcgccgcgcccgaggcggcgcggatccccaacggcgaagcgttctgcctgcagtgcgtggcctcgtccttcgacgccgcgtggacggacgccgggcagcggctccttcgcgcgcgcggcctcgacgccccgcaccccgccgcctgcatgccgagggagttcgtcgagtacattgtcgggacgcaggaggacggccagagtccggcattcgccggggtagtggcgaacacgtcccgcgcgatcgagagcgagttcatcgacttggtagccggggacccgcagtaccgagggaagagggtcttcgccgtcgggccgatgaacccactgctcgacgtgatgaccgcgccggcggcagcgggacgcagtgcgcggcacgagtgcctggactggctcgacaggcaaccgccggcgtcggtgctgtacgtgtcgttcggcacgacgacgtcgctgccggcggagcagatcgcggagctcgccgcggcgctgcgcgacagcaagcagcggttcgtctgggttctgcgcgacgctgatcgcggtgtggtgcacgaggaggaggaggaagccgcggaggagagtaggcacgccaggttcctgtccgagttcaccgaggaaactcgaggcatcgggctggtgatcaccgggtgggcgccgcagctgcagatccaggcgcacggcgccacggcggcgttcatgagccactgcggctggaactcgaccatggagagcctgagccacgggaatccgatgctcgcctggcccatgcactccgaccagccgctggtggcggagctcgtgtgcaagttcctcaaggccgggatcctggtgaggccatgggagcaacacggcgctgtgacacctgcggatgccatccgcgaggcgatcgagaaggtgatggcacgcgacgaaggtttggcgctgcgggagagggccaaggagctcatggagtccattcgcgcctccgtcgctgagggcgggtcctcgcgcaaggacctcgacgacttcgttgcatacatagcaagatga

SEQ ID NO: 18407 - protein, 475 aa, Sorghum bicolor
  misc_feature: The sequence is a functional homolog of SEQ ID NO 8 in US patent 7148405
  misc_feature: Ceres ANNOT ID no. 8702272
  misc_feature (19)..(475): SWISSPROT Homolog: EC 2.4.1.215 Cis-zeatin O-beta-D-glucosyltransferase
  misc_feature (14)..(475): Pfam ID: UDPGT Pfam Description: UDP-glucoronosyl and UDP-glucosyl transferase
MALPKSEMSVESVAVVAVPYPAQGHLNGMLHMSLLLASRGLPVHYAAPGPHVRQARARVHGWGDDALRRIEFHELEVPAYATPPPDPAAPSPFPTHLIPMGEAFVAGARAPVATLLANVSARHRRVVVLYDRLSSFAAPEAARIPNGEAFCLQCVASSFDAAWTDAGQRLLRARGLDAPHPAACMPREFVEYIVGTQEDGQSPAFAGVVANTSRAIESEFIDLVAGDPQYRGKRVFAVGPMNPLLDVMTAPAAAGRSARHECLDWLDRQPPASVLYVSFGTTTSLPAEQIAELAAALRDSKQRFVWVLRDADRGVVHEEEEEAAEESRHARFLSEFTEETRGIGLVITGWAPQLQIQAHGATAAFMSHCGWNSTMESLSHGNPMLAWPMHSDQPLVAELVCKFLKAGILVRPWEQHGAVTPADAIREAIEKVMARDEGLALRERAKELMESIRASVAEGGSSRKDLDDFVAYIAR

SEQ ID NO: 18408 - DNA, 1395 bp, Sorghum bicolor
  misc_feature: Ceres ANNOT ID no. 8702276
  misc_feature: Encodes the peptide sequence at SEQ ID NO 18409
atggagtcagttgccgtcgtggccatcccgttcccggcgcagggccacctgaaccagctgctgcacctgtccctgcagctcgccgcgcgcgggctgcccgtgcactacgcggcgcccgcggagcacgtccgccaggcccgcgcgcgcgtgcacggctggggcgacgacgcgctccgccgcatcgacttccacgagctcgccatctccgactacgcctccccgccgcccgaccccgccgcgagctcgccctacccttcccacctcatgcccctgttcgaggcgttcatcgccgacgcgcccgcgccggtcgcggcgctcctccgcgggctctccgcgtcccaccgccgcgtcgtcgtcctgtacgacgtcatcaacgccttcgccgccgaggaggccgcgcgcctgcccaacggcgaggggttcgcgttccactgcaccgccgcgtcgtccatggtcccgcacatggacggtggcgcccggctcctgcgcgacgtgcacggcctcgacgaccaacccgtccacgccttcgtgacggaggagttcctcgagttcatcggcaagcgcgcgaggtccgcgcagacgatcccgtccagcgccggcgtcgtcatgaacacgtcccgcgcgctcgagggtgagttcatcgacttcgtcacccagcagctggcggccgccggcggcaagaaggtcttctctatcggtccgttaaatccgatgctgggcccgagcgcggacgagcttggcgcgacgcggcacgagtgcctcggttggctcgacaagcagccggccgcgtccgtactctacgtttcgttcggctcgatgtcgtcgctgcgcggcgagcagatcaaggagctcgccgcggcgctgcgcggcagcaaccagcgtttcatctgggtcctgcgcgacgccgaccgcggcaacgtattcggggactccgacgacgacgagagccggcacgccaggttcctgcgcgagttcaccagagaaacggagggaacagggctggtgatcaccgggtgggcgccgcagctggagatactggcgcacggcgccacggcggcgttcctgagccactgcggctggaactcgaccgtggagagcctgagccacgggaagcccatcctggcgtggcccatgcactccgaccagccgtgggacgccgagctggtgtgcaagtacctcaaggcaggctacctggtgaggccatgcgagaagcacgccgaggtgataccggcggcagccatacaggcggtgatcgagaggttgatggtctctgacgacgggctaccagtgcggcagcgtgcgacggcgatcggcgaggccgtccgtgcgtccgcggctgatggcgggtcatccagcaaggacctcgaaaacttcatcgctcacattgtacggtga

SEQ ID NO: 18409 - protein, 464 aa, Sorghum bicolor
  misc_feature: The sequence is a functional homolog of SEQ ID NO 8 in US patent 7148405
  misc_feature: Ceres ANNOT ID no. 8702276
  misc_feature (1)..(464): SWISSPROT Homolog: EC 2.4.1.215 Cis-zeatin O-beta-D-glucosyltransferase
  misc_feature (5)..(464): Pfam ID: UDPGT Pfam Description: UDP-glucoronosyl and UDP-glucosyl transferase
MESVAVVAIPFPAQGHLNQLLHLSLQLAARGLPVHYAAPAEHVRQARARVHGWGDDALRRIDFHELAISDYASPPPDPAASSPYPSHLMPLFEAFIADAPAPVAALLRGLSASHRRVVVLYDVINAFAAEEAARLPNGEGFAFHCTAASSMVPHMDGGARLLRDVHGLDDQPVHAFVTEEFLEFIGKRARSAQTIPSSAGVVMNTSRALEGEFIDFVTQQLAAAGGKKVFSIGPLNPMLGPSADELGATRHECLGWLDKQPAASVLYVSFGSMSSLRGEQIKELAAALRGSNQRFIWVLRDADRGNVFGDSDDDESRHARFLREFTRETEGTGLVITGWAPQLEILAHGATAAFLSHCGWNSTVESLSHGKPILAWPMHSDQPWDAELVCKYLKAGYLVRPCEKHAEVIPAAAIQAVIERLMVSDDGLPVRQRATAIGEAVRASAADGGSSSKDLENFIAHIVR

SEQ ID NO: 18410 - DNA, 1395 bp, Sorghum bicolor
  misc_feature: Ceres ANNOT ID no. 8702277
  misc_feature: Encodes the peptide sequence at SEQ ID NO 18411
atggagtcagtcgccgtcgtagcggtgccgttcccggcgcagggccacctgaaccagctcctgcacctgtcgctgcagctcgcgtcgcggggcctgcccgtgcactacgcggcgcccgcggcgcaggtccgccaggcccgcgcgcgtgtgcacggctgggacgagaccgcgctccgctccgtcgagttccacgacctcggcatctccgagtacgtctccccgccgcccgacccgaccgcgccgtcgccgttccccacgcacctcatgcccctgttcgaggcctacaccgccggggcgcgcgccccgctcgcggcgctcctcgccaggctctccgcctcgcaccgccgcgtcgtcgtggtgcacgaccgcatcaacgcgtacgccgccgaggaggccgcgcggctgcacaacggcgaggcgttcgggctgcactgcctggcggcgtcgacgctcgccgggaagacggacgccgggctccggctcctgcgtgagcgtggcctggcgttcctcgacgtcgcccaccacgcgtcgagggagttcgcggactacgtcgccaaacgcgcgatgccgaccaaggacatctcgcctggcgcgggcatcctcgtgaactcatgtcgcgcgctcgagggcgagttcatcgacgtcgttgcaggcgacctggccgccgacggcaagaagtatttcgccgtcgggcccttcaacccgctgctcgacctccgcgcggacgcccagacgcagagcaagccgcggcacgagtgcctggactggctggacaagcagcctccggcttcggtactctacgtgtcgttcggcacgacatcgtcgctgcggacagagcaaatcgcagagcttgcagcagcactgcgcgacagcgaccagcggttcatctgggtgctgcgcgacgcagaccgcggcaacgaatcggcggacgacggcgagagccagaacagacacgcggagctgctgtccaagttcaccgatcagacggaaggaaggggcagggtgatcaccgggtgggcgccgcagctggagatcctggcgcacggcgccacggcggccttcatgagccactgcggctggaactcgacgatggagagcctgagcaacgggaagcctatccttgcctggcccatgcactccgaccagccgtgggatgcggagctcgtgtgcaagtatctcaacgccgggatcctggtgaggccatgggagaagcacggtgaggtgattccggcggaggtcatcagacaagtcatcgaggacgccatgctttctgaccaaggagtggcggtgcggcagcgagcgaaggtgctcggagaggccgtccgtgcctgcctggctgacggcggctcatcgcgcaaagaccttgacgatttcattgctcatatcacaaagtaa

SEQ ID NO: 18411 - protein, 464 aa, Sorghum bicolor
  misc_feature: The sequence is a functional homolog of SEQ ID NO 8 in US patent 7148405
  misc_feature: Ceres ANNOT ID no. 8702277
  misc_feature (1)..(464): SWISSPROT Homolog: EC 2.4.1.215 Cis-zeatin O-beta-D-glucosyltransferase
  misc_feature (5)..(464): Pfam ID: UDPGT Pfam Description: UDP-glucoronosyl and UDP-glucosyl transferase
MESVAVVAVPFPAQGHLNQLLHLSLQLASRGLPVHYAAPAAQVRQARARVHGWDETALRSVEFHDLGISEYVSPPPDPTAPSPFPTHLMPLFEAYTAGARAPLAALLARLSASHRRVVVVHDRINAYAAEEAARLHNGEAFGLHCLAASTLAGKTDAGLRLLRERGLAFLDVAHHASREFADYVAKRAMPTKDISPGAGILVNSCRALEGEFIDVVAGDLAADGKKYFAVGPFNPLLDLRADAQTQSKPRHECLDWLDKQPPASVLYVSFGTTSSLRTEQIAELAAALRDSDQRFIWVLRDADRGNESADDGESQNRHAELLSKFTDQTEGRGRVITGWAPQLEILAHGATAAFMSHCGWNSTMESLSNGKPILAWPMHSDQPWDAELVCKYLNAGILVRPWEKHGEVIPAEVIRQVIEDAMLSDQGVAVRQRAKVLGEAVRACLADGGSSRKDLDDFIAHITK

SEQ ID NO: 18412 - DNA, 1539 bp, Sorghum bicolor
  misc_feature: Ceres ANNOT ID no. 8702313
  misc_feature: Encodes the peptide sequence at SEQ ID NO 18413
atggtggacccggacgccccgtgccccacgcgtcatgcactggacgctagcgtgaacccggcatccgccccctctcggcgtcggagactgcgacccggcaaattcggtaatagaaacaggcgaccaatcaccaatggcaacgcgccggcggctcgacggcgtcggacaattcgggcaatcgcgcgatcccaacctccaagcagccgccgcggccacgcgagtctacttcctcgtccgttcatccccaccgaacctgccagtgaactgcaaacctacctacccccggtcgccggtcacgggtctccgcccagactacaaatggagctccgcacctgcgcggcccccagttctgcgtccctctcttccggccgtggcgcggtgccatcctcgcgcctcctttcccgtcaaatttggagccgatcggcatactgcactgtctcctccacctcatcaagccctgttgctagaaggagccggttctccactctgatggcgactgcatacaacacagggaccccggacctagctgacttcaattgggatgctcttgggtttcaactgatcccaacggacttcatgtatttaatgagctgttcttcagaaggggtgttcacaaatggtaaattggtgccgtatgggccaattgagctgaatccagcagccgctgtgctgaattatggtcagggattgcttgaaggtctacgagcacatagaaaagaggatggatcaattcttctttttcgtccacatgaaaatgcactgcggatgaaaactggtgcagatcggttatgcatgcctgcaccaagtgtagagcaattcctagaagctgtgaagctaactgttctggcaaacaagcattgggtgcctccttttggtaaaggttctttgtatatcagaccacagctaattggaagtggggctatccttggtgtggcacctgccccacagtacacattcattgtgtttgtttgcccagttgggcattatttcaaggatggtttatctccaatcagcttgttaactgaggaagaataccaccgtgctgcacctggtggaactggtgatataaagactattgggaactatgcttcggttgttagtgctcagagaagagccaaggagaaaggccattctgatgttttatacctagatccaatccataataagtttgttgaggaagtttcttcttgtaatatattcatggtgaaggacaatgttatttctactccactgttaacgggaacaattctccctggaatcacaaggagaagtgtgattgaaatttctcaaaatcttggatttcaggttgaggagcgtccaatcacaatagatgaactgcttggggctgatgaagtcttttgtacaggaacagctgttgtagtgtcacctgttgggagcatcacttaccgtggaagaagagtggagtatgggaagaaccaggaggccggagccgtgtctcagcaactctacgccgcattcacagctatccagaaaggtgtcacggaggacagaatgggatggacgttgcagctagcttag

SEQ ID NO: 18413 - protein, 512 aa, Sorghum bicolor
  misc_feature: Useful for making plants with modulated nitrogen use efficiency
  misc_feature: Functional homolog of the protein sequence given in SEQ ID NO 13131
  misc_feature: Ceres ANNOT ID no. 8702313
  misc_feature (170)..(512): SWISSPROT Homolog: EC 2.6.1.42 Branched-chain-amino-acid transaminase
  misc_feature (206)..(494): Pfam ID: Aminotran_4 Pfam Description: Aminotransferase class IV
MVDPDAPCPTRHALDASVNPASAPSRRRRLRPGKFGNRNRRPITNGNAPAARRRRTIRAIARSQPPSSRRGHASLLPRPFIPTEPASELQTYLPPVAGHGSPPRLQMELRTCAAPSSASLSSGRGAVPSSRLLSRQIWSRSAYCTVSSTSSSPVARRSRFSTLMATAYNTGTPDLADFNWDALGFQLIPTDFMYLMSCSSEGVFTNGKLVPYGPIELNPAAAVLNYGQGLLEGLRAHRKEDGSILLFRPHENALRMKTGADRLCMPAPSVEQFLEAVKLTVLANKHWVPPFGKGSLYIRPQLIGSGAILGVAPAPQYTFIVFVCPVGHYFKDGLSPISLLTEEEYHRAAPGGTGDIKTIGNYASVVSAQRRAKEKGHSDVLYLDPIHNKFVEEVSSCNIFMVKDNVISTPLLTGTILPGITRRSVIEISQNLGFQVEERPITIDELLGADEVFCTGTAVVVSPVGSITYRGRRVEYGKNQEAGAVSQQLYAAFTAIQKGVTEDRMGWTLQLA

SEQ ID NO: 18414 - DNA, 867 bp, Sorghum bicolor
  misc_feature: Ceres ANNOT ID no. 8702314
  misc_feature: Encodes the peptide sequence at SEQ ID NO 18415
atggaggggaaggaggaggacgtgcgcctgggcgccaacaagtactcggagcgccagcccatcggcacggcggcgcagggcaccgacgacaaggactacaaggagcccccgccggcgccgctcttcgagcccggtgagctcaagtcgtggtccttctaccgcgcgggcatcgccgagttcgtcgccaccttcctcttcctctacatctccatcctcaccgtcatgggcgtctccaagtccacctcaaagtgcgccaccgtcggcatccagggcatcgcctggtcctttggcggcatgatcttcgccctcgtctactgcaccgccggcatctccggcgggcacatcaacccggcggtgaccttcgggctgttcctggcgaggaagctgtcgctcaccagggcggtcttctacatcatcatgcagtgcctgggcgccatctgcggcgcgggcgtcgtcaaggggttccagcaggggctgtacatgggcaacggcggcggcgccaacgtcgtcgcgccaggctacaccaagggcgacggcctcggcgctgagatcgtcggcaccttcgtcctcgtctacaccgtcttctccgccaccgacgccaagaggaacgccagggactcccatgtgccgatccttgctccgctcccaatcgggttcgcggtgttcctggtccacctggccaccatccccatcaccggcaccggcatcaacccggcgcggagccttggcgccgccgtcgtttacaaccagaaccatgcctggtctgaccactggatcttctgggtcggccccttcatcggcgctgccctggctgccatctaccaccaggtgatcatcagggccatcccgttcaagagcaggtcttaa

SEQ ID NO: 18415 - protein, 288 aa, Sorghum bicolor
  misc_feature: Useful for making plants with modulated water use efficiency
  misc_feature: Functional homolog of the protein sequence given in SEQ ID NO 14289
  misc_feature: Useful for making plants with modulated drought sensitivity
  misc_feature: Functional homolog of the protein sequence given in SEQ ID NO 14287
  misc_feature: Useful for making plants with modulated cold sensitivity
  misc_feature: Functional homolog of the protein sequence given in SEQ ID NO 14288
  misc_feature: Ceres ANNOT ID no. 8702314
  misc_feature (46)..(275): Pfam ID: MIP Pfam Description: Major intrinsic protein
MEGKEEDVRLGANKYSERQPIGTAAQGTDDKDYKEPPPAPLFEPGELKSWSFYRAGIAEFVATFLFLYISILTVMGVSKSTSKCATVGIQGIAWSFGGMIFALVYCTAGISGGHINPAVTFGLFLARKLSLTRAVFYIIMQCLGAICGAGVVKGFQQGLYMGNGGGANVVAPGYTKGDGLGAEIVGTFVLVYTVFSATDAKRNARDSHVPILAPLPIGFAVFLVHLATIPITGTGINPARSLGAAVVYNQNHAWSDHWIFWVGPFIGAALAAIYHQVIIRAIPFKSRS

SEQ ID NO: 18416 - DNA, 1602 bp, Sorghum bicolor
  misc_feature: Ceres ANNOT ID no. 8702320
  misc_feature: Encodes the peptide sequence at SEQ ID NO 18417
atgggcaactgcttcaccaagacgcacgagcaggagataccaatcaccacggacccgccgtatcggccgtcgtcgtcgatgccgcagtaccggccgccccacaaggcgcgggaggtgccgctgacctcgggctcgggtggctcgcgccggccgccgccgccgcggcttccggccttcccgtcgtcgggcacggggtcgatgggctcccggcgggcgcccgccggccagatcgggccgatcctgcagcggcccatggtggacgtgcgcacgctgttccacctggagcggaagctcgggagcgggcagttcgggaccacgtacctgtgcacggagcgcgcgacggggcgcaagtacgcgtgcaagtccgtgtccaagcgcaagctggtgcgccgcgccgacatcgacgacatgcgccgggagatcaccatcctgcagcacctcagcggccagcccaacgtggcggagttcaagggcgcgttcgaggacgccgacgacgtgcacgtcgtcatggagttctgctccggcggggagctcttcgaccgcatcacggccaagggcagctactccgagcgccaggccgccgccgtctgccgcgacatcctcaccgtcgtgcacgtctgccacttcatgggggtcatgcaccgggacctcaagcccgagaacttcctcctcgccagccccgccgacgacgcgccgctcaaggccatcgacttcggcctctccgtcttcatcgaagaaggtaaagtttacaaggacatcgtgggaagtgcgtactatgtggcgccagaggtactgcaccggaattacggcagagagattgatgtctggagtgctggcgtgatcctatacattcttctatgcgggtcaccgcctttctgggcagaaacggagaaaggcatatttgatgcaatattggccggcgaacttgatttaatctcctccccgtggccctccatatctgaaaatgcaaaggatctcattagaagaatgttgaacagggatcctcggaggcgcattactgcagtacaggccctagaacatccatggctcaaaggtggtgcacctgacagacctatcgatagcgcagtcctgtcaagaatgaagcaattcaaggcaatgaacaagctaaagcaacttgcactcaaggtaatcgcggagaacctaacagaagacgagatcaagggactgaagcagatgttcaacaacatggatacagacaagagtggcacgatcacagtcgaagaactgaaggaaggactgacaaaactagggtcaaagattagtgaagcggaggttcagaagcttatggaagcagttgacgtggacaagagtggcagcattgattacgcagagttccttactgccatgatgaataaacataaactggaaaaggaggaggatttgatccgtgcatttcaacactttgacaaagatgatagcgggtacataacaagagatgaactgcaacaagccatggcggagtatggaatcagtgatgaagcaagcattaaagaagtactagatgaagttgacaaagacaaggatgggagaatcgactatgaagagtttgtagaaatgatgaagaagggaagttatacctga

SEQ ID NO: 18417 - protein, 533 aa, Sorghum bicolor
  misc_feature: The sequence is a functional homolog of SEQ ID NO 2 in US patent 7084323
  misc_feature: Ceres ANNOT ID no. 8702320
  misc_feature (80)..(530): SWISSPROT Homolog: EC 2.7.11.1 Non-specific serine/threonine protein kinase
  misc_feature (92)..(350): Pfam ID: Pkinase Pfam Description: Protein kinase domain
  misc_feature (502)..(530): Pfam ID: efhand Pfam Description: EF hand
  misc_feature (395)..(423): Pfam ID: efhand Pfam Description: EF hand
  misc_feature (467)..(495): Pfam ID: efhand Pfam Description: EF hand
  misc_feature (431)..(459): Pfam ID: efhand Pfam Description: EF hand
MGNCFTKTHEQEIPITTDPPYRPSSSMPQYRPPHKAREVPLTSGSGGSRRPPPPRLPAFPSSGTGSMGSRRAPAGQIGPILQRPMVDVRTLFHLERKLGSGQFGTTYLCTERATGRKYACKSVSKRKLVRRADIDDMRREITILQHLSGQPNVAEFKGAFEDADDVHVVMEFCSGGELFDRITAKGSYSERQAAAVCRDILTVVHVCHFMGVMHRDLKPENFLLASPADDAPLKAIDFGLSVFIEEGKVYKDIVGSAYYVAPEVLHRNYGREIDVWSAGVILYILLCGSPPFWAETEKGIFDAILAGELDLISSPWPSISENAKDLIRRMLNRDPRRRITAVQALEHPWLKGGAPDRPIDSAVLSRMKQFKAMNKLKQLALKVIAENLTEDEIKGLKQMFNNMDTDKSGTITVEELKEGLTKLGSKISEAEVQKLMEAVDVDKSGSIDYAEFLTAMMNKHKLEKEEDLIRAFQHFDKDDSGYITRDELQQAMAEYGISDEASIKEVLDEVDKDKDGRIDYEEFVEMMKKGSYT

SEQ ID NO: 18418 - DNA, 4077 bp, Sorghum bicolor
  misc_feature: Ceres ANNOT ID no. 8702318
  misc_feature: Encodes the peptide sequence at SEQ ID NO 18419
atggcagcacttcttcctctgctgctcgcccacctactcctctgcgcccatggcgccaccgcgtcctcggccgcgacaccgccgcctctcccggtcctgcccgtcccgtcttacgcgcagctccggtggcagctctccgagatggcgctcttcctccacttcggccccaataccttcacggactccgagtggggcaccggccgcgccgacccctccgtgttcgccccctcggcactcgacgcgggccagtgggcgcgcgtcgcggcgcagggcgggttcggccgcgtcgtgctcacggccaagcaccacgacggtttctgcctctggccgtcggcgctgaccgactactcggtggccgcctcgccgtggcggggcggggctggggacgtcgtcgccgacctcgccgcagccgcgcgcgcggaggggatcgggctggggctgtacctctcgccgtgggaccgccatgagccggtgtacggggacaccatcgcgtacaacgagcattacttgggacagatgacggaactgctgaccaggtatggagatctagaggaaatttggctagatggtgcaaagggcgatgccaagaagatgaattatatgtttgatgcctggttttcacttatacatcagctacaacaaagggtagttatcttctcagatgctggaccagacactagatgggtgggagatgaggcaggagtcgcaggctatacttgctggtcccccttcaacaagagttccgtgacaattgggcataccattgctgaatactcacgcagtggggatccttttgggcaagactgggttcctgcagaatgtgatgtttccatcagaccaggttggttctggcatgcctcagagaaaccaaaaaatgcgacaactctgcttgacatatactacaaatcagttggtagaaattgtctcctcattttgaatgtccctcccaattcatctggcctcattgccaatgaagacatactagtccttcaggaattcactgggattcggcatgcaattttctcgcaaaactttgctgctaatgccactgtcacagcaaacagtgtgcgtggtgggcaagataatctgcagtttgcaccatccaaagtgcttgaagatggcatatactcctactgggctccacaggaaggtcaaacctgctgggaaatgctcttcgaccttgggcgatctacttccttcaacatgctccagctccaggagcctatacaactggggcagcgtgttattgagtttcatgtggctatcctcatagatgaactatggcaaacaattgttgaaggcacgacaatcggatacaagagactgcttctatttccagtcgttgaatctcggtacctgaagctttccatcgacagtgcacgcgcagatccacttatctcgttctttggtgtcttcatggatcccttctcgtccagacatagtttacagaatcatgtcaaaccaccccgcacaaacagtagcgacgttacaatgttgaggatggcccatgcttctgtcaacaagagtattgccgcaatactgaactatacattcgaaggcgtaactgattgtttacgtatccgtagcctgaaggcggaaaagtgccgctgccgctgccgccgccgccccagcccctcgctgccggcgaacatgtccgagcaggcgccaccttacgctcccctccccctcgtctcctcccttgccccagatcctagctctaccccgtcaccgaaccctacccttgtcctccccaatcctgtcttccccaacaagcgcaagcgcaccggattccgccgcaaagtaccctccggggcccccgccgcccatgccccctctcccgtggctccctcgcagccacctccccccgcctccgccgccgacgatatcatagtgatcaaccgtgagccgaccgcggaggccgtcaccgctctcaccgccggcttcccggcggactcgctcactgacgaggagatcgaggcgggcgttgtctccgacgttggcggcatcgagcaggtcaattacatcctcatccgcaaccacctcctctgccggtggcgcgagacctacaactcctggctcgccaaggagcccttcgcgacgctcatccctccccactgcgagcacctcctcaccgccgcctactccttcctcgtctcaaatagctacatcaatttcggcgtcgccccagccatcaaggagcgaatacccaaggagccaacgagacccaccaccgtcatcgtggtaggcgctggccttgctgggctagctgctgcacggcagctggtggcgttcgggttcaaagtgatcgtcctggaaggtcgcaaaaggtgtggtggccgtgtgtacactaagaagatggaaggcggtgggcgcatggctgctgctgaccttggcggcagcgtgcttaccgggacatttgggaacccgctaggaattgtggcgaagcaactcggcttgccaatgcacaaaattagagacaagtgtccactctaccggccggatggatcaccagttgatccagaggtggataagaacgtggagattacatttaacaagcttcttgacaaatcaagcaacctgcgggcatcaatgggggaggtggcagtggatgtttcacttggggcggctctagagacattgcgccaggctgatgggggcgtctctacacaggaggagatgaacttgttcaattggcatctcgcaaatcttgagtatgccaatgcaggattgctgtctagactaagccttgcgttctgggatcaggatgatccatatgacatgggtggggatcactgcttcttgcctggtggcaatggcaaacttgtgcaagccctggcagagaatgtagcaattgtttacgagaggacggtgcacactataaggtatggaggggatggggtgcaggtggttgtcaatggagggcaggtgtatgaaggggacatggcattgtgcacagttccacttggggttctgaaaaatggaggcatcaagtttgtaccggagttaccacagaggaagcttgatagtatcaagaggcttggtttcggattgttgaacaaggtatcaatgttgtttccacatgttttctggagtactgatcttgatacctttgggcatctggttgaagatccaaggcgacgtggggagttctttctgttctatagctatgcaacagtggctggtggtccattgttgatggccttggttgctggtgaagctgcccacaattttgaaaccacgccaccaactgatgctgtcagctcagttctccagatactaagaggtatctatgaaccacaagggattgaggtgccagaccctctacagagtgtttgcactagatggggcactgactcgttcagtctaggttcatactctcatgtcgctgtgggggcctctggagatgactatgacatattagccgaaagtgttggtgatggccgtcttttctttgctggtgaggctaccacgaggcgttatccagcaacaatgcatggtgcttttatcagtggtttgcgggaggctgctaacatgacactgcatgccaatgcccgggcagcaaaaaataaagtagacaaaagtccatcgacaaacacacaggcgtgtgctgctatattaacggacttgtttaggcaaccagatttggagtttggaagcttctccgttatttttggaggaaaagcttctgatccaaaatccccagctattctaaaggtggaattaggtgcgtcacggaagaaaaatgcagctgaaggggtaaagacggaacagaaccactcaaacaaattgttgtttcagcagctccagtcacactttaaccagcaacaacagctttatgtttacacattgctatcacgacagcaagctatggagttaagggaggtcagaggaggcgatgacatgaggttgcactacctctgtgaaaaactgggggtgaaattagttggcaggaaaggccttggtcctggggcagatgctgtaattgcatctattaaggcagaacgtaacagaggtcgaactagacctggcccctcaaagctgaaaaaatctctgaagcctaatgttgctgcatcatga

SEQ ID NO: 18419 - protein, 1358 aa, Sorghum bicolor
  misc_feature: Useful for making plants with modulated flowering time
  misc_feature: Functional homolog of the protein sequence given in SEQ ID NO 13356
  misc_feature: Ceres ANNOT ID no. 8702318
  misc_feature (37)..(487): SWISSPROT Homolog: EC 3.2.1.51 Alpha-L-fucosidase
  misc_feature (985)..(1180): SWISSPROT Homolog: EC 1.5.3.11 Polyamine oxidase
  misc_feature (752)..(1179): Pfam ID: Amino_oxidase Pfam Description: Flavin containing amine oxidoreductase
  misc_feature (633)..(725): Pfam ID: SWIRM Pfam Description: SWIRM domain
  misc_feature (7)..(381): Pfam ID: Alpha_L_fucos Pfam Description: Alpha-L-fucosidase
MAALLPLLLAHLLLCAHGATASSAATPPPLPVLPVPSYAQLRWQLSEMALFLHFGPNTFTDSEWGTGRADPSVFAPSALDAGQWARVAAQGGFGRVVLTAKHHDGFCLWPSALTDYSVAASPWRGGAGDVVADLAAAARAEGIGLGLYLSPWDRHEPVYGDTIAYNEHYLGQMTELLTRYGDLEEIWLDGAKGDAKKMNYMFDAWFSLIHQLQQRVVIFSDAGPDTRWVGDEAGVAGYTCWSPFNKSSVTIGHTIAEYSRSGDPFGQDWVPAECDVSIRPGWFWHASEKPKNATTLLDIYYKSVGRNCLLILNVPPNSSGLIANEDILVLQEFTGIRHAIFSQNFAANATVTANSVRGGQDNLQFAPSKVLEDGIYSYWAPQEGQTCWEMLFDLGRSTSFNMLQLQEPIQLGQRVIEFHVAILIDELWQTIVEGTTIGYKRLLLFPVVESRYLKLSIDSARADPLISFFGVFMDPFSSRHSLQNHVKPPRTNSSDVTMLRMAHASVNKSIAAILNYTFEGVTDCLRIRSLKAEKCRCRCRRRPSPSLPANMSEQAPPYAPLPLVSSLAPDPSSTPSPNPTLVLPNPVFPNKRKRTGFRRKVPSGAPAAHAPSPVAPSQPPPPASAADDIIVINREPTAEAVTALTAGFPADSLTDEEIEAGVVSDVGGIEQVNYILIRNHLLCRWRETYNSWLAKEPFATLIPPHCEHLLTAAYSFLVSNSYINFGVAPAIKERIPKEPTRPTTVIVVGAGLAGLAAARQLVAFGFKVIVLEGRKRCGGRVYTKKMEGGGRMAAADLGGSVLTGTFGNPLGIVAKQLGLPMHKIRDKCPLYRPDGSPVDPEVDKNVEITFNKLLDKSSNLRASMGEVAVDVSLGAALETLRQADGGVSTQEEMNLFNWHLANLEYANAGLLSRLSLAFWDQDDPYDMGGDHCFLPGGNGKLVQALAENVAIVYERTVHTIRYGGDGVQVVVNGGQVYEGDMALCTVPLGVLKNGGIKFVPELPQRKLDSIKRLGFGLLNKVSMLFPHVFWSTDLDTFGHLVEDPRRRGEFFLFYSYATVAGGPLLMALVAGEAAHNFETTPPTDAVSSVLQILRGIYEPQGIEVPDPLQSVCTRWGTDSFSLGSYSHVAVGASGDDYDILAESVGDGRLFFAGEATTRRYPATMHGAFISGLREAANMTLHANARAAKNKVDKSPSTNTQACAAILTDLFRQPDLEFGSFSVIFGGKASDPKSPAILKVELGASRKKNAAEGVKTEQNHSNKLLFQQLQSHFNQQQQLYVYTLLSRQQAMELREVRGGDDMRLHYLCEKLGVKLVGRKGLGPGADAVIASIKAERNRGRTRPGPSKLKKSLKPNVAAS

SEQ ID NO: 18420 - DNA, 3534 bp, Sorghum bicolor
  misc_feature: Ceres ANNOT ID no. 8702335
  misc_feature: Encodes the peptide sequence at SEQ ID NO 18421
atggggtcgaggcggcggcggcaccaccaccacggccggtgggtggtgcccgccgtggcgccggccgcggcggcgttcgcagcggcggggttgctcttcctcgtcgtcgcgttccactgcttcctgtcgccgccgcaaagcgacggcggtggcggtggtgccagtggcagctcccgtgtcttccggcgcccgaacccgccgttcctgttgaacaagccagcggaggtgcgcagaaatgtaatcggcgccgtggatttcgctgttcccagcggtgggagcaagcttggggagcagctctgggagtcgaaggcggcgggcaacttcttcggctgcagcaacgccaccaagcaattcgccgatgccgaggctgtgaccaagtcggaccgttacttgatgatcgcgaccagcggcggactgaatcagcagcgaacagggatcatagatgctgtcgttgcagcccgcatactgaatgcaacacttgtcattccaaagctggatgaagaatccttctggaaagatgcgagcgactttgcagagatatttgatgttgattcattcatatcctcactctcgaatgatgtaaagatcgtacgacaagtacctgacaggaatgggaaaccaccttcgccatataagatgcgtattcctagaaagtgtactcctaaatgctatgagagccgagtgttgcctgctcttctaaagaagcatgttgttcagttaaccaaatttgactaccgattatcaaataagctagagactgatcttcaaaagcttaggtgtagagtcaattatcatgcactaaggtttacagacccaatcttcagaatgggtgaaatgcttgtccaaagaatgagggaaaaaagtgggcgcttcattgctcttcacctaagatttgagcctgacatgcttgcgttctctggttgctactatgggggtggagacattgagagaagagaacttggtgagattcgtaagaggtggaagaccctgcatgcaagcaaccctgacagagaacggcggcacggaaagtgccctctaacaccagaggaagtagggctcatgcttagggcattgggatttgggaaggacgtgcacctttatgttgcatcaggagatgtatatggaggcgaggagacactggcacctctgaaagcactcttcccaaactttcactcaaaggaaactctagcaaacaaggagttagctcctttcttaccatattcatctcgcatggctgctcttgattttattgtatgcgacaggagtgatgtttttgtgacaaacaacaatggcaacatggccagaatgttggctggtcgaaggagatattttgggcacaagaggaccataaggcccaacactaagaaactttactcattgtttctgaatcgaaccagcatgagttgggacacatttgcatctaaagttcagaccttccaaaagggattcatgggggagcccaatgagattaaactaggaagaggcgaattccatgagcatcctgcagattgcatttgtgcaaaatcgaagggaaaaactggacagagcaggcctcacctagttaaaggagctggagaagctgtggagagccactctattgatggggaacttgactggaaggatttggactacggagagcatacacccttgggcagggattcatctaatgaaacagaatcagatgatattcgtgttggtggatcagacattcctgaattggaggatatgatattggagacacatagaaacagctcaacaaagaagaaaggcctggaagagcttccttcagaaaagacaggagcagctgccgccggagctggaccagagagcttgcacactggtcaggcctcacgtgctatgagagggagggaggtcactggtgtgcaggacctcgcaggtcatcggctcgccgcccgcctcgctgcaaatcacgagggtgggctactgcctcaccagctctttaggacgtcgctcaccagtcagctccgcgcacaaggagaaggatgcaggtgtggggcttgcccactggggccgcgcgccactgagatctcgtgtcaccgccagccaccgagggccgcgcacagggctgggcgtcgccgagccccgaagggaggtgccgggcctgcccaccaggggccgcgcgccgccgagccccgacgccagccagcagccaccggggggcacacgccaaaaaggaaaacgcttgagccccggaaccttccttccctccagtcgctgctcctcttccacgtcctccccgcccgcctccacgccgcctccttcctctcccgacgccaccaccccacgctcgccggcgagccgctggagctcgggcccgccgtgtcccgcgccgtgacgcggcccgacgcggtagtgcgcgcggacggcgtcatccacggcgtggaccgcctcctggtcccgcgctccgtccaggacgccttcaaccgccgccgcagcctcgcgtcgtccatctccgtcgcgctccccacgggcgcccccgaggtggacccgcgcacgcaccgcctcctcaaaaaacccgccccgccgctgggtgccccgccggcgctccctgtctgggacgcgatggcacccggcccatccatcgcgccggcgccggcgccgggtccaggcaccgggacgcaccgcttcgacgggcacgggcaggtgaaggacttcatccagaccctcctcctctacggcgggtacaacgagctggccggcatcctcgtgaacctcacctcgctcgccaccgagatgggccgcctcgtctccgagggctacgtcctcaccgtgctggcccccaacgacgaggccatggcgcggctcaccacggaccagctcagcgagccggggtcgccggagtccacgatggcgccgccggacccgcggcgttggccgcgaacgcccgcgccgggagccgcaccgccttcccgcccactgtcacgcccgacagcgccaggatcaatggcaccggtggtagtagagctgatgacgacgacggccagggacctgcagctcgctgatgacacggctgctgctactcaccagcaagcacgcgtgcaccaggtgggagacgacgacgaggaaggcatcaagctggccatggcggcggcgccagcggccgaggcgttcgcggtgcaggagccaccggcggacgaggaggccttggcggagcggcaggcggaggtggcccggctcctggccgggttccggcggcacctcgaggaccggtccgcgcaccacctggggtacccgtacaacctggacttcgacttcgcctcgctggcgccgttcctgcagggcctctgcatcaacaacctcggcgaccccttcgtggagagcaactacggcgtgcactcccggccgctggaggtggcggtgctcgactggttcgcccgcctctgggacctcgtccccggcgactactggggctacgtcaccagctgcggctccgtgagatggcacagaagaagtaagcaatttcattttctacgggcatcagtgtcaaatggtttagccgttatccaccgttag

SEQ ID NO: 18421 - protein, 1177 aa, Sorghum bicolor
  misc_feature: Useful for making plants with modulated nitrogen use efficiency
  misc_feature: Functional homolog of the protein sequence given in SEQ ID NO 14347
  misc_feature: Useful for making plants with altered cell wall content and/or composition
  misc_feature: Functional homolog of the protein sequence given in SEQ ID NO 14044
  misc_feature: Ceres ANNOT ID no. 8702335
  misc_feature (1062)..(1151): SWISSPROT Homolog: EC 4.1.1.22 Histidine decarboxylase
  misc_feature (633)..(807): Pfam ID: Fasciclin Pfam Description: Fasciclin domain
MGSRRRRHHHHGRWVVPAVAPAAAAFAAAGLLFLVVAFHCFLSPPQSDGGGGGASGSSRVFRRPNPPFLLNKPAEVRRNVIGAVDFAVPSGGSKLGEQLWESKAAGNFFGCSNATKQFADAEAVTKSDRYLMIATSGGLNQQRTGIIDAVVAARILNATLVIPKLDEESFWKDASDFAEIFDVDSFISSLSNDVKIVRQVPDRNGKPPSPYKMRIPRKCTPKCYESRVLPALLKKHVVQLTKFDYRLSNKLETDLQKLRCRVNYHALRFTDPIFRMGEMLVQRMREKSGRFIALHLRFEPDMLAFSGCYYGGGDIERRELGEIRKRWKTLHASNPDRERRHGKCPLTPEEVGLMLRALGFGKDVHLYVASGDVYGGEETLAPLKALFPNFHSKETLANKELAPFLPYSSRMAALDFIVCDRSDVFVTNNNGNMARMLAGRRRYFGHKRTIRPNTKKLYSLFLNRTSMSWDTFASKVQTFQKGFMGEPNEIKLGRGEFHEHPADCICAKSKGKTGQSRPHLVKGAGEAVESHSIDGELDWKDLDYGEHTPLGRDSSNETESDDIRVGGSDIPELEDMILETHRNSSTKKKGLEELPSEKTGAAAAGAGPESLHTGQASRAMRGREVTGVQDLAGHRLAARLAANHEGGLLPHQLFRTSLTSQLRAQGEGCRCGACPLGPRATEISCHRQPPRAAHRAGRRRAPKGGAGPAHQGPRAAEPRRQPAATGGHTPKRKTLEPRNLPSLQSLLLFHVLPARLHAASFLSRRHHPTLAGEPLELGPAVSRAVTRPDAVVRADGVIHGVDRLLVPRSVQDAFNRRRSLASSISVALPTGAPEVDPRTHRLLKKPAPPLGAPPALPVWDAMAPGPSIAPAPAPGPGTGTHRFDGHGQVKDFIQTLLLYGGYNELAGILVNLTSLATEMGRLVSEGYVLTVLAPNDEAMARLTTDQLSEPGSPESTMAPPDPRRWPRTPAPGAAPPSRPLSRPTAPGSMAPVVVELMTTTARDLQLADDTAAATHQQARVHQVGDDDEEGIKLAMAAAPAAEAFAVQEPPADEEALAERQAEVARLLAGFRRHLEDRSAHHLGYPYNLDFDFASLAPFLQGLCINNLGDPFVESNYGVHSRPLEVAVLDWFARLWDLVPGDYWGYVTSCGSVRWHRRSKQFHFLRASVSNGLAVIHR

SEQ ID NO: 18422 - DNA, 1371 bp, Sorghum bicolor
  misc_feature: Ceres ANNOT ID no. 8702342
  misc_feature: Encodes the peptide sequence at SEQ ID NO 18423
atggggaactgcctcggctcggaggaggccgaactggtggaggtcgtgaagaactcgggccaccatggacagccccgagctccagccatggtggcggcacccaaatccgagggttccatgagctcatcagggcgccccagcagcagcaggtctcctggctcgtccatgaacagcagcgccaccacgacgggccgaagcggcagcaccagcaccagcagcggctcgaggcccctcgcgtccgccgccgccgccgacgcgtaccaccaggaggagcgggaggaggggaggatcctggagacgcccgacctccgcatcttcaccttcgcggagctccgggccgcgacgcgcaacttcaggccggacacggttctgggcgagggcgggttcgggcgggtgtacaagggctgggtcgacgagaagaccatgaacccgacgcgctccggcatcggcatggtggtcgccgtcaagaagctcaacccggagagcgtgcagggcgtgcaggagtggcagtctgaggtgaactttctggggaggctgtcgcatccgaacctggtgaggctgctgggctactgcgtggaggacagggatctcctcctcgtgtacgagtacatgcccaaaggcagcctggacaatcatctcttcagaaagggcggctccttcgaaccaatgtcgtggaaccttcggctgcgcatcgccattggcgccgcgcgtggcctcgccttcctccactcgtcggagaagcaggtgatctaccgagacttcaaggcctcaaacatcctcctcgacacgaattacaacgccaagctatccgacttcggtctcgccaagaatggcccgaccggcggcgacagccacgtcaccacccgggtcatgggcacgtacggctacgctgcgccggagtacgtcgccacagggcacctgtacgtgaagagcgacgtgtacggcttcggcgtggtgctgctggagatgctgacgggcctgcgggcgctggacacgggccgccccgcgcagcagcacaacctggtggagtgggccaagccgtacctggcggaccggcggaagctggcgcgcctcgtcgacccgcggctcgagggccagtacccgtccaaggcggcgctgcaggcggcccagctcacgctgcgctgcctcgagggggaccccaggagccggccctccatggcggaggtcgtgctggcactcgaggagatcgagcagctcaaggtgcggcccaagggcgcgccgcgggaccaccgggacgaagcagcgcggagcagccacggccacgggcggtcgtcgcgcccgaggtccgggtccgggtccggccgggcggggagcagcagccaccaccaccagtctccgagcatgaggtag

SEQ ID NO: 18423 - protein, 456 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8702342
  misc_feature (92)..(406): SWISSPROT Homolog: EC 2.7.11.1 Non-specific serine/threonine protein kinase
  misc_feature (118)..(400): Pfam ID: Pkinase Pfam Description: Protein kinase domain
MGNCLGSEEAELVEVVKNSGHHGQPRAPAMVAAPKSEGSMSSSGRPSSSRSPGSSMNSSATTTGRSGSTSTSSGSRPLASAAAADAYHQEEREEGRILETPDLRIFTFAELRAATRNFRPDTVLGEGGFGRVYKGWVDEKTMNPTRSGIGMVVAVKKLNPESVQGVQEWQSEVNFLGRLSHPNLVRLLGYCVEDRDLLLVYEYMPKGSLDNHLFRKGGSFEPMSWNLRLRIAIGAARGLAFLHSSEKQVIYRDFKASNILLDTNYNAKLSDFGLAKNGPTGGDSHVTTRVMGTYGYAAPEYVATGHLYVKSDVYGFGVVLLEMLTGLRALDTGRPAQQHNLVEWAKPYLADRRKLARLVDPRLEGQYPSKAALQAAQLTLRCLEGDPRSRPSMAEVVLALEEIEQLKVRPKGAPRDHRDEAARSSHGHGRSSRPRSGSGSGRAGSSSHHHQSPSMR

SEQ ID NO: 18424 - DNA, 900 bp, Sorghum bicolor
  misc_feature: Ceres ANNOT ID no. 8702374
  misc_feature: Encodes the peptide sequence at SEQ ID NO 18425
atggcggcggtggtggcgacgcagcagcagcagcgcaagtaccagtggggcgagctcgcggacgatgacggcgccagcgatctcggcctcgtcctcctcctcccgccgcgggtcgtcgtcgggcccgacgcgggcggcctccggacggtgatcgagtaccgcttcgacgacgagggcaacaaggtcaaggtcgtcaccaccacccgcacctgcagcctcctcgcgcgcgcgcgcctctccaggagcgccgtcgagcgccgctcgtgggccaagttcggcgacgccgtcaagggggacgacgccggctcgcgcctcaccatggtctccaccgaagaggtcctcctcgagcgcccacgagcccgagggaaaagggccgaggaaccatgtacttctgatgatccactggatatggcaagtacaagaagtggcattctcatggtttgccgaacatgtgggaaaaagggtgatcattggacctcgaagtgcccctacaaggacctttctccacagacccaaggtcctgtcgacgttccttctactgccgatggcctggcagcaccacttggtactggtgtgcgagcatatgttcctccaaacaagaaagaaggtactgatacaagtggagcaagcatgatgaagagaaggaatgatgaaaactctatccgtgtgaacaatctctcagaggacaccagtgagttcgacctctttgagctcttctccaagtttggccctgtaaaccgtgccttcgtagcaaaggacagaaggactggatcaagcaggggctttggctttgtcaacttcgttcatagagaggatggtgagagggctatcagcaagctcaatgggtatggttatgataaccttatcctccgagttgagtggtcagaaaagaagaactag

SEQ ID NO: 18425 - protein, 299 aa, Sorghum bicolor
  misc_feature: Useful for making plants with altered alkaloid content
  misc_feature: Functional homolog of the protein sequence given in SEQ ID NO 14575
  misc_feature: Ceres ANNOT ID no. 8702374
  misc_feature (218)..(296): SWISSPROT Homolog: EC 5.2.1.8 Peptidylprolyl isomerase
  misc_feature (221)..(292): Pfam ID: RRM_1 Pfam Description: RNA recognition motif. (a.k.a. RRM, RBD, or RNP domain)
MAAVVATQQQQRKYQWGELADDDGASDLGLVLLLPPRVVVGPDAGGLRTVIEYRFDDEGNKVKVVTTTRTCSLLARARLSRSAVERRSWAKFGDAVKGDDAGSRLTMVSTEEVLLERPRARGKRAEEPCTSDDPLDMASTRSGILMVCRTCGKKGDHWTSKCPYKDLSPQTQGPVDVPSTADGLAAPLGTGVRAYVPPNKKEGTDTSGASMMKRRNDENSIRVNNLSEDTSEFDLFELFSKFGPVNRAFVAKDRRTGSSRGFGFVNFVHREDGERAISKLNGYGYDNLILRVEWSEKKN

SEQ ID NO: 18426 - DNA, 2391 bp, Sorghum bicolor
  misc_feature: Ceres ANNOT ID no. 8702404
  misc_feature: Encodes the peptide sequence at SEQ ID NO 18427
atgagcttcggcgatctcctcgacggcggcgggtccgcggctggcgtgcagttcccgtacggcgtcttcgcgtcatcgccggccctctccctcgccgtggtggacgccgggcgccgccgcgacggcggcagcgctgcgcgggcgggctcgtcggcccgccgaggcggcggaggaaacgggaaggacgcgtcggaggcggagaacgagggccagtcgatggtgagcggacacctcgacgtcgtcttgtctggcggcggcgatggcgaggacgacgaggacggcgaggacgcgaacccgcgcaagcgcaagaggcggtacaaccgccacacgccgcatcagatcgcacggctcgaagcgatgttcaaggaattcccccacccggacgagaagcagcgcgcggagctgagcaagcagctgggcctggagccgcggcaggtcaagttctggttccagaaccggcgcacgaatgcgaaggagaacgcacggctgaagcaggagaacgacaagctgcgtgtcgagaacctgtccatccgggaggccatgagggacctggtgtgcagcggctgtggcggcccagcggtgctcggggacctgtcgctcgaagagcgccacctgcgcctcgagaacgcgaggctcagggacgagctcgctcgagtctgcaccctcactgccaagttcattggcaagcccatgtctcacatggaactgctcgcggtcgcggaggagccgcatcctatgccaggctcgtcactggaacttgcagttgctggtggtgttggttccggcgtcccatcgagcaaaatgcccgtctcgacgatctctgagttggctggcagcacatccagcgcaatgggaacagtgatcacgcccatggtgactgcatcattgccgatggttagcattgacaagtccaagttcgcccagcttgcagtgagtgcgatgaatgagcttgtcaagatggcgcagacgaatgaaccgctgtggattccaagcgcttcctcacctggctcgccaaccatggagactctaaacttcaaagagtacttgaaggcattcacgccgtgtgttggagtgaaacgtaatgggtttgtgtctgaggcctctagggagtccggcattgtcaccgttgacagtagcgctgctcttgtggaggccttcatggatgagagacgatggtcagacatgttctcctgcattgttgccaaggcagccaccattgaggagatctcacctggtgttgcaggaagcagaaatggtgcattgctgcttatgcaggcagaactacaagtgctttcacctcttgtccctataagggaggtaacatttcttaggttctgcaaacagcttgctgagagtgcatgggctgtagtggatgtttccattgatggactgcagatggatcactgcctcgctacaaacacgaaatgccggaggctgccttcaggttgcgtgttgcaagatacccccaatggatgcaaggtcacatgggttgagcatgctgaatatcctgaggcatccgtgcaccagctctaccagcctcttctgtgctctggtctcgcccttggtgcagggcggtggcttgcaacactgcaacgccagtgtgagtgtttggccatcctcatgtcatcgcttgcagtgccagagcatgactcagaagcggtttctctggaaggaaaacggagcttgttgaagttggcacggaggatgatggagaacttctgcgcagggatgagtgcgtcatcttcctgtgaatggagtatactggatggcttaacaggtagcatggggaaagatgtacgtgtcatggtacagaacagtgtggatgaacctggggtgccaccaggtgtggtgcttagtgttgccacagcagtatggttgcctgtgacacctgagcggctcttcaactttcttcgcgatgaggagctccgtgctgaatgggacatcctcagcaatggtggccctatgcagcagatgttacgcattaccaaggggcaactggatggcaactctgtaactctactgagagctgatcatacaaactcccacctgaacagcatcttgattctacaagagacgtgcactgacagatctggtgcaatggtcgtgtatgcccccgtggacttcccggcaatgcagcttgtgattggtggaggggactcaacgaatgtggcactcctgccatctggtttcgtcattctgcctgatgggtctagctctagcgctggtggggttgggcacaagacatgcggatcgctgctcacggttgcattccagatccttgtgaacagccagcccacagcaaagctcacggtggagtcagtggacaccgtgtacaacctcatctcttgtaccatcgagaagatcagggcggcacttcactgtgacatctga

SEQ ID NO: 18427 - protein, 796 aa, Sorghum bicolor
  misc_feature: The sequence is a functional homolog of SEQ ID NO 92 in the 10/666,642 US patent application
  misc_feature: The sequence is a functional homolog of SEQ ID NO 130 in the 10/666,642 US patent application
  misc_feature: The sequence is a functional homolog of SEQ ID NO 2670 in the 10/374,780 US patent application
  misc_feature: The sequence is a functional homolog of SEQ ID NO 334 in the 10/225,066 US patent application
  misc_feature: The sequence is a functional homolog of SEQ ID NO 666 in the 11/435,388 US patent application
  misc_feature: The sequence is a functional homolog of SEQ ID NO 244 in the 10/412,699 US patent application
  misc_feature: The sequence is a functional homolog of SEQ ID NO 424 in the 11/435,388 US patent application
  misc_feature: The sequence is a functional homolog of SEQ ID NO 519 in the 11/479,226 US patent application
  misc_feature: The sequence is a functional homolog of SEQ ID NO 58 in the 10/286,264 US patent application
  misc_feature: The sequence is a functional homolog of SEQ ID NO 2324 in the 10/374,780 US patent application
  misc_feature: The sequence is a functional homolog of SEQ ID NO 246 in the 10/412,699 US patent application
  misc_feature: The sequence is a functional homolog of SEQ ID NO 522 in the 11/479,226 US patent application
  misc_feature: The sequence is a functional homolog of SEQ ID NO 596 in the 11/435,388 US patent application
  misc_feature: The sequence is a functional homolog of SEQ ID NO 716 in the 10/225,066 US patent application
  misc_feature: The sequence is a functional homolog of SEQ ID NO 80 in the 10/286,264 US patent application
  misc_feature: Ceres ANNOT ID no. 8702404
  misc_feature (308)..(536): Pfam ID: START Pfam Description: START domain
  misc_feature (103)..(159): Pfam ID: Homeobox Pfam Description: Homeobox domain
MSFGDLLDGGGSAAGVQFPYGVFASSPALSLAVVDAGRRRDGGSAARAGSSARRGGGGNGKDASEAENEGQSMVSGHLDVVLSGGGDGEDDEDGEDANPRKRKRRYNRHTPHQIARLEAMFKEFPHPDEKQRAELSKQLGLEPRQVKFWFQNRRTNAKENARLKQENDKLRVENLSIREAMRDLVCSGCGGPAVLGDLSLEERHLRLENARLRDELARVCTLTAKFIGKPMSHMELLAVAEEPHPMPGSSLELAVAGGVGSGVPSSKMPVSTISELAGSTSSAMGTVITPMVTASLPMVSIDKSKFAQLAVSAMNELVKMAQTNEPLWIPSASSPGSPTMETLNFKEYLKAFTPCVGVKRNGFVSEASRESGIVTVDSSAALVEAFMDERRWSDMFSCIVAKAATIEEISPGVAGSRNGALLLMQAELQVLSPLVPIREVTFLRFCKQLAESAWAVVDVSIDGLQMDHCLATNTKCRRLPSGCVLQDTPNGCKVTWVEHAEYPEASVHQLYQPLLCSGLALGAGRWLATLQRQCECLAILMSSLAVPEHDSEAVSLEGKRSLLKLARRMMENFCAGMSASSSCEWSILDGLTGSMGKDVRVMVQNSVDEPGVPPGVVLSVATAVWLPVTPERLFNFLRDEELRAEWDILSNGGPMQQMLRITKGQLDGNSVTLLRADHTNSHLNSILILQETCTDRSGAMVVYAPVDFPAMQLVIGGGDSTNVALLPSGFVILPDGSSSSAGGVGHKTCGSLLTVAFQILVNSQPTAKLTVESVDTVYNLISCTIEKIRAALHCDI

SEQ ID NO: 18428 - DNA, 1704 bp, Sorghum bicolor
  misc_feature: Ceres ANNOT ID no. 8702423
  misc_feature: Encodes the peptide sequence at SEQ ID NO 18429
atgacgtcgtgcgcgggagacgccacggtggcgtgcagggatgacgcgcggccgcacggggacgcggcctgcggcgtctcctgccccttgctcgccaagcccgctggggaggtccacatcccggtggccggcgaagacgcgcctgccgtgcccgtgctcacgaccaagtcgcccgggcggctcgccaccgcggtgaaggaggccctgttcgtattcctgggcatggcgttcccgaagacgcccgtggtgtcgtccagcgacgcgcgtggcgaggcgcggtcgattcttggcctcgcgctcccgatgattctgacgggcctcctcctctacctccgctccatgatttcgatgctcttcctcggtcgtctcggcggcctggcgctcgccggcgggtcactcgccatcggcttcgccaatatcactgggtattccgtgctctccggcctcgccatgggcatggaacccatatgcggccaggcattcggcgcgggcaacttctcgctgctcggaatcaccatgcagaggacggtgctgctgctcatcgccgcggccgttcccatcggtggcctctggatgcacatgcggcctctcctcctcctctgcggccaggacaccggcatcgcggcggtcgccgagacctacattctggcgtcgctcccggacctcgtcctccaggcgttcatccaccccgtgcggatatacctccgggcgcagtccatcaacctgccgctcacggtctgcgccgcgctcgccattgccatccacctccccatcaactacgtcctcgtcaccgtcctcggcctcggcatcagaggggtggcattcgcctccgtgctggcgaacctgaacctcctactcttcctcctcggctacatcttcttcatgggcgtccacaggcgcaccggcggcttcgtgctctcccgcgagagcttccgcggctggggcgagctcgccagcctcgcgctgccgagctgcgtcagcgtctgcctcgagtggtggtggtatgagatcatgatcctgctgtgcggcctgctgctgaacccgcaggcaacggtggcgtccatgggcatcctgatccagaccacgtcactcatctacatcttcccttcctccctcagcttcggcgtgtccacccgcgtcagcaacgagctgggcgcgaaccggcccgaggacgcgagccgcgccgccacggtggggctcatgctgggcttcgccttcggcggcttggcgtccgcgttcgcgttcgcggtgcggaacgtgtgggcgagcatgttcacggccgacccggcgatcatcgcgctcaccgcgtcggtgctgcccgtcctgggcctgtgcgagctcggcaactgcccgcagacgacgggctgcggcgtgctgcgcggcagcgccaggcccaaggacgccgccagcatcaacctccggtccttctacctcgtgggcacgccggtggcgctcgtcctggccttctggctccactacgacttcaagggcctctggttcgggctcctggcggcgcaggccacctgcatggtgcgcatgctgctggtcatcggccgcacggactgggcgagcgaggccaagcgctcgaggcagctcaccggagccaaggacagcgacgacaaggctggcggagacgagaagtcgcgcttgttgcttggcgacacggacatggagaaagccaatgctcactctgatcagtgttga

SEQ ID NO: 18429 - protein, 567 aa, Sorghum bicolor
  misc_feature: Useful for biocontainment applications
  misc_feature: Useful for making plants with modulated biomass
  misc_feature: Functional homolog of the protein sequence given in SEQ ID NO 14422
  misc_feature: Ceres ANNOT ID no. 8702423
  misc_feature (323)..(486): Pfam ID: MatE Pfam Description: MatE
  misc_feature (101)..(261): Pfam ID: MatE Pfam Description: MatE
MTSCAGDATVACRDDARPHGDAACGVSCPLLAKPAGEVHIPVAGEDAPAVPVLTTKSPGRLATAVKEALFVFLGMAFPKTPVVSSSDARGEARSILGLALPMILTGLLLYLRSMISMLFLGRLGGLALAGGSLAIGFANITGYSVLSGLAMGMEPICGQAFGAGNFSLLGITMQRTVLLLIAAAVPIGGLWMHMRPLLLLCGQDTGIAAVAETYILASLPDLVLQAFIHPVRIYLRAQSINLPLTVCAALAIAIHLPINYVLVTVLGLGIRGVAFASVLANLNLLLFLLGYIFFMGVHRRTGGFVLSRESFRGWGELASLALPSCVSVCLEWWWYEIMILLCGLLLNPQATVASMGILIQTTSLIYIFPSSLSFGVSTRVSNELGANRPEDASRAATVGLMLGFAFGGLASAFAFAVRNVWASMFTADPAIIALTASVLPVLGLCELGNCPQTTGCGVLRGSARPKDAASINLRSFYLVGTPVALVLAFWLHYDFKGLWFGLLAAQATCMVRMLLVIGRTDWASEAKRSRQLTGAKDSDDKAGGDEKSRLLLGDTDMEKANAHSDQC

SEQ ID NO: 18430 - DNA, 1926 bp, Sorghum bicolor
  misc_feature: Ceres ANNOT ID no. 8702418
  misc_feature: Encodes the peptide sequence at SEQ ID NO 18431
atggcggtgggcgcgaccgccacgaagctgcacctctcgtcggcggccgcggccgcgcgccgcccctcgctgctccacctcgcggccgtcgccgtcctctgctcggtgtcctacctcctcggcatctggcaccacggcggcttctccgcgggccccgccgccgccggcggcggcgtctcctcctcggtctccatcgccaccgccgtctcgtgcgccaccccagccctgacgaccgcctcctcgtctccccccgcggggccgctcgacttcgccgcgcaccacacggcggaggggacggaggcggaggccgcgctccgccaccgcagctacgaggcgtgccccgccaaatactccgagtacacgccctgcgaggacgtggagcgctccctgcggttcccgcgcgaccgcctcgtctaccgggagcgccactgccccgcggacggcgagcgcctccggtgcctcgtgccggcgcccaagggctaccgcaacccgttcccgtggccggccagccgcgacgtcgcctggttcgccaacgtgccgcacaaggagctcagcgtcgagaaggcggtgcagaattggatccgcgtcgacggcgacaggttccgcttccccgggggcggcaccatgttccctcgcggcgccggcgcctacatcgacgacatcggcaagcttatccccctccacgacggatccatccgcaccgcccttgacaccggctgcggggtggcgagctggggagcctacttgctgtcacgcaacatccttgccatgtccttcgctccgcgagactcccacgaggcgcaggttcagtttgcactagagcgtggtgtgccggcgatgattggtgtccttgcctccaatcggctcacctatccggcacgttcctttgacatggcgcactgctctcgctgcctcatcccatggcaactttacgatgggctatacttgatagaggttgatcgtatcctaaggcctggaggttattggattttgtctggaccaccaatcaactggaagaaacactggaaggggtgggacaggactaaagaagacctggatgcagagcagaaagccattgagtcagttgccaagagcctctgctggaagaagatcaaggaggagggcgacattgcaatctggcagaagcctactaaccacattcattgcaaggccatccacaaagttatcaagtccccgcccttctgttctaaccaaaacccagatgctgcctggtatgacaagatggaagcgtgtataactccactcccagaggtcagtgacttgaaggaggttgccggcggtgcgttgaagaaatggccggagaggctaactgcagtgccgccccggattgccagtggcagcatcgagggggtcacggaagagatgtttgtggaagatactgagttatggaagaagagagttgggcactacaagtccgtgattgctcaactcggccagaaaggccggtaccgcaacttactggatatgaatgcaaagtttggcggcttcgctgcggcattggtaaatgaccccttgtgggtcatgaacatggtccctactgtggggaactcaacaacccttggggttatatacgagcgtggcctcattgggagctaccaggactggtgtgagggcatgtccacttacccccggacctacgacctcattcatgcagattcagtgttcacactgtacaatggcagatgtgaggcggagaacattctgctcgaaatggacagaattctgaggcctgagggcacggtcatcatcagagatgacgtggatctgttagtgaagataaagagcatcacggacgggatgagatggaatagccagatcgtggatcacgaagatggtccgctcgtccgcgagaagctcctccttgttgtgaagacatactggactctcgatgacaacaaacaatag

SEQ ID NO: 18431 - protein, 641 aa, Sorghum bicolor
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: The sequence is a functional homolog of SEQ ID NO 1593 in the 11/479,226 US patent application
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 758 in the 10/412,699 US patent application
  misc_feature: Useful for making plants with altered cell wall content and/or composition
  misc_feature: Functional homolog of the protein sequence given in SEQ ID NO 13686
  misc_feature: The sequence is a functional homolog of SEQ ID NO 560 in the 10/412,699 US patent application
  misc_feature: Ceres ANNOT ID no. 8702418
MAVGATATKLHLSSAAAAARRPSLLHLAAVAVLCSVSYLLGIWHHGGFSAGPAAAGGGVSSSVSIATAVSCATPALTTASSSPPAGPLDFAAHHTAEGTEAEAALRHRSYEACPAKYSEYTPCEDVERSLRFPRDRLVYRERHCPADGERLRCLVPAPKGYRNPFPWPASRDVAWFANVPHKELSVEKAVQNWIRVDGDRFRFPGGGTMFPRGAGAYIDDIGKLIPLHDGSIRTALDTGCGVASWGAYLLSRNILAMSFAPRDSHEAQVQFALERGVPAMIGVLASNRLTYPARSFDMAHCSRCLIPWQLYDGLYLIEVDRILRPGGYWILSGPPINWKKHWKGWDRTKEDLDAEQKAIESVAKSLCWKKIKEEGDIAIWQKPTNHIHCKAIHKVIKSPPFCSNQNPDAAWYDKMEACITPLPEVSDLKEVAGGALKKWPERLTAVPPRIASGSIEGVTEEMFVEDTELWKKRVGHYKSVIAQLGQKGRYRNLLDMNAKFGGFAAALVNDPLWVMNMVPTVGNSTTLGVIYERGLIGSYQDWCEGMSTYPRTYDLIHADSVFTLYNGRCEAENILLEMDRILRPEGTVIIRDDVDLLVKIKSITDGMRWNSQIVDHEDGPLVREKLLLVVKTYWTLDDNKQ

SEQ ID NO: 18432 - DNA, 1440 bp, Sorghum bicolor
  misc_feature: Ceres ANNOT ID no. 8702455
  misc_feature: Encodes the peptide sequence at SEQ ID NO 18433
atggcgctggtccgccccgagcatccaaatccggccgcccgccgcccgcggctcgtcgtgctcctcctgctcgccttcttcgcccttcagctcctcgtcttcctcgctttccgagccgtgcgacctcctcccgccacagcctccgccgccgccgccgccgctgtgccggtgctggcgtcggcgccgacccgcagagacgagaatgattcgagctgcggcggcgggctcgtgtacgtctacgacctccccgcggccttcaacgaggacctgctcgggatgtgcgacgcgctggcgcccatgtactcgctgtgcccctacctcgccaacgacgggctcgggttccctgcgggcgggaccaacctgtcgtcgctcctgccgcagcagctgctcgggtcgtggtacgcgtccgaccagttcgcgctggagcacatcgtgcaccgccgcctgctctcccaccgctgccgcacgacggaccctgcgcgcgccgcggcgttcttcgtgccattctacgcggggctcgccgtgggccgccacctgtgggcggccaacgccaccggcgccgacagggacagggactgcgtcgcgctgctgtcgtggctccacgcgcagccgtggtaccggcgatcccacggctgggaccacttcatcgcgctgggccgcatcacgtgggacttccgccgcacgacgggcgccgggtggggcagcggcttcctcaccatgcccggggtggccaacgtcacccgcctcgtcatcgagcgcgacccctgggacggcatggacgtcggcatcccgtacccgaccgggttccacccgctcaccgccgccgacgtgtgcgcgtggcagcggtacgtcgcgcggcgcccgcggcccaggctcttcgccttcgccggcgcgccgcggtcggccatcaagggcgacttccgcgcgctgctgctggaggagtgccaggcggccggggacgccgcctgcggcgcgctggactgcgccgagggcaggtgcatcaagaacaacgcgctcgtcatggagctcttcatgggcgccaggttctgcctgcagccgcgcggggacagcttcacgcggcggtcgctgttcgactgcctggtggcgggcgccgtccccgtgctgttctggcggcggagcgcgtacgagcagtacgggtggtacctgcccgtggacgggcgcgaggcggagtggtccgtgttcatcgaccgcgaccagctccgcgcggggaacctcacggtgcgcggcgtgctggcggctatcccggactcgcgggtgcggctgatgcggaagcgcgtggtgaagatgatcccggggctggtgtacgccgcggcggacggggagggcctcggcggcggcatgaaggacgccgtggacgtcatggtcgacggcatgctgcggcgtgtcgccgagcagcgtccgagatggcggacgacgtga

SEQ ID NO: 18433 - protein, 479 aa, Sorghum bicolor
  misc_feature: Useful for making plants with altered carbohydrate content
  misc_feature: Functional homolog of the protein sequence given in SEQ ID NO 14628
  misc_feature: Ceres ANNOT ID no. 8702455
  misc_feature (77)..(433): Pfam ID: Exostosin Pfam Description: Exostosin family
MALVRPEHPNPAARRPRLVVLLLLAFFALQLLVFLAFRAVRPPPATASAAAAAAVPVLASAPTRRDENDSSCGGGLVYVYDLPAAFNEDLLGMCDALAPMYSLCPYLANDGLGFPAGGTNLSSLLPQQLLGSWYASDQFALEHIVHRRLLSHRCRTTDPARAAAFFVPFYAGLAVGRHLWAANATGADRDRDCVALLSWLHAQPWYRRSHGWDHFIALGRITWDFRRTTGAGWGSGFLTMPGVANVTRLVIERDPWDGMDVGIPYPTGFHPLTAADVCAWQRYVARRPRPRLFAFAGAPRSAIKGDFRALLLEECQAAGDAACGALDCAEGRCIKNNALVMELFMGARFCLQPRGDSFTRRSLFDCLVAGAVPVLFWRRSAYEQYGWYLPVDGREAEWSVFIDRDQLRAGNLTVRGVLAAIPDSRVRLMRKRVVKMIPGLVYAAADGEGLGGGMKDAVDVMVDGMLRRVAEQRPRWRTT

SEQ ID NO: 18434 - DNA, 1290 bp, Sorghum bicolor
  misc_feature: Ceres ANNOT ID no. 8702457
  misc_feature: Encodes the peptide sequence at SEQ ID NO 18435
atggccgcctcccaccacctaatcctcctagtcctctgcctcaccgccgccgcggcctccgcccacaacatcacggccatcctggacgggcgctccgagtacacgctgtacaacagctacctctcccagaccaaggtgtgcgacgagatcaacagccggagctcggtcaccgtcctcgtcctcaccaacggcgccatgtcctccctcgtcgccaacctctccctcgccgacatcaagaacgcgctccgcctcctcaccctcctcgactacttcgacgagaagaagctccactccatcggctccagctcccagctcaccacctcgctctaccagaccacgggccaggccgcaggcgacatgggccacgtcaacatcaccgacctccgcggcggcaaggtcgccttcgcctccgccgcgccaggcgccaagttccagtccacctacaccaagcgcgtcgccgacttcccgtccaacctctccgtcctcgaggtctccgaccccatcaccttccctggcctcttcggctccccgtccgcctcgtccgccaacatcaccgacctcctcgagaaggccgggtgcaagcagttcgcgcgcctcatcgtctcgtccggggtcgtcaagacgtaccaggccgccatggacaaggggctcaccctgttcgcgcccaacgacgacgcgttcaaggctaaggacctgcccgatctgagcaagctcaccagcgccgacctcgtcgcgctactgcagtaccacgcgctgccgcagtacgcgcccaaggcgtcgctcaaggtcgccagcggccgcatcccgaccctcgcctctaccggcgcggggaagtacgacctcaccgtcgcctccagcggcgacgaagtgtccctggacaccggcgtggacaagtcccgcgtcgcgtccaccgtgctcgacgaccccccgacggtcatcctcacggtcgacagcgtgctgctcccgcacgtgatcttcggcggcgcgccgtcccccgcgccggcgcccggaccggccgccgacgtgcccgcttcggccccggctcccgaaggctccgcaccggcgcccactcccaaggccgccggcaagaagaagaagaagaaggccaagtccccttcgcactccccgcccgcgccgccggcggactcgcccgacttggcccccgccgacgcgccagacgatgacgccgcggacaaggtcgaatctaaaaagaacggcgccgccgcagcggccgtgagcttcgtggcctcggtggcctctgccggcctggccgtcgcgctccttttgtga

SEQ ID NO: 18435 - protein, 429 aa, Sorghum bicolor
  misc_feature: Useful for making plants with altered carbohydrate content
  misc_feature: Functional homolog of the protein sequence given in SEQ ID NO 14629
  misc_feature: Useful for making plants with altered cell wall content and/or composition
  misc_feature: Functional homolog of the protein sequence given in SEQ ID NO 14630
  misc_feature: Ceres ANNOT ID no. 8702457
  misc_feature (192)..(322): Pfam ID: Fasciclin Pfam Description: Fasciclin domain
MAASHHLILLVLCLTAAAASAHNITAILDGRSEYTLYNSYLSQTKVCDEINSRSSVTVLVLTNGAMSSLVANLSLADIKNALRLLTLLDYFDEKKLHSIGSSSQLTTSLYQTTGQAAGDMGHVNITDLRGGKVAFASAAPGAKFQSTYTKRVADFPSNLSVLEVSDPITFPGLFGSPSASSANITDLLEKAGCKQFARLIVSSGVVKTYQAAMDKGLTLFAPNDDAFKAKDLPDLSKLTSADLVALLQYHALPQYAPKASLKVASGRIPTLASTGAGKYDLTVASSGDEVSLDTGVDKSRVASTVLDDPPTVILTVDSVLLPHVIFGGAPSPAPAPGPAADVPASAPAPEGSAPAPTPKAAGKKKKKKAKSPSHSPPAPPADSPDLAPADAPDDDAADKVESKKNGAAAAAVSFVASVASAGLAVALLL

SEQ ID NO: 18436 - DNA, 1707 bp, Sorghum bicolor
  misc_feature: Ceres ANNOT ID no. 8702454
  misc_feature: Encodes the peptide sequence at SEQ ID NO 18437
atgcccgagtcaccggcatctccgggcaagcccccctcgcagccgggatcgccgctcaatgccgccactccgttcccagcgtcggctttgctgcgaggctccgtgctgctcctcgccttcctcgtcctccagctcgtgctcttctggaacatcctcggcttccccagctcccgcttcctcccggcgccgggccacaggaacactacctggcccaacggcgcggtcaacggcggcgcgtgcgatgacgggctcatctacgtctacgacctcccgtcggagttcaaccacgacctcgtcgacgactgcgagagcctgtggccctggtactcgttctgcccgtacctagccaacggcggcttcggcgaggcggccgccacgctgcccgtcttcttcaacgtcacgcggaacgtgtcgctgcccagctggtacaacaccgaccagttccagctcgaggtcatcatccaccgccgcctcctctcgcacaggtgccgcaccaccgacccgtcgctggccaccgcgttctacgtcccgttctacgtcggcctcgacgtcggcagccacctgtggggggacaactccaccgctgccgaccgcgacagggcgggcttgaggctgctccggtggctcaacaaccagacgtccttccagaggtccggcggctgggaccacttcatcacgctggggcgcatcacgtgggacttccgccggttcggcgacgacgggtggggcaccaacttcgtggtcctccccgggatagccaacgtgacccgcctcggcatcgaggccgaccggctggaccccatggaagtcgccgtcccgtacccgaccggcttccacccgcgcaccgccgccgacgtgcgcgcgtggcagcggcacgtgctgtccctcaggcgcagcaagctcttcggcttcgccggcgcgccgcgctccgggttccgggacgacttcagggaggtgctgctggaggagtgcgaggacgccgggagcgagcactgccgttccgtggactgccgcggcacgcggtgcaccgacaacggcgcggcggtgctggagctgttcctggactcgagcttctgcctgcagccgcgcggggacagcttcacgcggcgctcgctgttcgactgcatggtggccggcgccgtgccggtgctgttctggcggcgcaccgcgtacgaccagtaccggtggtacctgccgccggggccggcgcgcggcgaggccgaggacgacggggagtggtccgtgttcatcgaccggcaggcgctgcgcgtgggcaacgtgagcgtgcgggacatcctggagggcctcagcgagcggcgagtgcggcggatgcgggagcgcgtggtggagatgatcccgcggctggtgtacgcgtcgtcgcccgacgggctcggcgacggcatggaggacgccctcgatgtggcgctgcgcggcgtgctggagcggttccgccggcgccgggcgagcactgcgcctcaaggcttttcagcaaagcgcccaccaggccgctccgtggcactggcacggcgtgtcgacaacaaatcgacgccggcgccggcgcctccttctgacggcaaaaatggatcggcagcggcggtgaatcagaacgcctcaggaacaaagccgagctctcctgcttcgtcgtacgtaaaacccgtcgtgtccaaagcatcggcttcaactggaaagagcttgcaaaaatcctga

SEQ ID NO: 18437 - protein, 568 aa, Sorghum bicolor
  misc_feature: Useful for making plants with altered carbohydrate content
  misc_feature: Functional homolog of the protein sequence given in SEQ ID NO 14628
  misc_feature: Ceres ANNOT ID no. 8702454
  misc_feature (85)..(448): Pfam ID: Exostosin Pfam Description: Exostosin family
MPESPASPGKPPSQPGSPLNAATPFPASALLRGSVLLLAFLVLQLVLFWNILGFPSSRFLPAPGHRNTTWPNGAVNGGACDDGLIYVYDLPSEFNHDLVDDCESLWPWYSFCPYLANGGFGEAAATLPVFFNVTRNVSLPSWYNTDQFQLEVIIHRRLLSHRCRTTDPSLATAFYVPFYVGLDVGSHLWGDNSTAADRDRAGLRLLRWLNNQTSFQRSGGWDHFITLGRITWDFRRFGDDGWGTNFVVLPGIANVTRLGIEADRLDPMEVAVPYPTGFHPRTAADVRAWQRHVLSLRRSKLFGFAGAPRSGFRDDFREVLLEECEDAGSEHCRSVDCRGTRCTDNGAAVLELFLDSSFCLQPRGDSFTRRSLFDCMVAGAVPVLFWRRTAYDQYRWYLPPGPARGEAEDDGEWSVFIDRQALRVGNVSVRDILEGLSERRVRRMRERVVEMIPRLVYASSPDGLGDGMEDALDVALRGVLERFRRRRASTAPQGFSAKRPPGRSVALARRVDNKSTPAPAPPSDGKNGSAAAVNQNASGTKPSSPASSYVKPVVSKASASTGKSLQKS

SEQ ID NO: 18438 - DNA, 915 bp, Sorghum bicolor
  misc_feature: Ceres ANNOT ID no. 8702473
  misc_feature: Encodes the peptide sequence at SEQ ID NO 18439
atggcccaggctccggcgcgcgccgcctccgccgtgcggctcttcgacgcgcactgccacctgcaagatccccgcgtcgcggccgtcgcccccgccctcatacgcgccgccgccgcatccggcgtcgcacgcttcgcggtcaacggcacctccgagcagatggccgaggatcacccagccgtcgtcccctgcttcggcctgcacccatggtgggtacccgagaggtcgccggattggatgaattccttgcggcggttcttcgccgaaaccccggaggcggctgttggggagattggtctggacaaaggttcacatggaaaaaccatcgacttcggagaacaggtcgaagtgttccaacgacaacttgaacttgctaaggaattggagagacctgtttctgttcattgtgtgcgggcatttggtgatcttctggaagtactgaagcaaactggacctttcccagcaggcgtgttgttacattcttatatgggatcttcagaaatggtgtctggcctttcaaatttaggctgttacttttcactatctggcttcttgataggcatgaaatccactaaagctaagaaaatgctgaagtcaatacccttggatagaattcttttagagacagacgcacctgatgcattaccaagattggacaatgttgctgtatcaccagtccctgttcacagttcagatgcagatactgaaaagcgtcacatagattcagagtcacaggctgctaatgcatcaaatgagtccctgaaccatccagaaaatatccatatcgttttgaattatgtcgcatcactccttgaaatgccagagtcagaattggcggagctgagttacaagaatgcaaccaaactgttttcttatcctggctccaaagttcagcctgaagctgaaggcatttaa

SEQ ID NO: 18439 - protein, 304 aa, Sorghum bicolor
  misc_feature: Useful for making plants with modulated biomass
  misc_feature: Functional homolog of the protein sequence given in SEQ ID NO 13236
  misc_feature: Ceres ANNOT ID no. 8702473
  misc_feature (15)..(291): Pfam ID: TatD_DNase Pfam Description: TatD related DNase
MAQAPARAASAVRLFDAHCHLQDPRVAAVAPALIRAAAASGVARFAVNGTSEQMAEDHPAVVPCFGLHPWWVPERSPDWMNSLRRFFAETPEAAVGEIGLDKGSHGKTIDFGEQVEVFQRQLELAKELERPVSVHCVRAFGDLLEVLKQTGPFPAGVLLHSYMGSSEMVSGLSNLGCYFSLSGFLIGMKSTKAKKMLKSIPLDRILLETDAPDALPRLDNVAVSPVPVHSSDADTEKRHIDSESQAANASNESLNHPENIHIVLNYVASLLEMPESELAELSYKNATKLFSYPGSKVQPEAEGI

SEQ ID NO: 18440 - DNA, 1572 bp, Sorghum bicolor
  misc_feature: Ceres ANNOT ID no. 8702487
  misc_feature: Encodes the peptide sequence at SEQ ID NO 18441
atgaagggaggagggggcgggaaggagacgctcaccgcctccttcctccgcttcctcctcctgctcctcctccccctcaccgccctctacttcttctacacgctgcacctcctcctcacctccgcgtcgtcggccgcctccaactgcgcgcctgacgccgcgtcggtctcccgggtgtccgccaacctcacggcggcgacggcgtcggcgtcgacggcggcggcggagaagcagctgcccccttcccccttggctgtgccctcggcgacgacgctgcagcacgtggtgttcggcatcgccgcgtcgtcgcggttctgggacaagcgtaaggagtacatcaaggtgtggtggcgcccgcgcggcgccatgcggggctacgtgtggctggaccgcgaggtgcgcgagtccaacatgtccacggcgcgcacggggctcccggccatcaggatctcgtccgacacctccgcgttcccctacacgcaccgccgcggccaccggtccgccatccgcatctcccgcatcgtctccgagacgttccgcctgggcctccccggcgtgcgctggttcgtaatgggcgacgacgacaccgtcttcttcccggacaacctcctcaccgtgctcaacaagttcgaccaccgccagccctactacatcggctccctctccgagagccacctgcagaacatctacttctcctacgggatggcgtacggcggcggcggcttcgccatcagccggcccctggccgaggcgctggcgcggatgcaggacggctgcctccgccggtacccagcgctgtacggcagcgacgaccggatccaggcgtgcatggcggagctgggcgtgccgctcaccaaacacccggggttccaccagtacgacgtgtacggcgacctcctgggcctgctcgcgtcccacccggtggcgccgatcgtgacgctgcaccacctggacgtcgtgaagccgctgttcccggacgcgaggtcgcgcccggcggcggtgcggcggctgttcgacgggccggtgaagctggacacggcggggctgatgcagcagtccatctgctacgacggcgccaaccgttggacggtgtccgtggcgtgggggttcacggtgctggtggccaggggcataatgtcgcctcgggagatggagatgccggcgcgcacgttcctcaactggtaccgccgcgccgactacacggcgtacgcgttcaacacgaggccgatggcgcgcagcccgtgccagaagcccgccgtgtactacatgtcgtcggcgcggcgccaggccgggcgcggcggggagaccacggtgacgcggtacgagcggtggcgccacccgaacgagacgcggcccgcgtgccggtgggacatagccgacccggacgcgcatctcgatcacatcgtcgtcctcaagaagcctgaccccgggctctgggacaggtcccccaggcgaaattgctgcagagtggtgtcttcgcccaaggatggtggggagaacggggagaagacgatgaccatcgatgtaggcgtatgcagggaaggcgagttcagccaagtagcaggagcgtga

SEQ ID NO: 18441 - protein, 523 aa, Sorghum bicolor
  misc_feature: Useful for making plants with altered carbohydrate content
  misc_feature: Functional homolog of the protein sequence given in SEQ ID NO 14169
  misc_feature: Ceres ANNOT ID no. 8702487
  misc_feature (80)..(293): SWISSPROT Homolog: EC 2.4.1.222 O-fucosylpeptide 3-beta-N-acetylglucosaminyltransferase
MKGGGGGKETLTASFLRFLLLLLLPLTALYFFYTLHLLLTSASSAASNCAPDAASVSRVSANLTAATASASTAAAEKQLPPSPLAVPSATTLQHVVFGIAASSRFWDKRKEYIKVWWRPRGAMRGYVWLDREVRESNMSTARTGLPAIRISSDTSAFPYTHRRGHRSAIRISRIVSETFRLGLPGVRWFVMGDDDTVFFPDNLLTVLNKFDHRQPYYIGSLSESHLQNIYFSYGMAYGGGGFAISRPLAEALARMQDGCLRRYPALYGSDDRIQACMAELGVPLTKHPGFHQYDVYGDLLGLLASHPVAPIVTLHHLDVVKPLFPDARSRPAAVRRLFDGPVKLDTAGLMQQSICYDGANRWTVSVAWGFTVLVARGIMSPREMEMPARTFLNWYRRADYTAYAFNTRPMARSPCQKPAVYYMSSARRQAGRGGETTVTRYERWRHPNETRPACRWDIADPDAHLDHIVVLKKPDPGLWDRSPRRNCCRVVSSPKDGGENGEKTMTIDVGVCREGEFSQVAGA

SEQ ID NO: 18442 - DNA, 708 bp, Sorghum bicolor
  misc_feature: Ceres ANNOT ID no. 8702499
  misc_feature: Encodes the peptide sequence at SEQ ID NO 18443
atggggaggggcagggtggagctgaagcggatcgagaacaagatcaaccgccaggtgaccttctccaagcgtcgcaatggcctcctcaagaaggcctacgagctctccgtgctctgcgacgccgaggtggcgctcatcgtcttctccagccgtggcaagctctacgagttcggcagcgcaggggtaaataagactttggaaaagtaccataattgttgtcacaatgctcaagattccaacactagttttggtggtgaacctcagaattggtaccaagaaatgtcaaggttcaaggataagcttgaatcgctccaacgctctcagaggcacatgcttggtgaggaccttgggcccctgagcataaaggagctgcagcaactggaaaaacaacttgaagattctctgtcacaggctcgacaccggaagactcaaatgatgatggaacagatggatgagcttcgtcgaaaggagcgccaacttgatgagcttaacaagaaactgaaaaacaagctggaagcagaaggttgcagcaactacaggggcgtccaaacatcctgggctactgacgcagcaataaccagcgacagcggggcactttccacgccaaatgctgaaccaccagctgctgctgtggactgtgaacccactctgcaaatcgggttcgttgctgctgaggcagcagccaagccaagacgaagtaaacactga

SEQ ID NO: 18443 - protein, 235 aa, Sorghum bicolor
  misc_feature: The sequence is a functional homolog of SEQ ID NO 707 in the 10/666,642 US patent application
  misc_feature: Useful for making plants with modulated flowering time
  misc_feature: Functional homolog of the protein sequence given in SEQ ID NO 13524
  misc_feature: Useful for making plants with altered alkaloid content
  misc_feature: Useful for making plants with altered terpenoid content
  misc_feature: Functional homolog of the protein sequence given in SEQ ID NO 13021
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 4 in US patent 7057087
  misc_feature: The sequence is a functional homolog of SEQ ID NO 30 in the 10/666,642 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 28 in the 10/666,642 US patent application
  misc_feature: The sequence is a functional homolog of SEQ ID NO 730 in the 10/666,642 US patent application
  misc_feature: Useful for making plants with modulated biomass
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 2 in US patent 7273968
  misc_feature: The sequence is a functional homolog of SEQ ID NO 46 in the 10/666,642 US patent application
  misc_feature: The sequence is a functional homolog of SEQ ID NO 14 in the 10/666,642 US patent application
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 919 in the 10/666,642 US patent application
  misc_feature: The sequence is a functional homolog of SEQ ID NO 42 in the 10/666,642 US patent application
  misc_feature: The sequence is a functional homolog of SEQ ID NO 1701 in the 10/412,699 US patent application
  misc_feature: Useful for making plants with altered lignin content
  misc_feature: Functional homolog of the protein sequence given in SEQ ID NO 12944
  misc_feature: The sequence is a functional homolog of SEQ ID NO 1949 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8702499
  misc_feature (77)..(173): Pfam ID: K-box Pfam Description: K-box region
  misc_feature (9)..(59): Pfam ID: SRF-TF Pfam Description: SRF-type transcription factor (DNA-binding and dimerisation domain)
MGRGRVELKRIENKINRQVTFSKRRNGLLKKAYELSVLCDAEVALIVFSSRGKLYEFGSAGVNKTLEKYHNCCHNAQDSNTSFGGEPQNWYQEMSRFKDKLESLQRSQRHMLGEDLGPLSIKELQQLEKQLEDSLSQARHRKTQMMMEQMDELRRKERQLDELNKKLKNKLEAEGCSNYRGVQTSWATDAAITSDSGALSTPNAEPPAAAVDCEPTLQIGFVAAEAAAKPRRSKH

SEQ ID NO: 18444 - DNA, 1032 bp, Sorghum bicolor
  misc_feature: Ceres ANNOT ID no. 8702506
  misc_feature: Encodes the peptide sequence at SEQ ID NO 18445
atgggaagccagcttctgtccaccgtcgagcgtcgcgaggtcctcccggagtgctatatccggccggagttcgacaggccgcgactcgccgaagtgacgacggacagcgacgtcccgctcatcgacctcgcgtcgccggataagcaacgagtcatcggccagattggtctggcttgccggacctatggcttcttccaggtcataaaccatggaatagaagaggagctactggagaagatgatggccgttggtctggagttcttccgtctgccgccggaggagaaggagaagctgtactcagatgaaccgttcaagaagataaggctctccaccagcttcaacgtccgcaaggagacggtgcgcaactggcgggactatctgcgccttcactgccacccgctggaggagttcttgcccgaatggccgtccaatcctgaatccttcaaggaggtagtcagcgcgtactgccgcgaggtccggctgctcggtctccggcttctcggcatgatctccctcagcctaggcctcgaggaggactacatcgagaaggccctcggcgagcaggagcagcacatggccgtgaactactacccgcagtgcccggaacccgacctcacctacggtctgccgaagcacacggatcccaacgccctcaccgtcctcctccaggaccccaacgtcgccggccttcaggtcctcaagggcggcgaccaatggatcgccgtcagcccccggcgaaacgctttcgtcatcaacctaggcgatcagttacaggcgctgagcaacggcgcgtacaagagcgtgtggcaccgtgcggtggtgaacgccgcgcaagagcgcatgtcggtggcatctttcctgtgcccgtgcaacagcgcggtgatcagccccgcggcggcgctcgtcggcgaaggggacgcgcccgtgtaccggagctacacctacgaagagtactacaagaagttctggagcaggagcctggaccaggagcactgcctggagcttttcagaagcacccagcagctccagtaa

SEQ ID NO: 18445 - protein, 343 aa, Sorghum bicolor
  misc_feature: Useful for making plants with modulated oxidative stress sensitivity
  misc_feature: Functional homolog of the protein sequence given in SEQ ID NO 14631
  misc_feature: Ceres ANNOT ID no. 8702506
  misc_feature (6)..(340): SWISSPROT Homolog: EC 1.14.11.9 Flavanone 3-dioxygenase
  misc_feature (188)..(289): Pfam ID: 2OG-FeII_Oxy Pfam Description: 2OG-Fe(II) oxygenase superfamily
MGSQLLSTVERREVLPECYIRPEFDRPRLAEVTTDSDVPLIDLASPDKQRVIGQIGLACRTYGFFQVINHGIEEELLEKMMAVGLEFFRLPPEEKEKLYSDEPFKKIRLSTSFNVRKETVRNWRDYLRLHCHPLEEFLPEWPSNPESFKEVVSAYCREVRLLGLRLLGMISLSLGLEEDYIEKALGEQEQHMAVNYYPQCPEPDLTYGLPKHTDPNALTVLLQDPNVAGLQVLKGGDQWIAVSPRRNAFVINLGDQLQALSNGAYKSVWHRAVVNAAQERMSVASFLCPCNSAVISPAAALVGEGDAPVYRSYTYEEYYKKFWSRSLDQEHCLELFRSTQQLQ

SEQ ID NO: 18446 - DNA, 1056 bp, Sorghum bicolor
  misc_feature: Ceres ANNOT ID no. 8702508
  misc_feature: Encodes the peptide sequence at SEQ ID NO 18447
atggccccagccatttccaagcctctcctcagcgatctcgtggcacagatcgggaaagtcccatcgagccacatcaggcctgtgggagaccgcccggacctcgccaatgtcgacaacgagtccggcgccgggatcccgctcatcgacctcaagatgctcaacgggccggagcgccgtaaggtggtggaggccatcggcagggcctgcgaatccgacggcttcttcatggtgacgaaccacggcatcccggcggcggtggtggaggggatgctgcgcgtggcgagggagttcttccacctgccggagtcggagcggctcaagtgctactccgacgaccccaagaaggcgatccggctgtccaccagcttcaacgtgcgcacggagaaggtgaacaactggcgcgacttcctgcgcctgcattgctacccgctcgagagcttcgtcgaccagtggccgtcaaacccgccatccttcaggcaagtggtgggcacctacgcgacggaagcgagggcgctagcgctgaggctgctggaggccatatcggagagcctgggcctggagcggagccacatggtgcgcgccatggggaggcacgcgcagcacatggcggtgaactactacccgccgtgcccgcagccggagctcacctacgggctgccgggccacaaggaccccaatgccatcacgctgctgctccaggacggcgtctccggcctgcaggtgcagcgcggcggccgatgggtggccgtgaaccccgtgcccgacgcgctggtcatcaacatcggagaccagatgcaggcactgagcaacgaccgatacaagagcgtgctccaccgcgtgatcgtcaacagcgagagcgagcggatctcggtgccgacgttttactgcccgtcgccggacggggtgatcgcgccggccgacgcgctggtggacgacgcccaccctctggcctaccgccctttcacttaccaggagtactacgacgagttctggaacatgggcctccagtcggcaagctgcctcgaccggtttaggcccggaggatccatagagtga

SEQ ID NO: 18447 - protein, 351 aa, Sorghum bicolor
  misc_feature: Useful for making plants with modulated oxidative stress sensitivity
  misc_feature: Functional homolog of the protein sequence given in SEQ ID NO 14631
  misc_feature: Ceres ANNOT ID no. 8702508
  misc_feature (19)..(327): SWISSPROT Homolog: EC 1.14.11.9 Flavanone 3-dioxygenase
  misc_feature (198)..(297): Pfam ID: 2OG-FeII_Oxy Pfam Description: 2OG-Fe(II) oxygenase superfamily
MAPAISKPLLSDLVAQIGKVPSSHIRPVGDRPDLANVDNESGAGIPLIDLKMLNGPERRKVVEAIGRACESDGFFMVTNHGIPAAVVEGMLRVAREFFHLPESERLKCYSDDPKKAIRLSTSFNVRTEKVNNWRDFLRLHCYPLESFVDQWPSNPPSFRQVVGTYATEARALALRLLEAISESLGLERSHMVRAMGRHAQHMAVNYYPPCPQPELTYGLPGHKDPNAITLLLQDGVSGLQVQRGGRWVAVNPVPDALVINIGDQMQALSNDRYKSVLHRVIVNSESERISVPTFYCPSPDGVIAPADALVDDAHPLAYRPFTYQEYYDEFWNMGLQSASCLDRFRPGGSIE

SEQ ID NO: 18448 - DNA, 1263 bp, Sorghum bicolor
  misc_feature: Ceres ANNOT ID no. 8702513
  misc_feature: Encodes the peptide sequence at SEQ ID NO 18449
atggagttcgcgagctcttccagtaggttttccaaagaggaggacgaggaggaggaaggggaggaagaggacgaggaggcgtccccgcgcgagatccccttcatgacagcggcggctgcgacggccgacaccggacccgccgccgcctcctcgtcctcgccttccgcggcgggggcctcggcgtccgcgtcgggttcggctgctgccctccgctccggcgacggcgccggggcgtccggtagcggcggcggcggcggcgggagcgacgacgtggaggtgatcgagaaggagcacatgttcgacaaggtggtgacgcccagcgacgtggggaagctcaaccggctggtgatcccgaagcagcacgcggagaagtacttcccgctggacgcggcggccaacgagaagggcctcctgctcagcttcgaggaccgcgccggcaagctctggcgcttccgctactcctactggaacagcagccagagctacgtcatgaccaagggctggagccgcttcgtcaaggagaagcgcctcgacgccggggacaccgtctccttctgccgcggcgccggggaggccgcgagggaccgcctcttcatcgactggaagcgacgcgccgactcccgcgacccgcaccggatgccacgactcccgctcccgatggcgcccgtcgcgtcgccctacggccttgggccctggggcggcggcgcgggcggtttcttcatgccgcccgcgccgcccgccacactctacgagcaccaccgcttccgccaggcccttgacttccgcaacatcaacgccgccgccgcgccggccaggcagctcctcttcttcggctcacaaggcatgcccccgcgcgcgtccatgccgctacagcagcagcagccgcagccgcagccgtcgcttccgcccccgcccccgcctctgcacagcattatgatggtgcaacccggcagccccgcggtcacgcacggcttgcccatggttctcgactcggtgccgctcgtcaacagcccaacggcagccgcgaagcgagtccgcctgtttggggtcaacctcgacaacccgcaacaaggcagcagtgccgagtcaagccaagacgccaacgcattgtcgctgaggatgccgggatggcaacggccggggccattgaggttcttcgaatcgcctcaacgcggcgccgccgagtcatctgcagcctcgtcgccgtcgtcatcatcgtcctccaagagagaagcgcattcgtcattggatctcgatctgtga

SEQ ID NO: 18449 - protein, 420 aa, Sorghum bicolor
  misc_feature: The sequence is a functional homolog of SEQ ID NO 1181 in the 10/374,780 US patent application
  misc_feature: Ceres ANNOT ID no. 8702513
  misc_feature (99)..(203): Pfam ID: B3 Pfam Description: B3 DNA binding domain
MEFASSSSRFSKEEDEEEEGEEEDEEASPREIPFMTAAAATADTGPAAASSSSPSAAGASASASGSAAALRSGDGAGASGSGGGGGGSDDVEVIEKEHMFDKVVTPSDVGKLNRLVIPKQHAEKYFPLDAAANEKGLLLSFEDRAGKLWRFRYSYWNSSQSYVMTKGWSRFVKEKRLDAGDTVSFCRGAGEAARDRLFIDWKRRADSRDPHRMPRLPLPMAPVASPYGLGPWGGGAGGFFMPPAPPATLYEHHRFRQALDFRNINAAAAPARQLLFFGSQGMPPRASMPLQQQQPQPQPSLPPPPPPLHSIMMVQPGSPAVTHGLPMVLDSVPLVNSPTAAAKRVRLFGVNLDNPQQGSSAESSQDANALSLRMPGWQRPGPLRFFESPQRGAAESSAASSPSSSSSSKREAHSSLDLDL

SEQ ID NO: 18450 - DNA, 1668 bp, Sorghum bicolor
  misc_feature: Ceres ANNOT ID no. 8702547
  misc_feature: Encodes the peptide sequence at SEQ ID NO 18451
atgggcaacgcatgcggcggctcccttagatccaagtacctgcacagcttcaagcacgccgcgtcgcagcgccacgactccgagtacagcgccaccagcaccgtcgacgactcgcccaggaagcagcccaccacgccgcccgccaccacggacgcccacgcgcagccgccgccggcgtccgccgccgccgcagccatgaggcgcggcggggcgggcgcgacgcccgacctcgggtccgtgctcggccaccccacccccaacctccgcgacctctacgcgctcggcaggaagctcgggcaggggcagttcggcaccacctacctctgcaccgagctcgccacgggggtcgactacgcctgcaagtccatctccaagcgcaagctcatcaccaaggaggacatcgacgacgtgcgccgagagatccagatcatgcaccacctctcgggccacaagaacgtcgtcgctatcaagggcgcgtacgaggaccaggtctacgtccacatcgtcatggagctctgcgccggaggcgagctcttcgaccggatcatacagcgcgggcactacagcgagcgcaaggccgccgagctcaccaggatcatcgtcggggtcgtcgaggcctgccactcgctcggggtcatgcaccgggacctcaagcccgagaacttcctgctcgccaacaaggacgacgacctctcgctcaaggccatcgatttcggactctctgtcttcttcaagcctggtcaagttttcaccgatgttgttggtagcccatattatgtggctccagaagttttgttgaaaagttatggaccagcagctgatgtatggacagccggtgtcattctttacattctactaagtggtgtgcctccattttgggcagaaacacaacaaggaatatttgatgctgtattgaaaggtgtcattgattttgattctgatccgtggcctgtcatatctgatagtgcaaaagatcttataagacgaatgctgaatcctcgtgctgccgagcgcttaacagcacacgaagttctatgccatccatggattcgtgatcatggagtagctcctgaccgtccactggatccagctgtcttatctcgcattaagcaattctctgcaatgaataagttgaagaaaatggctttacgagtaatagctgagagcctatcagaagaggaaattgcggggttgaaggaaatgttccagaccatggacactgataacagtggcgcaattacttatgatgagctaaaagaaggattgagaaaatatggctccacactgaaggacactgagattcgtgatcttatggacgcagctgatattgacaacagtggaacaattgactacatagaattcattgctgcaactttgcatctcaataagctggaacgtgaggaacatctcgtagcagccttttcatatttcgacaaagatggtagtggctatatcacagtggatgaactacaggaagcttgcaaagagcataacatgccagatgcttttcttgatgatgtcatcaacgaagcagaccaggacaatgatggccgcattgactatggagagtttgttgccatgatgaccaagggcaacatgggagtgggtcgaagaacaatgagaaacagcctgaatatcagcatgagggacgcacctggtgctttctga

SEQ ID NO: 18451 - protein, 555 aa, Sorghum bicolor
  misc_feature: The sequence is a functional homolog of SEQ ID NO 2 in US patent 7084323
  misc_feature: Ceres ANNOT ID no. 8702547
  misc_feature (80)..(554): SWISSPROT Homolog: EC 2.7.11.1 Non-specific serine/threonine protein kinase
  misc_feature (92)..(350): Pfam ID: Pkinase Pfam Description: Protein kinase domain
  misc_feature (397)..(425): Pfam ID: efhand Pfam Description: EF hand
  misc_feature (503)..(531): Pfam ID: efhand Pfam Description: EF hand
  misc_feature (469)..(497): Pfam ID: efhand Pfam Description: EF hand
  misc_feature (433)..(461): Pfam ID: efhand Pfam Description: EF hand
MGNACGGSLRSKYLHSFKHAASQRHDSEYSATSTVDDSPRKQPTTPPATTDAHAQPPPASAAAAAMRRGGAGATPDLGSVLGHPTPNLRDLYALGRKLGQGQFGTTYLCTELATGVDYACKSISKRKLITKEDIDDVRREIQIMHHLSGHKNVVAIKGAYEDQVYVHIVMELCAGGELFDRIIQRGHYSERKAAELTRIIVGVVEACHSLGVMHRDLKPENFLLANKDDDLSLKAIDFGLSVFFKPGQVFTDVVGSPYYVAPEVLLKSYGPAADVWTAGVILYILLSGVPPFWAETQQGIFDAVLKGVIDFDSDPWPVISDSAKDLIRRMLNPRAAERLTAHEVLCHPWIRDHGVAPDRPLDPAVLSRIKQFSAMNKLKKMALRVIAESLSEEEIAGLKEMFQTMDTDNSGAITYDELKEGLRKYGSTLKDTEIRDLMDAADIDNSGTIDYIEFIAATLHLNKLEREEHLVAAFSYFDKDGSGYITVDELQEACKEHNMPDAFLDDVINEADQDNDGRIDYGEFVAMMTKGNMGVGRRTMRNSLNISMRDAPGAF

SEQ ID NO: 18452 - DNA, 774 bp, Sorghum bicolor
  misc_feature: Ceres ANNOT ID no. 8702536
  misc_feature: Encodes the peptide sequence at SEQ ID NO 18453
atggctccgccgctcctgctcttcctcttcctcctcccggccctcgccgccggacaccagcacccgtcctcctatggttcgtccgcgctctccgagtggcgccccgccaaggcatcctactacgccgccgaccccgaagacgccatcggtggggcgtgcgggttcggggatctggggaagcacgggtacgggatggcgacggtggggctgagcacggcgctgttcgagcgcggcgcggcgtgcggcggctgctacgaggtcaagtgcgtcgaggatctcaagtactgcctccccggcacctcaatcgtcgtcacggccaccaacttctgcgccccaaactacggcctccccgccgacgccggcggccactgcaacccgcccaaccaccatttcctcctccccatccagtcgtttgagaagattgcgctctggaaggccggcatcatgcccatccagtaccgccgtgttaagtgcctccgagaaggtggtgtcaggttctctgtcaatggtcggcacttcttctttacagtcctaatcagcaatgttggtggcgcgggtgatgttagatctgtgaagatcaaaggaacagagttaggatggctctcgatgggccgcaattggggccaggtgtggcacatcaactgtgacatgaggggacaacccctgtcgtttgagctcagctcaagcgatggcaagacactcaccagtttcaacgttgtgcccaaggattgggagtatggcaagacatacacggggaagcagtttcttctgtag

SEQ ID NO: 18453 - protein, 257 aa, Sorghum bicolor
  misc_feature: Useful for making plants with altered carbohydrate content
  misc_feature: Functional homolog of the protein sequence given in SEQ ID NO 14632
  misc_feature: Useful for making plants with altered cell wall content and/or composition
  misc_feature: Functional homolog of the protein sequence given in SEQ ID NO 14633
  misc_feature: Useful for making plants with altered lignin content
  misc_feature: Functional homolog of the protein sequence given in SEQ ID NO 12888
  misc_feature: Ceres ANNOT ID no. 8702536
  misc_feature (164)..(241): Pfam ID: Pollen_allerg_1 Pfam Description: Pollen allergen
  misc_feature (67)..(153): Pfam ID: DPBB_1 Pfam Description: Rare lipoprotein A (RlpA)-like double-psi beta-barrel
MAPPLLLFLFLLPALAAGHQHPSSYGSSALSEWRPAKASYYAADPEDAIGGACGFGDLGKHGYGMATVGLSTALFERGAACGGCYEVKCVEDLKYCLPGTSIVVTATNFCAPNYGLPADAGGHCNPPNHHFLLPIQSFEKIALWKAGIMPIQYRRVKCLREGGVRFSVNGRHFFFTVLISNVGGAGDVRSVKIKGTELGWLSMGRNWGQVWHINCDMRGQPLSFELSSSDGKTLTSFNVVPKDWEYGKTYTGKQFLL

SEQ ID NO: 18454 - DNA, 1197 bp, Sorghum bicolor
  misc_feature: Ceres ANNOT ID no. 8702584
  misc_feature: Encodes the peptide sequence at SEQ ID NO 18455
atgtcctcctcctcctcctcctcctcctccctgtctctacagccgcctcccgccggtgcaatcggcggcacttccccctactccgcgtccacgtctttcctcccctcgttcatgatcatcgccgcgctgctcgccttcgtgttcctcgcctccgtctccatccacctcctgctccgcttcctctccgaccgctcctcctcgtcgtcgtcgtctggacctccgctcccgcggacccaccgcgacgaagcgggctcggcggggagtacgatggacgcgtcgtccgcggcgaggcctgccgctaccgcggctgctccagccgacgcagcgaacaaggaggcggcggcgggcgacaacgagaagcagcggctgatcgactcgctgccgctgttcacgatggcgtcgtcgctggcggagctccccaagagctcgcccgactgcgccgtctgcctgacgctgttcacgccagacgccgagctgaggctgatgcccgcgagccgccgcaagttctacgcagcgtgcgtcgacgcctggctgcgcaccacgccgtcctgcccgctctgccgcgccgccgtcgtcgcgttcccgcacccctcgctctccgccatgctcgccgccgcgcagcagcagcggccggcgtcgccgaggaccagggacccgcggtccgggtcgagcttcctcgtcgagatgggcaccgtcagcagcagccgcggctcgcccgtggcggccggcggcggtggcggggacaggaacaggaacagccgcacctactcgctcggctctttcgactaccaaatcgacgaggaggtggaagccgtggtgtcccgcgtcgcgcgcatcaccgcgagggaatccagcaccgtcaaggaggagatggagaagccttcgggtgaagaggtgtcggcacggccgccggcgccggcgccgtctccgccgcctccaggcgagacggtggccgaggcggcgggctcctcgcgcgggtggctgcgggagtacgtggaccggctggcgtcgtccgcctacacgttgtcggagcggtggagctcccgctggagccaggggcagagccagcagcagcggcaggaagagccgtggctgtgggacacggaggccgcggacatgtcggcggcgccggggtccgacgaggaggaggaggagacggcgttcatggtgatgtaccgctggatcgccggggtgtaa

SEQ ID NO: 18455 - protein, 398 aa, Sorghum bicolor
  misc_feature: Useful for making plants with modulated flowering time
  misc_feature: Functional homolog of the protein sequence given in SEQ ID NO 13153
  misc_feature: Ceres ANNOT ID no. 8702584
MSSSSSSSSSLSLQPPPAGAIGGTSPYSASTSFLPSFMIIAALLAFVFLASVSIHLLLRFLSDRSSSSSSSGPPLPRTHRDEAGSAGSTMDASSAARPAATAAAPADAANKEAAAGDNEKQRLIDSLPLFTMASSLAELPKSSPDCAVCLTLFTPDAELRLMPASRRKFYAACVDAWLRTTPSCPLCRAAVVAFPHPSLSAMLAAAQQQRPASPRTRDPRSGSSFLVEMGTVSSSRGSPVAAGGGGGDRNRNSRTYSLGSFDYQIDEEVEAVVSRVARITARESSTVKEEMEKPSGEEVSARPPAPAPSPPPPGETVAEAAGSSRGWLREYVDRLASSAYTLSERWSSRWSQGQSQQQRQEEPWLWDTEAADMSAAPGSDEEEEETAFMVMYRWIAGV

SEQ ID NO: 18456 - DNA, 1119 bp, Sorghum bicolor
  misc_feature: Ceres ANNOT ID no. 8702614
  misc_feature: Encodes the peptide sequence at SEQ ID NO 18457
atgaggaagcacgccaccgcattaggagactacgtcacggcgcctgggatgccacaggcctcgacgggcaacgttaggcactggaagggcctagccttcagcagcaccatggagcggtcgccgggaacctggtcgcccatgaacatgaagcccacggacatgccgccgggggctatgtatcgcgctgattccgacgcgccgccgggcttgcagcagcaacagcatccaggctccggtggcggtggcgctatcgtcgccgtcagcggtggggagctcgtgaagaagaaaagggggaggccgaggaagtatggcccggacgggagcatcggtttgggactcaagtccgcggcagcggcgggcactgaagcggcgggcggccaatccggtggtggaggcgggtctagctctaaccccgacggcaagcgcaggggacggccccctgggtccggcaaaaagaaacagctcgatgctttgggatcttcggggacatcatttactccccacataataactgtgaagcctaatgaggatgttgcgtccaaaataatggccttttctcaacaaggcccgcgcactacatgcataatttcagcaaacggcgctctgtgcacggcaacattgcgtcaaccagcaacctctggtgggatagtgacatatgagggacacttcgatatactctctctgtcaggctcattcctgcttgcagaggatggtgatactcgcagcagaacaggtggtttgagtgtggcactggctggaagtgatggacgcatagttgggggttgtgttgctggaatgctgatggcagcgacacctgtacaggttgtagttggcagtttcattgctgaaggtaaaaagccaaaagaagagcaaccgaaacgcgagccaacatcggtgccaccacacacagctggctttggggcggcctcgactgccagccccccatcggatggtacatcaagcgagcactctgatgatccagggagccccatgggaccaaacggcagcacattcactaacgcggggcttcctctgcactccacatttgctccagctggttggtcactatcagggaaccaaagccgctatgatccagatctaaagatgatgaccgactga

SEQ ID NO: 18457 - protein, 372 aa, Sorghum bicolor
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
  misc_feature: Ceres ANNOT ID no. 8702614
MRKHATALGDYVTAPGMPQASTGNVRHWKGLAFSSTMERSPGTWSPMNMKPTDMPPGAMYRADSDAPPGLQQQQHPGSGGGGAIVAVSGGELVKKKRGRPRKYGPDGSIGLGLKSAAAAGTEAAGGQSGGGGGSSSNPDGKRRGRPPGSGKKKQLDALGSSGTSFTPHIITVKPNEDVASKIMAFSQQGPRTTCIISANGALCTATLRQPATSGGIVTYEGHFDILSLSGSFLLAEDGDTRSRTGGLSVALAGSDGRIVGGCVAGMLMAATPVQVVVGSFIAEGKKPKEEQPKREPTSVPPHTAGFGAASTASPPSDGTSSEHSDDPGSPMGPNGSTFTNAGLPLHSTFAPAGWSLSGNQSRYDPDLKMMTD

SEQ ID NO: 18458 - DNA, 756 bp, Sorghum bicolor
  misc_feature: Ceres ANNOT ID no. 8702630
  misc_feature: Encodes the peptide sequence at SEQ ID NO 18459
atggcaatcgacgatgaatcgccgctcagagtcaacaccagaggcggcgccatgggaggaggcgggtgcgacggggcggagaaccagcggtggccgccgtggctcaagccgctgctggggacgagcttcttcggtcaatgcaaggtgcacgcggacgcgcacaagagcgagtgcaacatgtactgcctcgactgcatgaacggcgcgctctgctcccagtgcctcgcctaccaccgcgaccaccacgccatccagatacggaggtcctcctaccatgacgtgatccgggtgtctgagattcagaaggtgctggacatcaccggcgtgcagacgtacatcatcaacagcgcgcgcgtggtgttcctgaacgagcgcccgcagccgaggcccggcaagggcgtcaccaacacctgcgaggtatgcgagcgcagcctcctcgacaccttccgcttctgctccctcggctgcaagatcgtcgggacctccggcgacttccgcatccggaagaagcacgtcgtcgttacgaagaagaagaagcaggcccagcaccagcaccagcacaggggcgcggcggcggcgtcggagtcggaggacgactcgtccaccagcaccagcggcggcagcgacaagagcagcgtggtgcagagcttcaccccgtcgaccccgccggcgactgccaacagcttccgcaccgggaagcggcgcaagggcgtgccgcaccggtcgccgttcggcaacctcatggtggagttctag

SEQ ID NO: 18459 - protein, 251 aa, Sorghum bicolor
  misc_feature: The sequence is a functional homolog of SEQ ID NO 664 in the 10/666,642 US patent application
  misc_feature: The sequence is a functional homolog of SEQ ID NO 668 in the 10/666,642 US patent application
  misc_feature: Ceres ANNOT ID no. 8702630
  misc_feature (47)..(158): Pfam ID: PLATZ Pfam Description: PLATZ transcription factor
MAIDDESPLRVNTRGGAMGGGGCDGAENQRWPPWLKPLLGTSFFGQCKVHADAHKSECNMYCLDCMNGALCSQCLAYHRDHHAIQIRRSSYHDVIRVSEIQKVLDITGVQTYIINSARVVFLNERPQPRPGKGVTNTCEVCERSLLDTFRFCSLGCKIVGTSGDFRIRKKHVVVTKKKKQAQHQHQHRGAAAASESEDDSSTSTSGGSDKSSVVQSFTPSTPPATANSFRTGKRRKGVPHRSPFGNLMVEF

SEQ ID NO: 18460 - DNA, 1176 bp, Sorghum bicolor
  misc_feature: Ceres ANNOT ID no. 8702677
  misc_feature: Encodes the peptide sequence at SEQ ID NO 18461
atggatcccaacgacgccttctcggcggcgcacccgttccggtgggacctgggcccgccggcgcacgccgcgcctccgcctccgcctccgccgcagccagcgccagcgccagcgccgcagctgccgcctcacgcgccgctggtgtacgcggcgccgagggagctggaggacctggtggccggctacggcgtgcgcccgtccacggtggcgcggatctcggagctcgggttcacggcgagcacgctcctgggcatgacggagcgcgagctggacgacatgatggccgcgctcgcgggtctgttccgctgggacgtgctcctcggcgagcggttcggcctccgcgccgcgctgcgggccgagcgcggacgtgtcatgtccctcggcggccgcttccacaccgggagcaccttggatgccgcgtcacaggaagtgctgtccgacgagcgcgacgcggcggccagcggcggcacggtgatggccggcaagaagaagggtaacaaaggggtcggctcgaggaagggcaagaaggcgaggaggaagaaggagctgcggccactggacgtgctgggcgacgagaacgacggagacgaggacggcggcggcgggtcggagtcgacggagtcgtccgcgggcggctccggcggcggggagaggcagcgggagcacccgttcgtggtcacggagcccggcgaggtggcgagggccaagaagaacggcctcgactacctcttccatctgtacgagcagtgccgcgtcttcctcttgcaggtgcagtccattgctaagctgggcggccacaagtcccctaccaaggtgacgaaccaggtgttccggtacgccaagaagtgcggggcgagctacatcaacaagcccaagatgcggcactacgtgcactgctacgcgctgcactgcctggacgaggaggcctccaacgcgctgcgccgggcgtacaaggcccgcggcgagaacgtcggcgcctggaggcaggcgtgctacgcgccgctcgtcgagatcgccgcgcgccacggcttcgacatcgacgccgtcttcgccgcgcacccgcgactcgccatctggtacgtgcccaccaggctgcgccagctctgccaccaggcgcgggggaaccacgcccacgtccacgccgccgccggcttcccgccgccgccgatgttctag

SEQ ID NO: 18461 - protein, 391 aa, Sorghum bicolor
  misc_feature: Useful for biocontainment applications
  misc_feature: Functional homolog of the protein sequence given in SEQ ID NO 14634
  misc_feature: Useful for making plants with modulated biomass
  misc_feature: Functional homolog of the protein sequence given in SEQ ID NO 14635
  misc_feature: Useful for making plants with modulated flowering time
  misc_feature: Functional homolog of the protein sequence given in SEQ ID NO 14636
  misc_feature: Ceres ANNOT ID no. 8702677
  misc_feature (1)..(378): Pfam ID: FLO_LFY Pfam Description: Floricaula / Leafy protein
MDPNDAFSAAHPFRWDLGPPAHAAPPPPPPPQPAPAPAPQLPPHAPLVYAAPRELEDLVAGYGVRPSTVARISELGFTASTLLGMTERELDDMMAALAGLFRWDVLLGERFGLRAALRAERGRVMSLGGRFHTGSTLDAASQEVLSDERDAAASGGTVMAGKKKGNKGVGSRKGKKARRKKELRPLDVLGDENDGDEDGGGGSESTESSAGGSGGGERQREHPFVVTEPGEVARAKKNGLDYLFHLYEQCRVFLLQVQSIAKLGGHKSPTKVTNQVFRYAKKCGASYINKPKMRHYVHCYALHCLDEEASNALRRAYKARGENVGAWRQACYAPLVEIAARHGFDIDAVFAAHPRLAIWYVPTRLRQLCHQARGNHAHVHAAAGFPPPPMF

SEQ ID NO: 18462 - DNA, 1164 bp, Sorghum bicolor
  misc_feature: Ceres ANNOT ID no. 8702667
  misc_feature: Encodes the peptide sequence at SEQ ID NO 18463
atggcggccttcacgatgcacacgagcgcggccacctcgccctactcgccggcgggcacggccatccttctccgaagccggagtcgatcctactcctaccccaccgccgccaccaccaccatccgcgtgtcgtgctcgaagacgacggtggtgatcggggtggcggcggactccgggtgcgggaagagcacgttcacgcggcgcctgacgagcgtgctgggcggcggggcggagccgccgaggggcgggaaccccaactccaacacgctggtgagcgacaccgccacggtgatctgcctggacgactaccactcgctggaccgggccgggcggaaggccaagggcgtcacggcgctggacccgagggccatcgacttcgacctcatgtaccagcaggtgagggccatcaaggacggccgcgccgtcgagaagcccgtctacaaccacgtcaccggccgcatcgacccgcccgagctcatcaccccgcccgagatcctcgtcatcaaggggctgcacccaatgtacgatgagcgcgtgagggacctgctagacttgagcatctacctggacatcagcaacgaagtgaagtttgcatggaaagttcagagagacatggcagagcgtgggcacagccttgagagcatcagggccagcatcgaggcaaggaagcccgacttcgatgcttacattgagccgcagaagcagtacgcggacgccgtgatcgaggtgctgccgacgcagctgatcccgggcccgggcgacgacgagggcaaggtgctgcgcgtgaagctgatcatgaaggaaggcgtggagcacttcgccccggtgtacctcttcgacgaaggatccaccgtcaactggatcccctgcggccggaagctctcctgctcctaccccggcatcaggttcgcctacggcttcggcacctacttcgggcacgaggtgtcggtggtggagatggacgggcaattcgacaagctggacgagctcatctacgtggagacccacctgagcaacctgtcgaccaagttctacggggaggtggcgcagcagatgctcacgcacgccgatttgccgggcagcaacaacggcacggggctcttccagaccatcgtcgggctcaagatcagggacctctacgagcagatcgtcgcacgtcgctga

SEQ ID NO: 18463 - protein, 387 aa, Sorghum bicolor
  misc_feature: Useful for making plants with altered lignin content
  misc_feature: Functional homolog of the protein sequence given in SEQ ID NO 14562
  misc_feature: Ceres ANNOT ID no. 8702667
  misc_feature (40)..(387): SWISSPROT Homolog: EC 2.7.1.19 Phosphoribulokinase
  misc_feature (51)..(250): Pfam ID: PRK Pfam Description: Phosphoribulokinase / Uridine kinase family
MAAFTMHTSAATSPYSPAGTAILLRSRSRSYSYPTAATTTIRVSCSKTTVVIGVAADSGCGKSTFTRRLTSVLGGGAEPPRGGNPNSNTLVSDTATVICLDDYHSLDRAGRKAKGVTALDPRAIDFDLMYQQVRAIKDGRAVEKPVYNHVTGRIDPPELITPPEILVIKGLHPMYDERVRDLLDLSIYLDISNEVKFAWKVQRDMAERGHSLESIRASIEARKPDFDAYIEPQKQYADAVIEVLPTQLIPGPGDDEGKVLRVKLIMKEGVEHFAPVYLFDEGSTVNWIPCGRKLSCSYPGIRFAYGFGTYFGHEVSVVEMDGQFDKLDELIYVETHLSNLSTKFYGEVAQQMLTHADLPGSNNGTGLFQTIVGLKIRDLYEQIVARR

SEQ ID NO: 18464 - DNA, 1707 bp, Sorghum bicolor
  misc_feature: Ceres ANNOT ID no. 8702673
  misc_feature: Encodes the peptide sequence at SEQ ID NO 18465
atggagaagggccagccagagaggggaagcccaaagattcaggatgaaagtctcacggtgccactcattcaagacaagaaaaccggaagcaaagcaccagcagtggttctagcattcgagtgcttggaaagcacagcgttcaatggcattggcacgaacctagtggtgtacctggagaccgtgctgcacggtagcaatctagccagcgcgtccagtgtcacctcgtggttcgggaccagctacctgacgccgatcttcggcgccatcgtcgcggacacgttctggggcaactacaacaccatcctcgtctccctcctcgtctaccttcttggcatgatgttggtcaccttctcggcgttcctgccgaccaccgagctctgtggagttgggtcgtcgtgccaccccgtgctgggctcgcagaacgtcgcgttcctcggcctctacctcgtggccttcggcagcggcggcgtgcgcgcggcgctgctgccgttcggcgcggagcagttcgacgacgacaacgccgtggaccgggagcgcaagatgtccttcttcagctggttctacatctgcgtcgacttcggcatgatcatctcgggcgtcttcatcgtgtggatccagcagaacatcagctgggggctcggcttcggcatcgccaccgcctgcgtcgcgctcgccttcggcggcttcgtgctcgccacgcccatgtacaagcgccggatgccgacgggaacgccgctcaagagcctgggccaggtcgtcgtcgccgcgttcaggaaggtcagcctccgcgtccccgcggacgccggcctcctctacgaggtccacgacatgatcgagcagcccaagatcgcgcacaccgacgagttcgggttcctcgacaaggcggcggtggtcgcggagtcggacgacccggaggaggtgacgaacgacgccgcggcggcggccgcggggtcgtcgtcgtggaggctctgcacggtgacgcaggtggaggagctcaagatcctgctgcgcctgctcccgatatgggcgaccagcatcgtgctgtcggcggcgtacgcgcagctcaacaccacgttcgtgcagcagggcggcgtgatggacatgcgggtgatgtcgtcgctcaccgtcccggcggcgtccatggtgtccttcgaggtgctctgcgtcctggcgtgggtgctcatctacgacgccgtgatcctgccggcgctccgggccatctcccccgcgcgcggggagccgtcgcagctgcagcggatgggcgccgggcggctgctcatggcgtgcgcgatggccgtggcggcgctggtggagatgaggcgcctcgacgccgctggccgcggcgagtccatcagcatcgcgtggcagatgccgcagtacttcgtgctggccggcggggaggtgttctgctacatcgcgcagctggagttcttctacgacgaggcgccggagacgatgaagagcatgtgcacgtccttcgcgctgctcaccgtcgcgctggggagctacatgagctcgctcatctacgccgtcgtggacgcgctcaccgccaccggcggcggcgggcggcccggctggatctcggacaacctcgacgagggccacctcgactacttcttctggaccatggcggcgctgtgcacgctcaacttcgtcgtgtacagtgggttcgccaggaactacaaggtcaagacggtcgtgtcgtga

SEQ ID NO: 18465 - protein, 568 aa, Sorghum bicolor
  misc_feature: Useful for making plants with modulated nitrogen use efficiency
  misc_feature: Functional homolog of the protein sequence given in SEQ ID NO 14373
  misc_feature: Ceres ANNOT ID no. 8702673
  misc_feature (98)..(498): Pfam ID: PTR2 Pfam Description: POT family
MEKGQPERGSPKIQDESLTVPLIQDKKTGSKAPAVVLAFECLESTAFNGIGTNLVVYLETVLHGSNLASASSVTSWFGTSYLTPIFGAIVADTFWGNYNTILVSLLVYLLGMMLVTFSAFLPTTELCGVGSSCHPVLGSQNVAFLGLYLVAFGSGGVRAALLPFGAEQFDDDNAVDRERKMSFFSWFYICVDFGMIISGVFIVWIQQNISWGLGFGIATACVALAFGGFVLATPMYKRRMPTGTPLKSLGQVVVAAFRKVSLRVPADAGLLYEVHDMIEQPKIAHTDEFGFLDKAAVVAESDDPEEVTNDAAAAAAGSSSWRLCTVTQVEELKILLRLLPIWATSIVLSAAYAQLNTTFVQQGGVMDMRVMSSLTVPAASMVSFEVLCVLAWVLIYDAVILPALRAISPARGEPSQLQRMGAGRLLMACAMAVAALVEMRRLDAAGRGESISIAWQMPQYFVLAGGEVFCYIAQLEFFYDEAPETMKSMCTSFALLTVALGSYMSSLIYAVVDALTATGGGGRPGWISDNLDEGHLDYFFWTMAALCTLNFVVYSGFARNYKVKTVVS

SEQ ID NO: 18466 - DNA, 5124 bp, Sorghum bicolor
  misc_feature: Ceres ANNOT ID no. 8702684
  misc_feature: Encodes the peptide sequence at SEQ ID NO 18467
atggcggaggaggagagggatttgggtgacatcgtgctctcctggtcggtgcaggagatcatggacgacgacctccacaaggggaagcgttggattctgctcatcctccggaccatgaaggcttgggctttgccattgaatcgaatgattaggattgtactgattgaaaagaattatattaagggaaccaccatcgtgcctaatgatagacagatcggtacattctatgtaaattggtgctggagattgaaaatctttattccacaactggtggagaaaatcccattcagctttagttctcttgatgactacttgaggtcatatattgcacctctgatcgaagaaacaagatcaggcctaagctcatgccttgagctcatcgcagaagcaccctcatcaaaaatactttccatggaagctgcaggcaaatcaggactgtattttatggatgttgacttctgggacaatggtgctggtttttctacggagacctacactgcaaggaacggcgatatatttattttgtctagcatgaagcctgaagctacagatgacttcaaccgctatggtttaacgtattgcttggcaatggttactgaagtttccatgaatgatgactatcagaagggcttcaaagtgaaagtttcaaatggtactggtttggaaggagactttagtaaacttgtacacgcaacgtttcttgataatatcatgacaaacatacggatatggaaagcactttgcttcgactcaagcatgaataataatttcacagtaatcaggtcacttttagcccccagaaatatggagcagctactgctagttaatctaaatcagtcacaagtggatgccattgaatctatcatctcagctgtacggtgtagacatttgaacctcacgaaacttatatggggtccaccaggtaccggaaagaccaaaactgttagtgctatgctgtgggctctggcttgtttgaaatgccgaactcttacatgtgctcccacaaatgttgctgttgttggtgtctgcactcgattccttaaaaatttaaaggaattcaacaagcagattgacaaaactggtctacctctttctctcggagatgttttgttattagggaacaagtacaacatggacatcactgaggagcttcaggaagttttcttggattatcgtgcagatgagcttacagagtgcttttcatcattgtctggatggaggtacataattgcttcaatgatatctttttttgaggactgtggttctcgatacgatatgcttcttgaggatgatgaaagccatgattctgtatgttttttggatttcctgaagaagcagtttgatgttgcagcaaaagctgtaaagaaatgcatgatgactttgtggcttcaccttccagggaagtgcttttcgcatgaaaatgtaaacaatatatctatgctgttagtttggctagaaaaaattgatgcccttttatgtgatggagatttaactgatgagagtgtgaaaaggggctttgattttcagtcaactgagaactctattaatgcagaaccaatatcttctattgagaaggaattaggtggagcaaagtctctatgccttaaattgctgaaagatcttcgaaattcacttaatttacctgtcagtgcagacaggaactggattcagaactattgcatgcgtaatgcaactttaattttctgtacagcctctagttcttatcggttgcataacgcaacgattgctccgcttgatgtgttgatcgttgatgaggtatgcaaggaagctggattcggaatcagtctttttgagagattagtcatactgaattttgaaaagcatttgttgaatatacagtatcgcatgaacccttgtatcagcttatttccaaatgctaaattttatgagaagaagattttagatggccccaatgttttttcttcttcatacaacaaggattacatgggtcttccttttggtagctatgctttcataaacatcacagacgggagggaagaaaaggaaggtgcaggaaacagttggcgtaacctggttgaagttgccgttgttttgcacttgatccaaaccatctttaaatcttggagaaagagaggccaagggattagcattggtgtagtctcaccttacagttctcaggttgctgctatcaaagatagacttggcaaaaagtatgatacatctgatggctttcatgtcagggtcaagtcaattgatggtttccaaggagaagaggatgacgtcatcatactgtcaacagttagatccaatgggaggggcaatgttgggtttcttgctgacaaccaacgaacaaatgttgctcttacaagagcaaggcattgtctttggattcttgggaatgctaatacactgtataaaagtgggacagtctggacagacctcgttgctgatgcggagagacgtaaatgtatttccaatgccattaatgacacagaattgtgtaagttgattttgcatgtaaagaatgaacttgatgaactcgatgatctactttgttccaactcagcagttttcagcaataccagatggaaggtcgttctgagtgacaattttagaaggtctttcatgaaactaaaatctccactgctaaggagggaggtacttcaaaagcttgttaaacttggtggtggttggcggacaccaataaagaatcttgatgtgactgatgctttccagcttgcaaaagcataccggatcagagatctgtatcttgtttggagtactgatctggagaaaaacgaaagatactttcagataataagaatatgggacattttgtcacaccaacacattgctagaactgttcaacatctggaaaatctcttttccatgtacacagatgattaccttgaccactgcagaagagtgcagttagaagggaagctggaagttcctatagtttgggatgccgaacatgatattgttcggtataagaaggattgcagacttgatgataaggaagatcatgaccacgtggacacctcatgtgccttggagaatacaaaagttagtgaaagcttcttgctgatgaaattttactcgttatcatctggtgtggcaaagcatttgctgacagctactgatgggactgaaattgagattccctttgaactgactgatgaagaggaggcgataattcgattcccactcactagtttcattcttgggaggtcaggcactgggaaaaccactgttttgacaatgaaattgtatcaaattgagcaacactccttgattgcatctcaagggatagagttggatgaagttgatttatctgtggctgatcccaaaagtagcttggcaatggacacaaacaaaagggagagttttgtgaaacaagtccttatcactgtaagcccaaagctttgttcagctataaaaaatcacatttgcaggcttagaaggtttggctctggcgatgtttctgaccagcccaatactcttcatatgcatgatgtatttgatgaccttgaagagtttacagatgtacctgataattttagtgatctactgcatggccactatcctcttactataacataccgtaaattcttgatgatgcttgatggaacagtgcatacttcattttttgatatgttctatggagatttcaagcctagcattgagagaggtcattcgaaaactcgagctttgcaagcttttattgaatcaaaagaagttacatttgagaagtttgctgctttctattggccccatttcaatggcgaactaacgaagaaacttgatgcatccactgtctttactgaaataatttctcacataaagggtggatacaaagctaacatgccgtgcaatggccatcttgaaaggcttgattatgtgatgctctctgataaaagattttcatctctgagtagtaaattgcgagagaaaatttatgatgctttccttgattatgagggtatgaagcgcactgctagggaatatgatctgtcggattttgtcaacagtcttcacagaagtctagtttctgagggctacaatggggctttggtggatttcatttacatagacgaggtgcaggatcttaccatgtcacaaatagcacttctcaagtatgtgtgcaggaactttaaggagggctttgtttttgctggtgacacagcacaaactatagcaaggggtgttgacttcaggtttgaagatgttcgctcactgttttacacctcatttctctcagaaactgaagcatgcaaccaagctactaaacatggaaaacaagctcgtgtcacggatatgttccaactaagtcagaatttccgcacgcattgtggtgttcttcgaatggctcaaagtataatgagtcttctttactattttttcccgtcatgtgttgataagcttaatccagaaactgggcttgtatatggtgaagcacctgttcttctcgagtctggtaacgatgagaatgcaattatgactatttttggagaaagtagaggtgaacatggtgaccagcatgggtttggtgctgagcaagtcatattggttcgtgatgatgcaacgaagaaacaagttcttaaccttgttggtaaacaagctcttgtcttgtctatcgttgaatgcaagggccttgaattccaggacgtgctactctacaacttttttagttcatcgccattacggaacaaatggagagttgtatatgactacatgaaaacaagagatgttatgtcaacatctgaagttatatctcatccaggttttgacagaaacaagcattacctactatgttcagaactgaagcagctctatgtcgcaatcacacgaactaggcaaagactatggatatgtgaaaatgctgatgactactgtcaaccaatgttcgactattggaagaaattgtgcattgtagaggttagactacttgattcttcactgattcaagcaatgcagacagggagcagtgctgatgattggaggctaaggggtaccaagttatttaatgaggggcaatttgagatggctacaatgtgctttgaaaaggctggtgatgcatataaagagaaatgggcaagagctgctggacttcttgcaactgctgaccgggtcatctcctaa

SEQ ID NO: 18467 - protein, 1707 aa, Sorghum bicolor
  misc_feature: Useful for making plants with modulated salt sensitivity
  misc_feature: Functional homolog of the protein sequence given in SEQ ID NO 13507
  misc_feature: Ceres ANNOT ID no. 8702684
MAEEERDLGDIVLSWSVQEIMDDDLHKGKRWILLILRTMKAWALPLNRMIRIVLIEKNYIKGTTIVPNDRQIGTFYVNWCWRLKIFIPQLVEKIPFSFSSLDDYLRSYIAPLIEETRSGLSSCLELIAEAPSSKILSMEAAGKSGLYFMDVDFWDNGAGFSTETYTARNGDIFILSSMKPEATDDFNRYGLTYCLAMVTEVSMNDDYQKGFKVKVSNGTGLEGDFSKLVHATFLDNIMTNIRIWKALCFDSSMNNNFTVIRSLLAPRNMEQLLLVNLNQSQVDAIESIISAVRCRHLNLTKLIWGPPGTGKTKTVSAMLWALACLKCRTLTCAPTNVAVVGVCTRFLKNLKEFNKQIDKTGLPLSLGDVLLLGNKYNMDITEELQEVFLDYRADELTECFSSLSGWRYIIASMISFFEDCGSRYDMLLEDDESHDSVCFLDFLKKQFDVAAKAVKKCMMTLWLHLPGKCFSHENVNNISMLLVWLEKIDALLCDGDLTDESVKRGFDFQSTENSINAEPISSIEKELGGAKSLCLKLLKDLRNSLNLPVSADRNWIQNYCMRNATLIFCTASSSYRLHNATIAPLDVLIVDEVCKEAGFGISLFERLVILNFEKHLLNIQYRMNPCISLFPNAKFYEKKILDGPNVFSSSYNKDYMGLPFGSYAFINITDGREEKEGAGNSWRNLVEVAVVLHLIQTIFKSWRKRGQGISIGVVSPYSSQVAAIKDRLGKKYDTSDGFHVRVKSIDGFQGEEDDVIILSTVRSNGRGNVGFLADNQRTNVALTRARHCLWILGNANTLYKSGTVWTDLVADAERRKCISNAINDTELCKLILHVKNELDELDDLLCSNSAVFSNTRWKVVLSDNFRRSFMKLKSPLLRREVLQKLVKLGGGWRTPIKNLDVTDAFQLAKAYRIRDLYLVWSTDLEKNERYFQIIRIWDILSHQHIARTVQHLENLFSMYTDDYLDHCRRVQLEGKLEVPIVWDAEHDIVRYKKDCRLDDKEDHDHVDTSCALENTKVSESFLLMKFYSLSSGVAKHLLTATDGTEIEIPFELTDEEEAIIRFPLTSFILGRSGTGKTTVLTMKLYQIEQHSLIASQGIELDEVDLSVADPKSSLAMDTNKRESFVKQVLITVSPKLCSAIKNHICRLRRFGSGDVSDQPNTLHMHDVFDDLEEFTDVPDNFSDLLHGHYPLTITYRKFLMMLDGTVHTSFFDMFYGDFKPSIERGHSKTRALQAFIESKEVTFEKFAAFYWPHFNGELTKKLDASTVFTEIISHIKGGYKANMPCNGHLERLDYVMLSDKRFSSLSSKLREKIYDAFLDYEGMKRTAREYDLSDFVNSLHRSLVSEGYNGALVDFIYIDEVQDLTMSQIALLKYVCRNFKEGFVFAGDTAQTIARGVDFRFEDVRSLFYTSFLSETEACNQATKHGKQARVTDMFQLSQNFRTHCGVLRMAQSIMSLLYYFFPSCVDKLNPETGLVYGEAPVLLESGNDENAIMTIFGESRGEHGDQHGFGAEQVILVRDDATKKQVLNLVGKQALVLSIVECKGLEFQDVLLYNFFSSSPLRNKWRVVYDYMKTRDVMSTSEVISHPGFDRNKHYLLCSELKQLYVAITRTRQRLWICENADDYCQPMFDYWKKLCIVEVRLLDSSLIQAMQTGSSADDWRLRGTKLFNEGQFEMATMCFEKAGDAYKEKWARAAGLLATADRVIS

SEQ ID NO: 18468 - DNA, 819 bp, Sorghum bicolor
  misc_feature: Ceres ANNOT ID no. 8702687
  misc_feature: Encodes the peptide sequence at SEQ ID NO 18469
atgttgcgggggagctacggctgtggcggggcggcgtcacgggaccccaagccgcggctgcggtggacgccggacctccaccagcgcttcgtcgaagccgtcaccaggctcggcggcccggacaaagcaacacccaagtcagtgctcagattgatgggcatcaaaggcctcactctttaccatctaaaaagccacctccagaagtatagactgggaatacagggcaagaaaagcacaggcttggaacttgccactggcggagttttctcacaaggcctcagttcaaccacagcgcatcctccaggtgttcctgatgaaggaaagagcacgagagaaatagcacttagcaatgcactaaggtatcaaattcaagtccaaaggaaactacaagaacaaattgaggtgcaaaagaagctgcagatgcgaattgaggcccaagggaagtacttaaagacaatactagagaaagctcagacaaatatttcctttgacacagatgcatccaatggcatagaatcaaccagatcacagctcatgggcctcaaccaagctctatcaggtttcatggacaatgcaactcaagtatgcaaagaaaataggaagcaattggtgaaagctttgtcagatgacaacgataaagataatctaggctttcagctgtaccatgtaggaagtcaggaggctaaggaagtcaaatgcacaccaaaaactgaagactcgctcctactagacttaaatattgaaggaggatatgacctctcttctagaggaatgcaagcatgtgaactagaattgaaaatcaaccagcagataggataa

SEQ ID NO: 18469 - protein, 272 aa, Sorghum bicolor
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: Useful for making plants with altered alkaloid content
  misc_feature: Useful for making plants with altered terpenoid content
  misc_feature: Functional homolog of the protein sequence given in SEQ ID NO 13070
  misc_feature: Useful for making plants with altered lignin content
  misc_feature: Functional homolog of the protein sequence given in SEQ ID NO 13089
  misc_feature: The sequence is a functional homolog of SEQ ID NO 1097 in the 11/479,226 US patent application
  misc_feature: The sequence is a functional homolog of SEQ ID NO 2402 in the 10/374,780 US patent application
  misc_feature: The sequence is a functional homolog of SEQ ID NO 548 in the 10/225,066 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
  misc_feature: Ceres ANNOT ID no. 8702687
  misc_feature (19)..(70): Pfam ID: Myb_DNA-binding Pfam Description: Myb-like DNA-binding domain
MLRGSYGCGGAASRDPKPRLRWTPDLHQRFVEAVTRLGGPDKATPKSVLRLMGIKGLTLYHLKSHLQKYRLGIQGKKSTGLELATGGVFSQGLSSTTAHPPGVPDEGKSTREIALSNALRYQIQVQRKLQEQIEVQKKLQMRIEAQGKYLKTILEKAQTNISFDTDASNGIESTRSQLMGLNQALSGFMDNATQVCKENRKQLVKALSDDNDKDNLGFQLYHVGSQEAKEVKCTPKTEDSLLLDLNIEGGYDLSSRGMQACELELKINQQIG

SEQ ID NO: 18470 - DNA, 1518 bp, Sorghum bicolor
  misc_feature: Ceres ANNOT ID no. 8702670
  misc_feature: Encodes the peptide sequence at SEQ ID NO 18471
atgtgcgactacttccttccgaggatggagggcgaccaggccggcggcggcggcggcgaccttaccgacatcgtccggtccggcggggccatccctggcaacgccgctgagatgtcgtccacggccgccgcggacgagtggcagctccagggggacccgatgctcttcccgccgcttccctcgtccacgacgtcggaagcagcagcctgctccgccggcgggggcacaggtgccgacgtcttcggcgccgaccctttctcggggctcgtggacccgtttagtaccgactactcctcaggcgccgacttcttggacgccatgccggacgcgatggccaaggtcggcttcgacacggctatctgtggcggcagcggcagcggctgcggaggaggcggagcaggcggaggcggccagctgatagacatgagccggaagcagcctctcttgccgcggggggtgcagatgccggcgcttggagtgctggcgccgaggatggtgttgccgtcgccgttgtcgtcgccgagggagatacgaccgtacccgccgttagccggcgacatggtcaagctcgggatcacggccgggcaggtggccgggtgcgccatcgacgcagccgtcgtcggcatgcagatgtcttcgcctcgctccgcgggcgggatcaagcgcaggaagaaccaggcaaggaaggtggtatgcatcccggcgccgacagcagctgggggaagaccaactggagaggtggttccttctgatctctgggcctggaggaagtacggccagaagcctatcaagggttctccttatccaagagggtactacagatgcagcagctcaaaagggtgctcagcacggaagcaagtggaacgcagtcggactgacccaaacatgctcgtcatcacctacacctctgagcacaaccatccatggccgactcagcgcaacgccctggccgggtcaactcggaatcaccacggcaagaacagcggcggcagctcaggttccaagagctcacagaacgagaagcaacagcaacagcagcaaccaaacaacgtcaaggaagagcccaaggatccggcggccacgacgacaaccactagcacgattactaccacaactactagtacttctccggcagcggttgtgaaagaggagacgctggcagctggatcatcgtcagaggcactggggcaacaagtcatggatactacagcgctagcagtagtagaccacaacattgaactcatggaccaggtgttcggcgagagctacaagccgatgataccggaggccggccactctgacgacttcttctccgacctcgcggagctggagtcagatcccatgagcctaatcttctccaaagagtacatggaagcgaaacccagcagcggtggtgatcgtggccaccatcaggagaaagcaatgtccaaggacttggatccattgtttgacatgctagattggtctactaattcctcatcagctgggagcccatttgagcaaggaaagagaggctaa

SEQ ID NO: 18471 - protein, 505 aa, Sorghum bicolor
  misc_feature: The sequence is a functional homolog of SEQ ID NO 1026 in the 10/412,699 US patent application
  misc_feature: The sequence is a functional homolog of SEQ ID NO 534 in the 10/374,780 US patent application
  misc_feature: Ceres ANNOT ID no. 8702670
  misc_feature (249)..(309): Pfam ID: WRKY Pfam Description: WRKY DNA -binding domain
MCDYFLPRMEGDQAGGGGGDLTDIVRSGGAIPGNAAEMSSTAAADEWQLQGDPMLFPPLPSSTTSEAAACSAGGGTGADVFGADPFSGLVDPFSTDYSSGADFLDAMPDAMAKVGFDTAICGGSGSGCGGGGAGGGGQLIDMSRKQPLLPRGVQMPALGVLAPRMVLPSPLSSPREIRPYPPLAGDMVKLGITAGQVAGCAIDAAVVGMQMSSPRSAGGIKRRKNQARKVVCIPAPTAAGGRPTGEVVPSDLWAWRKYGQKPIKGSPYPRGYYRCSSSKGCSARKQVERSRTDPNMLVITYTSEHNHPWPTQRNALAGSTRNHHGKNSGGSSGSKSSQNEKQQQQQQPNNVKEEPKDPAATTTTTSTITTTTTSTSPAAVVKEETLAAGSSSEALGQQVMDTTALAVVDHNIELMDQVFGESYKPMIPEAGHSDDFFSDLAELESDPMSLIFSKEYMEAKPSSGGDRGHHQEKAMSKDLDPLFDMLDWSTNSSSAGSPFEQGKRG

SEQ ID NO: 18472 - DNA, 576 bp, Sorghum bicolor
  misc_feature: Ceres ANNOT ID no. 8702702
  misc_feature: Encodes the peptide sequence at SEQ ID NO 18473
atggcgggcggcttcacgttcaccagacccatccagctctccgccgtcggcccggccatgggacaagcctggggtaatctccaagacaaacttcaagggcggcggtggaaggagcaccaggtgaggaagatcaccgacaaggtgttcgaccgcctcacggaggacgcccagaagcgcgagaaggaggccctcagattcgaggaggtctacatcgccgtcctctgcgtctacaatgacatcaacaagtacttgccagggccgcaccacgatcccccgtccaaggagaagctcaaggccatgatggatgagtacgacgtgaacctggacgggctcctggaccgcgaggagttcgcggagttcatccggaagctgaccgcggactcgctgtgcacgatcagcgtgaagctgctgatcacgctggtggcggcgccggcgctggcgatggcgaccaagcgggcgacggagggcgtccccggcgtgggcaaggtggtgcgcaagatgcccaacgcgctctacgcctccgccatcaccctgggcgtcctgctggcgcagaaatccgccgagggcgtcgagtga

SEQ ID NO: 18473 - protein, 191 aa, Sorghum bicolor
  misc_feature: Useful for making plants with modulated cold sensitivity
  misc_feature: Functional homolog of the protein sequence given in SEQ ID NO 13072
  misc_feature: Ceres ANNOT ID no. 8702702
  misc_feature (96)..(124): Pfam ID: efhand Pfam Description: EF hand
MAGGFTFTRPIQLSAVGPAMGQAWGNLQDKLQGRRWKEHQVRKITDKVFDRLTEDAQKREKEALRFEEVYIAVLCVYNDINKYLPGPHHDPPSKEKLKAMMDEYDVNLDGLLDREEFAEFIRKLTADSLCTISVKLLITLVAAPALAMATKRATEGVPGVGKVVRKMPNALYASAITLGVLLAQKSAEGVE

SEQ ID NO: 18474 - DNA, 855 bp, Sorghum bicolor
  misc_feature: Ceres ANNOT ID no. 8702728
  misc_feature: Encodes the peptide sequence at SEQ ID NO 18475
atggcgagcgcttttagctcgagcggggcttgcgtgctgctggcgctgctcctggttctcttcgccaccggcgcgccgacggcggcggcggccggcagagtcgacgacggcctggaggtgacgtggggcgacggccgcgggagcgtctcgcccgacggccaggtgctgtcgctgtcgctcgaccacacctccggctccgggttccggtccaaggacacgtacctcttcgcgcgcgccgacgcgcagatcaagctcgtccccaacaactccgccggcaccgtcaccaccttctacttcatctcggaggggccatgggatgtccacgacgaggtcgacctcgagttcctggggaacgtgagcgggcagccctacacgctgcacaccaacgtgtacgccaacggcaacggcggcagggagcagcagttccacctctggttcgaccccaccgccgacttccacacctactccatcgagtggacgcagcagcacatcctcgtgctggtggacgggacgccgatccgggagttcaagaaccacgcggaccggggcgtgccgtacccgtcgtcgcagcggatgcgcctgtacggctcgctgtgggacgccgaggactgggccacgcagggcggccgcgtcaagacggactggtcgcaggcccccttcgtggcgcagtaccgcagcttcacggccaccgcgacgccgccggcggcggcgaccacagcggggtacgggcagcagatggacgcggcggcgcagcagtcgatgaagtgggcgcgggacaactacatggtgtacgactactgcgcggacaccaagcgcttcccgcagggcgtcccgccggagtgctccatgccgtag

SEQ ID NO: 18475 - protein, 284 aa, Sorghum bicolor
  misc_feature: Useful for making plants with altered carbohydrate content
  misc_feature: Functional homolog of the protein sequence given in SEQ ID NO 14637
  misc_feature: Useful for making plants with altered cell wall content and/or composition
  misc_feature: Functional homolog of the protein sequence given in SEQ ID NO 14638
  misc_feature: Ceres ANNOT ID no. 8702728
  misc_feature (38)..(282): SWISSPROT Homolog: EC 2.4.1.207 Xyloglucan:xyloglucosyl transferase
  misc_feature (34)..(217): Pfam ID: Glyco_hydro_16 Pfam Description: Glycosyl hydrolases family 16
  misc_feature (235)..(281): Pfam ID: XET_C Pfam Description: Xyloglucan endo-transglycosylase (XET) C-terminus
MASAFSSSGACVLLALLLVLFATGAPTAAAAGRVDDGLEVTWGDGRGSVSPDGQVLSLSLDHTSGSGFRSKDTYLFARADAQIKLVPNNSAGTVTTFYFISEGPWDVHDEVDLEFLGNVSGQPYTLHTNVYANGNGGREQQFHLWFDPTADFHTYSIEWTQQHILVLVDGTPIREFKNHADRGVPYPSSQRMRLYGSLWDAEDWATQGGRVKTDWSQAPFVAQYRSFTATATPPAAATTAGYGQQMDAAAQQSMKWARDNYMVYDYCADTKRFPQGVPPECSMP

SEQ ID NO: 18476 - DNA, 948 bp, Sorghum bicolor
  misc_feature: Ceres ANNOT ID no. 8702734
  misc_feature: Encodes the peptide sequence at SEQ ID NO 18477
atggccgtggacctgatgggctgctacgccccgcgccgcgccgacgaccagctcgccatccaggaggcggcggcggaaagtctccgcagcctggagctcctggtgtcgtccctgtccacccaggccggcgcgccgcacagggccgctcatcacctgcagcagcagcagccgttcggcgagatcgccgaccaggccgtctccaagttccgcaaggtcatctccatcctggaccgcaccggccacgcccgcttccgccgcgggcccgtcgagtccccgccgcgggcggccgcggcgcctccggtccccgctcccgctccggctctctccctggctccgttggctcacgtggcgcccgtcagcgcggcgcagccggcgccggcttcccagccgccgcagagcctgacgctggacttcacgaagcctaacctgaccatgtcgggcgccacgtccgtcacctccacgtcgttcttctcctccgtcacggccggcgagggcagcgtctccaagggccggagcctgatgtcctccggcaagccgccgctgtccggccacaagcggaagccctgcgccggcgcgcactccgaggccaccaccaacggcggccgctgccactgctccaagagaaggaaaaaccgcgtgaagaggaccatcagagtgccggcgatcagctcgaagatcgccgacatcccgccggacgagtactcgtggaggaagtacggccagaagcccatcaagggctccccttacccacggggctactacaagtgcagcactgtgcggggatgcccggcgaggaagcacgtggagcgcgccaccgacgacccggccatgctggtggtgacctacgagggcgagcaccgccacacgcccggagcggccgggcccagccccctggcgaccgcgtctccggtggccgccgctgtctccgccggcaacggccatgtctag

SEQ ID NO: 18477 - protein, 315 aa, Sorghum bicolor
  misc_feature: The sequence is a functional homolog of SEQ ID NO 1277 in the 11/479,226 US patent application
  misc_feature: The sequence is a functional homolog of SEQ ID NO 2442 in the 10/374,780 US patent application
  misc_feature: The sequence is a functional homolog of SEQ ID NO 48 in the 11/375,241 US patent application
  misc_feature: The sequence is a functional homolog of SEQ ID NO 590 in the 10/412,699 US patent application
  misc_feature: The sequence is a functional homolog of SEQ ID NO 632 in the 11/435,388 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8702734
  misc_feature (230)..(290): Pfam ID: WRKY Pfam Description: WRKY DNA -binding domain
MAVDLMGCYAPRRADDQLAIQEAAAESLRSLELLVSSLSTQAGAPHRAAHHLQQQQPFGEIADQAVSKFRKVISILDRTGHARFRRGPVESPPRAAAAPPVPAPAPALSLAPLAHVAPVSAAQPAPASQPPQSLTLDFTKPNLTMSGATSVTSTSFFSSVTAGEGSVSKGRSLMSSGKPPLSGHKRKPCAGAHSEATTNGGRCHCSKRRKNRVKRTIRVPAISSKIADIPPDEYSWRKYGQKPIKGSPYPRGYYKCSTVRGCPARKHVERATDDPAMLVVTYEGEHRHTPGAAGPSPLATASPVAAAVSAGNGHV

SEQ ID NO: 18478 - DNA, 942 bp, Sorghum bicolor
  misc_feature: Ceres ANNOT ID no. 8702729
  misc_feature: Encodes the peptide sequence at SEQ ID NO 18479
atggcggcactgctttgcagccccagcaaggtgcggcgcagcatgcttctggtcggcgtagcgctgatgatggtcgggatgcacctgagcgcggcgaccctggacgaggagatcgagctcatctggggcgcaagccacacctacttcttcatggacggcgaaaccgagacgctggcgctgtccctggacgaacagcagggctcttgcttccggtccaaggacatgtacctctacggcaccatcagcatggacatcaagctcgtcgagggcaactccgccggcgtcgtcgccaccgcctacaccatctccgaaggcccgtggtcgtatcacgacgagatcgacctggagttcctcggcaaccaaaccggccagccaatcgtcctccacaccaacatcttcgtcaacggcgtcggcggccgggagcagcagttctacctcccgttcgaccccaccgccgactaccacacctacaccatcgagtggaaccccaagtacatcctgatcaaagtggacgggaaggcgatccgggcgttcaagaactacgagcagtacggcgtggcgttcccgacgtggcagcagcagcgcgtgtacggcagcctgtgggacgcggacgagtgggcgacgcagggcgggcgcatcaagaccgactggtcggaggcgcccttcgtcgcctactaccggaactacaccgtggcctggtgccagccgtcgcccggcgtgtcgtggtgcggcgccgagcccagggactcgaagcgcttcgacctggaccagaagacgctgggggagctgtggtgggcgagccagcagtacaggatctacgactactgctccgaccacaagaggttcaacgactccgaattccccaaggaatgctcgctgcaacgccaaggactatgtatcaagatttctctgacagagttgcgctttgttttcgccatgtaa

SEQ ID NO: 18479 - protein, 313 aa, Sorghum bicolor
  misc_feature: Useful for making plants with altered carbohydrate content
  misc_feature: Functional homolog of the protein sequence given in SEQ ID NO 13783
  misc_feature: Ceres ANNOT ID no. 8702729
  misc_feature (16)..(293): SWISSPROT Homolog: EC 2.4.1.207 Xyloglucan:xyloglucosyl transferase
  misc_feature (34)..(219): Pfam ID: Glyco_hydro_16 Pfam Description: Glycosyl hydrolases family 16
  misc_feature (243)..(291): Pfam ID: XET_C Pfam Description: Xyloglucan endo-transglycosylase (XET) C-terminus
MAALLCSPSKVRRSMLLVGVALMMVGMHLSAATLDEEIELIWGASHTYFFMDGETETLALSLDEQQGSCFRSKDMYLYGTISMDIKLVEGNSAGVVATAYTISEGPWSYHDEIDLEFLGNQTGQPIVLHTNIFVNGVGGREQQFYLPFDPTADYHTYTIEWNPKYILIKVDGKAIRAFKNYEQYGVAFPTWQQQRVYGSLWDADEWATQGGRIKTDWSEAPFVAYYRNYTVAWCQPSPGVSWCGAEPRDSKRFDLDQKTLGELWWASQQYRIYDYCSDHKRFNDSEFPKECSLQRQGLCIKISLTELRFVFAM

SEQ ID NO: 18480 - DNA, 183 bp, Sorghum bicolor
  misc_feature: Ceres ANNOT ID no. 8702731
  misc_feature: Encodes the peptide sequence at SEQ ID NO 18481
atgcacgccaacgtgtttgtgcaggggagaggtaacacagagaaggagttctacttctggtttgatcccactgcggatttccacaccattctctggaacccacacaacatcatgtacgtggcaaaccttgcgcctgcatttcactctttttatatctgcatgaactattttttatctacttga

SEQ ID NO: 18481 - protein, 60 aa, Sorghum bicolor
  misc_feature: Useful for making plants with altered cell wall content and/or composition
  misc_feature: Functional homolog of the protein sequence given in SEQ ID NO 14639
  misc_feature: Useful for making plants with altered carbohydrate content
  misc_feature: Functional homolog of the protein sequence given in SEQ ID NO 13783
  misc_feature: Ceres ANNOT ID no. 8702731
  misc_feature (1)..(45): SWISSPROT Homolog: EC 2.4.1.207 Xyloglucan:xyloglucosyl transferase
MHANVFVQGRGNTEKEFYFWFDPTADFHTILWNPHNIMYVANLAPAFHSFYICMNYFLST

SEQ ID NO: 18482 - DNA, 1407 bp, Sorghum bicolor
  misc_feature: Ceres ANNOT ID no. 8702727
  misc_feature: Encodes the peptide sequence at SEQ ID NO 18483
atggcagcggctagggcgcacctcctagccttcctatcggttctcacgacgatggtggtcgccctctcttcggcggctgccggtggtggtcgcatgacggaccagctcgacatactctggggcccgacgcagcttctcaacggaagcaacggcgacgaccagaccatcgggctgtcgctggaccgcgtcatggggtcgggcttccggtccaagacctcctatctcttcgccaggatcgacatcgacatcaagctcgtcccgggcaactccgccggcaccgtcacgacggtttacttgatgtctgaaaagcagtggaaaacccatgacgagatcgacctggagttcctgggcaacctcaccggcgagccgtacaccctgcacaccaacatcttcgccaatggctccggcggcagggaggtgcagtaccgcctctggttcgaccctactctagacttccacacctactccatcatctggaattcagacgagatcctgatcctggtcgacaacaaggcgatccggcggttcaggaaccactggaatgccggcgtccccttcccggtgtaccagccgatgaggctgaacggcgtgctctgggacgccgacgactgggcgacgcagggcgggcgcgtcaagacggactggacccaggcgccgttcaccgcctacttccggaactaccgcgccaccggctgcgagccgagcgggttcgcgtcgtgggtgtgcggccagcagggcgcggcgcccggcggcggcggcgactggttcgacggcggagcggccggtgggctggacgacatgaagcagcaggagcagctgagggaggcgcaggataggtacatgatctacaactactgcaccgacaccaagaggttccctggtggcttccccacggaatatatgtcagcggctgaaatttcccgcgagtggagggatggtcaggtcaagcaaggtttcgctgctcatccgcgccatcgtctcgccttctgcggcggcggctcccgtccatacggagcaggagcgcgcgcgaggcaagaagtggtgccggttgggtccacattgcccgtgctggcgctgctgaggctggccaagtccgccgcagcggggcggagagaggtgctggagtctggcaatgcggcggtgctgctgcggcacacggaggccggggacgaggcagtggccagggcgctcctacacctcagcctggatggacggcgccgtggacgtgctctccgcggcggtgtcctgcggcggcgtatccgcggcgtccgcggtcacgctctacaagctgctagagaaccgccgtcccgcggtgcgagaggactccccgcccgcgctcgccgacgtcgccgccgaaggctccgcgcacgacgtcgagatgctcggtctcctcgccaggtgccgtga

SEQ ID NO: 18483 - protein, 468 aa, Sorghum bicolor
  misc_feature: Useful for making plants with altered carbohydrate content
  misc_feature: Functional homolog of the protein sequence given in SEQ ID NO 14637
  misc_feature: Useful for making plants with altered cell wall content and/or composition
  misc_feature: Functional homolog of the protein sequence given in SEQ ID NO 14640
  misc_feature: Ceres ANNOT ID no. 8702727
  misc_feature (16)..(228): SWISSPROT Homolog: EC 2.4.1.207 Xyloglucan:xyloglucosyl transferase
  misc_feature (32)..(217): Pfam ID: Glyco_hydro_16 Pfam Description: Glycosyl hydrolases family 16
  misc_feature (242)..(300): Pfam ID: XET_C Pfam Description: Xyloglucan endo-transglycosylase (XET) C-terminus
MAAARAHLLAFLSVLTTMVVALSSAAAGGGRMTDQLDILWGPTQLLNGSNGDDQTIGLSLDRVMGSGFRSKTSYLFARIDIDIKLVPGNSAGTVTTVYLMSEKQWKTHDEIDLEFLGNLTGEPYTLHTNIFANGSGGREVQYRLWFDPTLDFHTYSIIWNSDEILILVDNKAIRRFRNHWNAGVPFPVYQPMRLNGVLWDADDWATQGGRVKTDWTQAPFTAYFRNYRATGCEPSGFASWVCGQQGAAPGGGGDWFDGGAAGGLDDMKQQEQLREAQDRYMIYNYCTDTKRFPGGFPTEYMSAAEISREWRDGQVKQGFAAHPRHRLAFCGGGSRPYGAGARARQEVVPVGSTLPVLALLRLAKSAAAGRREVLESGNAAVLLRHTEAGDEAVARALLHLSLDGRRRGRALRGGVLRRRIRGVRGHALQAAREPPSRGARGLPARARRRRRRRLRARRRDARSPRQVP

SEQ ID NO: 18484 - DNA, 441 bp, Sorghum bicolor
  misc_feature: Ceres ANNOT ID no. 8702779
  misc_feature: Encodes the peptide sequence at SEQ ID NO 18485
atgtacaattcatggctagttgtggaatggttaagtattatattactcttagttcttgaatgcattttttttgccaaaattttattgttgcagataagcagctatgaaaaagagctagaggaaatgaaacatatgactagacaggagtatattgcatacctaagaagaaatagcagtggattttctcgtggtgcgtcaaaatatcgtcgaacatcatcagcgtgggagagatggcaagcaaggatagggagagttgcaggaaacaaggatctctacttgggcaaattcagtaagctagctgccttcttttcttgtttatttgtttgtttggagaactcagtgaacggcaccatctggcgcgccgacatgtacggcagcgtgatctcccagctggccgaagctgggatgggcggctatgcctcgtacgggcaccacgcctag

SEQ ID NO: 18485 - protein, 146 aa, Sorghum bicolor
  misc_feature: Useful for biocontainment applications
  misc_feature: Functional homolog of the protein sequence given in SEQ ID NO 13650
  misc_feature: Ceres ANNOT ID no. 8702779
MYNSWLVVEWLSIILLLVLECIFFAKILLLQISSYEKELEEMKHMTRQEYIAYLRRNSSGFSRGASKYRRTSSAWERWQARIGRVAGNKDLYLGKFSKLAAFFSCLFVCLENSVNGTIWRADMYGSVISQLAEAGMGGYASYGHHA

SEQ ID NO: 18486 - DNA, 528 bp, Sorghum bicolor
  misc_feature: Ceres ANNOT ID no. 8702783
  misc_feature: Encodes the peptide sequence at SEQ ID NO 18487
atgtcacgatggcgccatcacgttccagcagctgctcgcatcctaggccccagccgagccgaccagacacttcacaattcacccgaaaatgtcgctgccctccagcgctctgaacatcgtcggctccgcctccatcacctccagcccttgtacttttgctcaaccaactctaacgataacgaccgggtgccctgcaactaccccgggcagaaggtgacgttccacgtggaggagggctccaaccccgtctacttcgcggtgctcgtcgagttcgaagacggcgacggcgacgtggtgcaggtggacatcatggaggccaactccggctactggacgccgatgcgcgagtcctggggatccatctggaggctggacgccaaccataggctgcaggcgcccttctcgctgcgcatcacaaatgagtccggcaggaagctggtggcacaagatggcaccatcacgttccacaaggcagcagctgctagcatcttaggcgagataaatcttttaagtctagttagttcataa

SEQ ID NO: 18487 - protein, 175 aa, Sorghum bicolor
  misc_feature: Useful for making plants with altered carbohydrate content
  misc_feature: Functional homolog of the protein sequence given in SEQ ID NO 14064
  misc_feature: Ceres ANNOT ID no. 8702783
  misc_feature (72)..(153): Pfam ID: Pollen_allerg_1 Pfam Description: Pollen allergen
MSRWRHHVPAAARILGPSRADQTLHNSPENVAALQRSEHRRLRLHHLQPLYFCSTNSNDNDRVPCNYPGQKVTFHVEEGSNPVYFAVLVEFEDGDGDVVQVDIMEANSGYWTPMRESWGSIWRLDANHRLQAPFSLRITNESGRKLVAQDGTITFHKAAAASILGEINLLSLVSS

SEQ ID NO: 18488 - DNA, 696 bp, Sorghum bicolor
  misc_feature: Ceres ANNOT ID no. 8702795
  misc_feature: Encodes the peptide sequence at SEQ ID NO 18489
atggcgcccaagaacgctctccccgccgccagcgccgtgaccgacggcatgatggagcccaggttccgcggcgtcaggaagcgcccgtggggccgctacgcggcggagatccgggacccggccaggaaggcccgcgtgtggctcggcaccttcgacaccgccgaggccgcggcgcgcgcctacgacgccgccgcgctccacttccgcggtcccaaggccaagaccaacttccccgtcgcgttcgccgcggccgcgcacgcgcaagcgctcgcgctcccgctcccgctgccgccgccgcccaagaagctggccgtgagccccagcagcagcaccgtggagtcctcgtcccgggactcgcccgccacgccgcccagggctcggtctccgtctccggccccgacggtgatgcctgcgccgtcgctcgacctttgtctcggcatgccggccatggtggctgcgcagccgttcctgttcctggacccgaggctcgcggtgaccgtggccgtgccggcgcccgtggcctgccggccgaccgctgttgccgccggtgccaagaagcagacagcaccaacatcctgcggtggagacgaggagcagagtgacacagggtcgtcgtcatctgtggtggacgcctccccggaagcggtttgcgtggggtttgacctcaacatgccaccgccggccgaggtggcgtag

SEQ ID NO: 18489 - protein, 231 aa, Sorghum bicolor
  misc_feature: Useful for making plants with altered lignin content
  misc_feature: Functional homolog of the protein sequence given in SEQ ID NO 13219
  misc_feature: Ceres ANNOT ID no. 8702795
  misc_feature (20)..(71): Pfam ID: AP2 Pfam Description: AP2 domain
MAPKNALPAASAVTDGMMEPRFRGVRKRPWGRYAAEIRDPARKARVWLGTFDTAEAAARAYDAAALHFRGPKAKTNFPVAFAAAAHAQALALPLPLPPPPKKLAVSPSSSTVESSSRDSPATPPRARSPSPAPTVMPAPSLDLCLGMPAMVAAQPFLFLDPRLAVTVAVPAPVACRPTAVAAGAKKQTAPTSCGGDEEQSDTGSSSSVVDASPEAVCVGFDLNMPPPAEVA

SEQ ID NO: 18490 - DNA, 1842 bp, Sorghum bicolor
  misc_feature: Ceres ANNOT ID no. 8702809
  misc_feature: Encodes the peptide sequence at SEQ ID NO 18491
atggccaagcccgtgaagcagctgactgctgctgcctccctctcgctgatgaaggccatcagcagcagcagcagccgtctcagctcaggcgggaacgcgcagcgcttcggctcgtcactaccctgcggccgcgggaggacgatgccgacgcaacggaggagcacgtcgtcgtcgacgcgccctgcggctccggtgaacagagttggccctggcagaagcaagcaacacgataagggagcatcagagactacgataatgcagcaactccagcaagtcgatgtgcttgagaacatggggatttctcggcattttgctggtgaaattaagcgtgtccttgacaggacatacagatgttggttactgagggatgaggaaattatgctggacgcagcgacatgtgcgatggcatttcgtattctaaggatgaacggatatgatgtctcttctgatgagctgtatcatgttgctgaagcatccatgttccataattcacttggaggatatttgaatgatacaagaacaatgttagaattacacaaagcttctacagttagtacctcagaagacgagtatatcctggataccataggctcatggtcaagtaccttactgagggaacaactagggtctggtggtgcactaaggagaactccactctttagagaggtggaacatgctctagattgtcccttctacaccacattggaccgtctagaccacaggtggaacatcgaaaatttcaatgttacgggccaccggatgctagagacaccatacttgtctagtcgacataccagcagagatattctaacgttggctgtccgagactttagttcctctcaatttaagtaccaacaagaacttaagcatcttgaaagctgggtgaaagagtgcaagttggaccagctaccatttgcacggcagaagttggcatacttctacttgtctgctgctggcaccatgttccctcctgaactgtctgatgctcgcattttgtgggcaaaaaatggtgtactcacaactgttgttgatgacttctttgatgttggaggatcaaaagaagaacttgaaaatcttttgttgtgggacgaacatcacaaaattgagttctactcggaacaagtagagattgtattttcttcaatttacaactcagttaaccagcttggagcaaaggcttctttgctacaagaccgcaatgttaccaaacacctagtacaaatatggttggatttgctaaagtctatgatgacagaggtagagtggcggatgagcaaatatgtgccaacagaggaggaatacatggcaaatgcatctttaacatttgcattaggccccattgtactgccaacattgtattttcttgggccaaagatcccgaagtctgccattaaagatccagaatacaacgagttgtttaggttaatgagcacatgtggtcggctcctgaatgatgttgaaacatttgagagagagtacaatgagggcaagctgaacagtgtttctctccttgttcttcatggtggctccatgtccatatcagatgctagaaggaaattacagaagcccatagacacctgcaggagagatctactacgactggttctacgtgaagaaggtgtcattcctaggccctgcaaggaattattctggaaaatgtgcaaggtgtgctacttcttctattcgggaactgatgggtttagctcaccagtggagaaggctagagaagtggatgcggtgatcaatgagccactaaagctccaaggaagccatgcatcgctgcgtgttgtgtgggagagggaggaaccaagcctcaatgatgttgttcatttgattcagtag

SEQ ID NO: 18491 - protein, 613 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 14641
  misc_feature: Ceres ANNOT ID no. 8702809
  misc_feature (85)..(587): SWISSPROT Homolog: EC 4.2.3.19 Ent-kaurene synthase
  misc_feature (268)..(532): Pfam ID: Terpene_synth_C Pfam Description: Terpene synthase family, metal binding domain
  misc_feature (48)..(252): Pfam ID: Terpene_synth Pfam Description: Terpene synthase, N-terminal domain
MAKPVKQLTAAASLSLMKAISSSSSRLSSGGNAQRFGSSLPCGRGRTMPTQRRSTSSSTRPAAPVNRVGPGRSKQHDKGASETTIMQQLQQVDVLENMGISRHFAGEIKRVLDRTYRCWLLRDEEIMLDAATCAMAFRILRMNGYDVSSDELYHVAEASMFHNSLGGYLNDTRTMLELHKASTVSTSEDEYILDTIGSWSSTLLREQLGSGGALRRTPLFREVEHALDCPFYTTLDRLDHRWNIENFNVTGHRMLETPYLSSRHTSRDILTLAVRDFSSSQFKYQQELKHLESWVKECKLDQLPFARQKLAYFYLSAAGTMFPPELSDARILWAKNGVLTTVVDDFFDVGGSKEELENLLLWDEHHKIEFYSEQVEIVFSSIYNSVNQLGAKASLLQDRNVTKHLVQIWLDLLKSMMTEVEWRMSKYVPTEEEYMANASLTFALGPIVLPTLYFLGPKIPKSAIKDPEYNELFRLMSTCGRLLNDVETFEREYNEGKLNSVSLLVLHGGSMSISDARRKLQKPIDTCRRDLLRLVLREEGVIPRPCKELFWKMCKVCYFFYSGTDGFSSPVEKAREVDAVINEPLKLQGSHASLRVVWEREEPSLNDVVHLIQ

SEQ ID NO: 18492 - DNA, 2436 bp, Sorghum bicolor
  misc_feature: Ceres ANNOT ID no. 8702810
  misc_feature: Encodes the peptide sequence at SEQ ID NO 18493
atgcccaacgttatggccgccgccccagccggctgcttacctcgcggggtgattcctccggcgcgatcgagcagaggcagagcatctcttcccggggtcgccagagcatatgcggagaggcggttggttgcagaaaacacaagcctgccaaacaagcatgtgcagcataaggaggaactggagactaggataaggaatcagctccggaggccccagttgccaccttctttgtacgacacagcctgggtttctatggtgccaatgcggggctctcatcatactccctgcttcccacagtgtgttgagtggatactgcagaaccagcaggatgatggatcttggggtgtcagccaatctggctcagaagtcaacaaggatgttctcctgtccacgttggcatgtgttcttgcgttgaagagatggaatgttggcagagagaacatgtggagaggactgcatttcattgggcggaacttctatgttgctatggacgagcaggtcgctgctcctgtaggtttcaacatcacttttcctggtttacttagcctcgccattgatatgggtttagaaattcctataagacaaactgatgtctgtgggattcttcacctccgtgagatggaattgaaaagacaggctgtggacagttcttatggaagaaaaacatatatggcttatatcgcagaagggttaggaagcatggtggactgggatgaagttatgaagttccagaggaagaatggatcattgttcagctctccttccacaactgctgttgcattaatccacaaatacaatgatccagcccttcaatacctaaatttgcttgtcagtgaatttggcagttcagtaccggcaatgtatcctttaaaaatacattgtcagctttcaatggtagatgcacttgaaagaatgggaatttctcagcactttgtcagtgaaatagaaagcatcctggacatggcatacagttgctggttacagaaagacgaggaaatcatgatggacaaagcaacatgtgcaatggcatttcgccttttgaggatgaatggttatgatgtttcctcagatgtgctgtctcatgttgctggaccttccactttccatgattcactacaaggatatttaaatgatacaaaatccctactggaattgtacaaggcttcaaaagtcagcttatcagaaaacgatttggtcttagatggcataggattctggtctggcaacttattgaaggataagttgtgctctagtagggtgaaaaaggacctgatttttggagagatggagtatgctgttaagtttcccttttatgccacactggagcgtctagaacacaagagaaacatcgaaaattttgatgcttggggtcctctgatgctaacaacaaaatcctcgtctttctgtatcgatcaggaatttgtagctttggctgtcgaagatttcagtttctctcaatatgtttaccaggatgaacttcggcatctcgatagttgggtgaaggagaacaagctggaccagctacaatttgctcggcagaaactgacatattgctatctgtctgctgctgctaccatattttcttctgaattgtctgacgctcgcatttcatgggccgaaaatggcgttctcacaactgtggttgatgacttcttcgatgttgggggatcaaaagaagaattagaaaacctgatagcactagttgagaaatggcatgcacaccatacagttgggttctactcagagcaagtgaaaatagtattttctgctatttatacaacagtgaaccatcttggagtaatcgcttctgcagcacaaggccgtgatgttacaaaccacctagtagaaatatggctggatttgttgaggtctatgatggtcgagacagaatggcagagaagccaatatgtgccaacagttgaagaatacatgacgaatgctgttgtctcatttgcactgggcccaattgtgctcccagcattgtatttcgtagggcaagaggttttagagcatgctgtcaaagatgaagagtatgatgaattatttaggctaatgagcacttgtgggaggctcctcaatgacagtcaaagcttcgagagggaaggcaaccaggggaagctgaatagcgtttctctacttgtccgccacagtggtggttctatgtccatagaagccgctaaaaaggcactgcagaagtccatagacgtctctaggagagacttgctaagattggttctcaggaaagaaagcgttgttcctaggccatgcaaggagctcttctggaagatgtgtaagatacttcacttgttctactttcagactgatggatttagctccccaaaggaaatggtcagtgcagtgaatgctgttatcaacgagccactcacagtccaaaatactactagttcgtttttgtctagttcatcagggaagtga

SEQ ID NO: 18493 - protein, 811 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 14641
  misc_feature: Ceres ANNOT ID no. 8702810
  misc_feature (56)..(795): SWISSPROT Homolog: EC 4.2.3.19 Ent-kaurene synthase
  misc_feature (473)..(742): Pfam ID: Terpene_synth_C Pfam Description: Terpene synthase family, metal binding domain
  misc_feature (237)..(458): Pfam ID: Terpene_synth Pfam Description: Terpene synthase, N-terminal domain
MPNVMAAAPAGCLPRGVIPPARSSRGRASLPGVARAYAERRLVAENTSLPNKHVQHKEELETRIRNQLRRPQLPPSLYDTAWVSMVPMRGSHHTPCFPQCVEWILQNQQDDGSWGVSQSGSEVNKDVLLSTLACVLALKRWNVGRENMWRGLHFIGRNFYVAMDEQVAAPVGFNITFPGLLSLAIDMGLEIPIRQTDVCGILHLREMELKRQAVDSSYGRKTYMAYIAEGLGSMVDWDEVMKFQRKNGSLFSSPSTTAVALIHKYNDPALQYLNLLVSEFGSSVPAMYPLKIHCQLSMVDALERMGISQHFVSEIESILDMAYSCWLQKDEEIMMDKATCAMAFRLLRMNGYDVSSDVLSHVAGPSTFHDSLQGYLNDTKSLLELYKASKVSLSENDLVLDGIGFWSGNLLKDKLCSSRVKKDLIFGEMEYAVKFPFYATLERLEHKRNIENFDAWGPLMLTTKSSSFCIDQEFVALAVEDFSFSQYVYQDELRHLDSWVKENKLDQLQFARQKLTYCYLSAAATIFSSELSDARISWAENGVLTTVVDDFFDVGGSKEELENLIALVEKWHAHHTVGFYSEQVKIVFSAIYTTVNHLGVIASAAQGRDVTNHLVEIWLDLLRSMMVETEWQRSQYVPTVEEYMTNAVVSFALGPIVLPALYFVGQEVLEHAVKDEEYDELFRLMSTCGRLLNDSQSFEREGNQGKLNSVSLLVRHSGGSMSIEAAKKALQKSIDVSRRDLLRLVLRKESVVPRPCKELFWKMCKILHLFYFQTDGFSSPKEMVSAVNAVINEPLTVQNTTSSFLSSSSGK

SEQ ID NO: 18494 - DNA, 1113 bp, Sorghum bicolor
  misc_feature: Ceres ANNOT ID no. 8702814
  misc_feature: Encodes the peptide sequence at SEQ ID NO 18495
atggcaccggtggaggcggagcagcacccgcggacggcgctggcgctcgcggcgcacgacgcctccggccgcgtctcccccatccgcatctcgcgaagggacactggagatgacgatgttgccatacagatactgtactgcgggatatgccactctgatctgcacaccatcaagaatgagtggaagaatgccaactaccctgttgtccctgggcacgagatcgctggactgatcactgaggttggcaagaatgtgaagaagttcaacgtcggagacaaggttggcgtcgggtgcatggtcaacacttgccaatcctgcgagagctgtgaggaaggacacgagaaccactgctccaagatcatcttcgcctacaactcccatgacagggacggcaccatcacctacggtggctactctgacatggtcgtcgtgaacgagcgctttgtcatcaggttccctgatggtgtgccccttgacaaaggcgcgccactgctctgtgctgggataaccgtgtacaaccccatgaagtaccatgggctggacgagccgggcaagcacattggcgtggttggccttggggggcttgggcatgtcgctgtgaagtttgcaaaggcgttcgggatgagggtgaccgtgatcagcacgtccccggagaagagggaggaggctatggagacgcttggtgcagacgcctttgttgttagcagtgatgctaatcagatgaaggctgtgaagggcacaatgcatggcattctgaacacggcctctgcaagcatgtccatgtacgcttaccttgctctcctcaagccccagggcaagatgatcttgcttggcctgcctgagaagcctctgcagatctctgccttctctttggttactggtggcaagactctggccgggagctgtatggggagcatcagggacacgcaggagatgatggacttcgcagccaagcatgggctggtggcggacgtcgagctgatcggcaccgaagaagtaaatgaggccatggagcgcctcgccaagggcgaggtcaggtaccgcttcgtcatcgacgtcggcaacaccctcagcgcggcgtcactagcgagctcaccggtcccagctctgtag

SEQ ID NO: 18495 - protein, 370 aa, Sorghum bicolor
  misc_feature: The sequence is a functional homolog of SEQ ID NO 2 in US patent 7288696
  misc_feature: Useful for making plants with altered cell wall content and/or composition
  misc_feature: Functional homolog of the protein sequence given in SEQ ID NO 14642
  misc_feature: Ceres ANNOT ID no. 8702814
  misc_feature (1)..(356): SWISSPROT Homolog: EC 1.1.1.255 Mannitol dehydrogenase
  misc_feature (37)..(152): Pfam ID: ADH_N Pfam Description: Alcohol dehydrogenase GroES-like domain
  misc_feature (183)..(318): Pfam ID: ADH_zinc_N Pfam Description: Zinc-binding dehydrogenase
MAPVEAEQHPRTALALAAHDASGRVSPIRISRRDTGDDDVAIQILYCGICHSDLHTIKNEWKNANYPVVPGHEIAGLITEVGKNVKKFNVGDKVGVGCMVNTCQSCESCEEGHENHCSKIIFAYNSHDRDGTITYGGYSDMVVVNERFVIRFPDGVPLDKGAPLLCAGITVYNPMKYHGLDEPGKHIGVVGLGGLGHVAVKFAKAFGMRVTVISTSPEKREEAMETLGADAFVVSSDANQMKAVKGTMHGILNTASASMSMYAYLALLKPQGKMILLGLPEKPLQISAFSLVTGGKTLAGSCMGSIRDTQEMMDFAAKHGLVADVELIGTEEVNEAMERLAKGEVRYRFVIDVGNTLSAASLASSPVPAL

SEQ ID NO: 18496 - DNA, 1173 bp, Sorghum bicolor
  misc_feature: Ceres ANNOT ID no. 8702876
  misc_feature: Encodes the peptide sequence at SEQ ID NO 18497
atggcggaggcggtagcggtggcggtggcggtggcgtacgaggcgcagcggcagaggcaggtagaggcgaacaagcggaagctggacgagctgcagctccaccgcctctccgccgccgtcagagaggccgccgccgctgccaaaccctcgccggccaagaagtggaaggcgcgggtgccgcgggacggtgccgccgccggcgtggagccgctacggcggtccggccgactcgccgacctccccgagaagcccgtgtactaccaggtcagggtcaagaagctgctcaagtataatgcaagggtgccgctggacgctgccgagaggagctacgccatctctaaggctgaggagctggtgcaagatctgggctccagcttccccatcttcatccagcccatgatacagtcccatgtcaccagaggcttctggctgggcctcccgacgtatttctgccggaagcacctgcccaagagtgatgagacgatcaccctggtggtggatgaggagggtgacgagtcagacacgctctacctcgcaaagaaggctggcctcagcactggatggaaagagttcgccatcgagcacaagctgcatgatggagattgcttggtcttccaactcattgagcagacaaagttcaagttacggaggccggagcgtaggacaagctcgcatctggaaattgctaggtgtaacctttttgggtggcagaaagcaaaagaaaaacctagtgcattataccgaggcgaagtttatttttcaacattagccattgagttgctttcagcagcaggtggagtgcccagtacacccaccggcgtcagcactccgccgcgccgacgcccgccgacgctccaggacgtacgagcgcatggatcgcgcgaggaacgggcgcgagctacatgggcgcgccgacttcgtcggcaccgggctcgccgccgtggccaccgccatgtcgtacctcctgctcgtcgtcgtcggccgcaacgaccccggcggcacgcctctggaccccttcaccacgtggcaagtcatcctggcgcttgggctcatgtccggcggcctgctgcttgtcatgtacggcatgcgggcgccaggcgcgcggcctccggttctcgtccgccgcgccgcggacgccgcgggcgccttactgtggtacgcagctggacctga

SEQ ID NO: 18497 - protein, 390 aa, Sorghum bicolor
  misc_feature: Useful for making plants with altered terpenoid content
  misc_feature: Functional homolog of the protein sequence given in SEQ ID NO 13124
  misc_feature: Ceres ANNOT ID no. 8702876
  misc_feature (128)..(221): Pfam ID: B3 Pfam Description: B3 DNA binding domain
MAEAVAVAVAVAYEAQRQRQVEANKRKLDELQLHRLSAAVREAAAAAKPSPAKKWKARVPRDGAAAGVEPLRRSGRLADLPEKPVYYQVRVKKLLKYNARVPLDAAERSYAISKAEELVQDLGSSFPIFIQPMIQSHVTRGFWLGLPTYFCRKHLPKSDETITLVVDEEGDESDTLYLAKKAGLSTGWKEFAIEHKLHDGDCLVFQLIEQTKFKLRRPERRTSSHLEIARCNLFGWQKAKEKPSALYRGEVYFSTLAIELLSAAGGVPSTPTGVSTPPRRRPPTLQDVRAHGSREERARATWARRLRRHRARRRGHRHVVPPARRRRPQRPRRHASGPLHHVASHPGAWAHVRRPAACHVRHAGARRAASGSRPPRRGRRGRLTVVRSWT

SEQ ID NO: 18498 - DNA, 774 bp, Sorghum bicolor
  misc_feature: Ceres ANNOT ID no. 8702834
  misc_feature: Encodes the peptide sequence at SEQ ID NO 18499
atggggcgtggaaaagtagagctcaagaagattgagaatccaacaaaccgccaagttaccttctccaagaggcggatggggttgttcaagaaggcaaacgagctagccattctttgtgatgcgcaaatcggagtcatcatattctctggaagtggcaggatgtatgagtactccagtcctccatggagaatagcaagcatctttgacagatacctcaaagcccctagtacccgttttgaggagatggatatccagcagaaaatcatccaggagatgactaggatgaaggatgagaggaacaggctgaggatgatcatggcacagtacatgggggaggatctggccacattctccgtgcaagatctgagcaaccttgaacagcagatcgagttctcgctctacaaagttcgcctgaggaagcaagagctacttgaccaccagcagctgctcgagatccgccaaagggagatgcacataccaggagagcagagcggctacctatgcctcatgaaccaggctattgcgagggggcagcagcagcagcaggctcaggcaggcgagatggcgggaattaaccagaggccattcccgtggtgggacgtgggggccagtggcagtggcagccagagtcagcagcagcagctgcccggccgggacgcggcggagtcgtcgatgacggcgctgcagctgtcgccgcagctgcacgagtacaggctccagccacggcagcccaacctgcagcaggacgccaacgtccatggctggctctggtaa

SEQ ID NO: 18499 - protein, 257 aa, Sorghum bicolor
  misc_feature: The sequence is a functional homolog of SEQ ID NO 729 in the 10/666,642 US patent application
  misc_feature: The sequence is a functional homolog of SEQ ID NO 1701 in the 10/412,699 US patent application
  misc_feature: The sequence is a functional homolog of SEQ ID NO 1949 in the 10/412,699 US patent application
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 1967 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: Ceres ANNOT ID no. 8702834
  misc_feature (9)..(59): Pfam ID: SRF-TF Pfam Description: SRF-type transcription factor (DNA-binding and dimerisation domain)
  misc_feature (71)..(173): Pfam ID: K-box Pfam Description: K-box region
MGRGKVELKKIENPTNRQVTFSKRRMGLFKKANELAILCDAQIGVIIFSGSGRMYEYSSPPWRIASIFDRYLKAPSTRFEEMDIQQKIIQEMTRMKDERNRLRMIMAQYMGEDLATFSVQDLSNLEQQIEFSLYKVRLRKQELLDHQQLLEIRQREMHIPGEQSGYLCLMNQAIARGQQQQQAQAGEMAGINQRPFPWWDVGASGSGSQSQQQQLPGRDAAESSMTALQLSPQLHEYRLQPRQPNLQQDANVHGWLW

SEQ ID NO: 18500 - DNA, 2529 bp, Sorghum bicolor
  misc_feature: Ceres ANNOT ID no. 8702897
  misc_feature: Encodes the peptide sequence at SEQ ID NO 18501
atgagtccatttgtgctggctgtggtgagcattgcatttctcaacttgtggttcctgcaagctcatggaagtgaattgcttctgagctgtggctcgaacggcactgttgatgctgatgggcggagatggatcggtgacataacccctgagggcaattttaccttgagcagccctgggattgccgcgtcacaggttgggaagagcaattccgatgaaatattcggaccgctttacagttctgcccgtttctttgacgcagcaacttggtataccattagtgtgctgcctggaagttactgtgtcagattgcatttcttcccttcaacattcgggaatttcagtgcaaacaattctgtgtttgatgtcacagcaaatgatttcaagcttgtttcaaaattcaatgtgtcagaggagattgcttggagagcctctgtgagcaattcagtcatcagtgcagttgtcaaggagtactttcttgtagttggtgctcatggcctgaatattgagtttgatccaagacctgggtcatttgcctttgtgaatgcaattgaggtcatgctggctccagataatttgttcaatgatacagtgagcaaagttggtggtgcaggcgtgcagcttccgcttggcttgcgcggtagaggtgttgagacaatgtaccggctgaacattggaggtcctgcacttaaatcggccagtgatcagtatctccataggccatggtacactgatgaagcattcatgttttctacaaatgctgctcagactgtgtctaatgtttcaagcataatgtatgtatcaagcaacgactcatcagttgcaccgattgatgtttacgagactgcaagaatcatgagcaataacatggttgtggacaagcggtttaacgtgtcatggcgattctatgtccacccaaactttgattacttagtccgccttcatttctgtgagcttgtctatgacaagcccagccagaggatcttcaagatctacatcaataacaagactgctgctgagaactatgatgtatatgcgagggctgcgggaattaataaagcatatcatgaggacttctttgacaactcaacacagcaggcagactcactttggcttcagctaggccctgattccatgaccagtgcctcaggtactgatgcacttctgaatggtttggagatattcaagctcagcaaggattccgacctttcttacgtgcttggtcatattgacacgggcaaccaaaggagttcttcaaaagggggaaagaataaaggtctatgggaagaagttggtattggctcagcatctttagttgcagttacaagcgttgttctgttctcttggtgttatataagaaagaaacaaaaagctgttaagaaggaggcccctctcgggtggcatccgttggttctccatgagactatgaaaagcactacagatgctcgtgcaaccagtaaatcatccttggcacgaaatgcctctaacatcggtcataggatgggaagaagattcggcattgcagagattagggctgccacgaagaattttgatgagtccttaatcattggaactggaggatttggaaaggtatacaaaggtgagctcgatgagggcactacagtggctatcaagcgtgctaatacactatgtggccagggtctgaaagaatttgaaacagagattgagatgctttccaagcttcggcatcggcaccttgttgcaatgattggctactgtgaagagcagaaagagatgattctggtgtatgaatacatggctaaggggacactgagaagccatctctatgggagcaaccttcctcctctgacatggaagcaacggatcgatgcatgcattggtgccgcccgtggccttcactacctccacacaggagcggaccgaggtataatccacagggatgtaaagaccactaacatcctgttggacgagaattttgttgcaaaaatagcagactttgggctgtccaaaactggaccaacgctcgaccacacccatgttagtactgcagtcaggggaagctttggatacctagatccagagtacttccggaggcagcaactcacacaaaaatccgatgtgtattcttttggagtggtgctctttgaagttgcttgtgcaaggcctgtgatagatcccacattgccaaaggatcaaatcaacttggcagagtgggcgatgaggtggcagcgccagcgttcgctggaagcaatcatggatcctcgtctggatggcgacttctcatcagaatcactgaagaagtttggtgaaattgcagagaaatgtctcgctgatgatgggagaagcaggccatcaatgggcgaggtcctgtggcatcttgagtatgtgctgcagctccatgaagcttacaagcgaaatgtagagtctgaatcatttggaagcggtgagttgggattcgctgatatatcctttagcctccctcacatcagagagggggaagaggaacgccactctaagccatcaagtatcagagaggaactagacacatga

SEQ ID NO: 18501 - protein, 842 aa, Sorghum bicolor
  misc_feature: Useful for making plants with modulated biotic stress sensitivity
  misc_feature: Functional homolog of the protein sequence given in SEQ ID NO 14099
  misc_feature: Ceres ANNOT ID no. 8702897
  misc_feature (504)..(802): SWISSPROT Homolog: EC 2.7.11.1 Non-specific serine/threonine protein kinase
  misc_feature (516)..(786): Pfam ID: Pkinase Pfam Description: Protein kinase domain
MSPFVLAVVSIAFLNLWFLQAHGSELLLSCGSNGTVDADGRRWIGDITPEGNFTLSSPGIAASQVGKSNSDEIFGPLYSSARFFDAATWYTISVLPGSYCVRLHFFPSTFGNFSANNSVFDVTANDFKLVSKFNVSEEIAWRASVSNSVISAVVKEYFLVVGAHGLNIEFDPRPGSFAFVNAIEVMLAPDNLFNDTVSKVGGAGVQLPLGLRGRGVETMYRLNIGGPALKSASDQYLHRPWYTDEAFMFSTNAAQTVSNVSSIMYVSSNDSSVAPIDVYETARIMSNNMVVDKRFNVSWRFYVHPNFDYLVRLHFCELVYDKPSQRIFKIYINNKTAAENYDVYARAAGINKAYHEDFFDNSTQQADSLWLQLGPDSMTSASGTDALLNGLEIFKLSKDSDLSYVLGHIDTGNQRSSSKGGKNKGLWEEVGIGSASLVAVTSVVLFSWCYIRKKQKAVKKEAPLGWHPLVLHETMKSTTDARATSKSSLARNASNIGHRMGRRFGIAEIRAATKNFDESLIIGTGGFGKVYKGELDEGTTVAIKRANTLCGQGLKEFETEIEMLSKLRHRHLVAMIGYCEEQKEMILVYEYMAKGTLRSHLYGSNLPPLTWKQRIDACIGAARGLHYLHTGADRGIIHRDVKTTNILLDENFVAKIADFGLSKTGPTLDHTHVSTAVRGSFGYLDPEYFRRQQLTQKSDVYSFGVVLFEVACARPVIDPTLPKDQINLAEWAMRWQRQRSLEAIMDPRLDGDFSSESLKKFGEIAEKCLADDGRSRPSMGEVLWHLEYVLQLHEAYKRNVESESFGSGELGFADISFSLPHIREGEEERHSKPSSIREELDT

SEQ ID NO: 18502 - DNA, 930 bp, Sorghum bicolor
  misc_feature: Ceres ANNOT ID no. 8702891
  misc_feature: Encodes the peptide sequence at SEQ ID NO 18503
atgagcttgatcagcatgatggaggcgcggctgccgccggggttccggttccaccccagggacgacgagctcgtgctggactacctctgccgcaagctctccggcaaaggcggcggtggcggcggcgcctcgtacggtggcatcgccatggtcgacgtcgacctcaacaagtgcgagccgtgggatcttccaggcgaggcgtgcgtgggcgggcgcgagtggtacttcttcagcctgcacgaccgcaagtacgcgacggggcagcggaccaaccgcgccacgcgctccggctactggaaggccacgggcaaggaccgccccatctccatctccggccgccgccgcggcggaggcggcaacggcgccggcgcgctggtcgggatgcgcaagacgctggtgttctaccagggcagggccccccgcgggaccaagaccgagtgggtcatgcacgagttccgcgtggacggcccggccgttgccgaccgccccggctcacctctccaggaggattgggtcctgtgcagggtgttctacaagagccgaactaccaccacaagaccggcggcaggccccgacgaggccgggccactgtccagcgagctgatcggcctgccgatgccgcagatggcccctgccggcgacgcctacctgtccttcgacaacacaccggcggcggacggtggctactactaccaccaccaagacgccgacctcgcggacgcgcaccaccacctgccgctgccggcgagtagcctgtcgagcttccgggacctgctgagcagcatggtggaaggcagcgacgccgccgtccggggcacgacggagctccacctgcagggctggacggaggcggcctacgcgcagcagcagggcggcgtgatgtcgtcgcactcgcagcagacgtggaacccgttcctgagctctggatga

SEQ ID NO: 18503 - protein, 309 aa, Sorghum bicolor
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: Useful for making plants with altered lignin content
  misc_feature: Functional homolog of the protein sequence given in SEQ ID NO 12985
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 492 in the 11/435,388 US patent application
  misc_feature: The sequence is a functional homolog of SEQ ID NO 741 in the 11/479,226 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 106 in the 10/225,068 US patent application
  misc_feature: The sequence is a functional homolog of SEQ ID NO 2348 in the 10/374,780 US patent application
  misc_feature: The sequence is a functional homolog of SEQ ID NO 340 in the 10/412,699 US patent application
  misc_feature: The sequence is a functional homolog of SEQ ID NO 778 in the 11/479,226 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: Useful for making plants with altered terpenoid content
  misc_feature: Functional homolog of the protein sequence given in SEQ ID NO 13140
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: Ceres ANNOT ID no. 8702891
  misc_feature (11)..(155): Pfam ID: NAM Pfam Description: No apical meristem (NAM) protein
MSLISMMEARLPPGFRFHPRDDELVLDYLCRKLSGKGGGGGGASYGGIAMVDVDLNKCEPWDLPGEACVGGREWYFFSLHDRKYATGQRTNRATRSGYWKATGKDRPISISGRRRGGGGNGAGALVGMRKTLVFYQGRAPRGTKTEWVMHEFRVDGPAVADRPGSPLQEDWVLCRVFYKSRTTTTRPAAGPDEAGPLSSELIGLPMPQMAPAGDAYLSFDNTPAADGGYYYHHQDADLADAHHHLPLPASSLSSFRDLLSSMVEGSDAAVRGTTELHLQGWTEAAYAQQQGGVMSSHSQQTWNPFLSSG

SEQ ID NO: 18504 - DNA, 441 bp, Sorghum bicolor
  misc_feature: Ceres ANNOT ID no. 8702924
  misc_feature: Encodes the peptide sequence at SEQ ID NO 18505
atgacctatggtgccgagacggtttatctcggtgccataagtcacgacgccgagaaaaagattcaaagaaggagcgtgatggccaagacgagctcgttcaagctggagcaccccctcgagaagaggcagtctgaggctaaccggatcagggagaagtaccctgacagaattccagtgattgttgagaaggctgagaggagtgacattcctgacatcgacaagaaaaagtacctcgtccctgctgatcttacagttggacaattcgtgtatgtcgttaggaagagaatcaagctcagtgctgagaaggctatcttcatctttgtgaagaacacccttccaccaacagctgctctgatgtcttcaatctatgaagagaataaggacgaggatgggttcctctacatgacttacagtggtgagaacaccttcggtctgctctag

SEQ ID NO: 18505 - protein, 146 aa, Sorghum bicolor
  misc_feature: Useful for making plants with modulated nitrogen use efficiency
  misc_feature: Functional homolog of the protein sequence given in SEQ ID NO 14643
  misc_feature: Ceres ANNOT ID no. 8702924
  misc_feature (41)..(144): Pfam ID: MAP1_LC3 Pfam Description: Microtubule associated protein 1A/1B, light chain 3
MTYGAETVYLGAISHDAEKKIQRRSVMAKTSSFKLEHPLEKRQSEANRIREKYPDRIPVIVEKAERSDIPDIDKKKYLVPADLTVGQFVYVVRKRIKLSAEKAIFIFVKNTLPPTAALMSSIYEENKDEDGFLYMTYSGENTFGLL

SEQ ID NO: 18506 - DNA, 1311 bp, Sorghum bicolor
  misc_feature: Ceres ANNOT ID no. 8702946
  misc_feature: Encodes the peptide sequence at SEQ ID NO 18507
atggcgccgcctcctcctactcaggccggtggagggcagccaccgcagtggggcgggatcccgccgccgatgacgcagcagtacggcgcaccgcctccgcagcagcctccggcgatgtggggccagcctccgccgcaggcgcactacgggcaggcgccacctcctcagccgtactacgccgcgcctcctgcgcccgcgccggcgccggccgcccccgctgcggcggacgaggtcaggacgctctggatcggggacctgcagtactggatggacgagagctacgtcttgggatgcttcttgagcaccggggaggttcaaaatgtgaagctcatccgtgacaagaattcaggacagcttcagggctatggttttgttgaatttacaagccgtgcagctgcagagcgagttcttcagacatacaatggacagatgatgccaaatgttgagttgacatttcggctgaactgggccagtgctggtgaaaagcgtgatgatactcctgactataccattttcgttggggatttggctgcagatgttacagattacttgttacaagagacattcagggttcattatccctcggtgaagggtgcaaaagttgtgactgataaattgacaatgcgcacaaagggatatgggtttgtgaaatttggtgatcctacagagcaagctcgtgcaatgactgaaatgaatggaatgccttgttcttccaggcctatgcgtattggtcctgcagcaagtaggaaaaatacaggaggtgttgttcaagagagagtaccaaattctcaaggagctcagtctgagaatgatcctaacaataccaccatatttgttggtggtcttgaccccaatgtcactgaagataccctaaaacaagttttttctccttatggcgaagtcgtccatgttaagatacctgttgggaagagatgtggttttgttcagttcgttaccagaccttctgctgagcaagcgctgctaatgctgcaaggggccttgattggtgcacagaatgttcggctttcatggggtagaagcctgtcgaacaagcaggctcagcctcagcaggaatccaaccaatggggtgcagcagcggctgctggcgctggtggttactatggtggctatggacaaggttatgaggcttatggcagtgggtatgcacaacctcaggatcctaacatgtatggttatggtgcttatgctggttatcccaattaccaacagcaacaagctgcacagcagccacagcaacaacagtattctgcgtggaattccaaccatggtcgtttctttatgatggcgtaa

SEQ ID NO: 18507 - protein, 436 aa, Sorghum bicolor
  misc_feature: The sequence is a functional homolog of SEQ ID NO 536 in the 10/666,642 US patent application
  misc_feature: The sequence is a functional homolog of SEQ ID NO 1484 in the 10/666,642 US patent application
  misc_feature: The sequence is a functional homolog of SEQ ID NO 278 in the 10/714,887 US patent application
  misc_feature: The sequence is a functional homolog of SEQ ID NO 278 in the 11/435,388 US patent application
  misc_feature: The sequence is a functional homolog of SEQ ID NO 252 in the 10/714,887 US patent application
  misc_feature: The sequence is a functional homolog of SEQ ID NO 252 in the 11/435,388 US patent application
  misc_feature: The sequence is a functional homolog of SEQ ID NO 568 in the 10/666,642 US patent application
  misc_feature: Ceres ANNOT ID no. 8702946
  misc_feature: Down-regulated in root tissues in response to methyl jasmonate treatment
  misc_feature: Down-regulated in shoot tissues in response to methyl jasmonate treatment
  misc_feature (277)..(342): Pfam ID: RRM_1 Pfam Description: RNA recognition motif. (a.k.a. RRM, RBD, or RNP domain)
  misc_feature (171)..(243): Pfam ID: RRM_1 Pfam Description: RNA recognition motif. (a.k.a. RRM, RBD, or RNP domain)
  misc_feature (81)..(152): Pfam ID: RRM_1 Pfam Description: RNA recognition motif. (a.k.a. RRM, RBD, or RNP domain)
MAPPPPTQAGGGQPPQWGGIPPPMTQQYGAPPPQQPPAMWGQPPPQAHYGQAPPPQPYYAAPPAPAPAPAAPAAADEVRTLWIGDLQYWMDESYVLGCFLSTGEVQNVKLIRDKNSGQLQGYGFVEFTSRAAAERVLQTYNGQMMPNVELTFRLNWASAGEKRDDTPDYTIFVGDLAADVTDYLLQETFRVHYPSVKGAKVVTDKLTMRTKGYGFVKFGDPTEQARAMTEMNGMPCSSRPMRIGPAASRKNTGGVVQERVPNSQGAQSENDPNNTTIFVGGLDPNVTEDTLKQVFSPYGEVVHVKIPVGKRCGFVQFVTRPSAEQALLMLQGALIGAQNVRLSWGRSLSNKQAQPQQESNQWGAAAAAGAGGYYGGYGQGYEAYGSGYAQPQDPNMYGYGAYAGYPNYQQQQAAQQPQQQQYSAWNSNHGRFFMMA

SEQ ID NO: 18508 - DNA, 417 bp, Sorghum bicolor
  misc_feature: Ceres ANNOT ID no. 8702953
  misc_feature: Down-regulated in root tissues in response to methyl jasmonate treatment
  misc_feature: Down-regulated in shoot tissues in response to methyl jasmonate treatment
  misc_feature: Encodes the peptide sequence at SEQ ID NO 18509
atgtgcacaagggaaggtcaagcctttgagctgtatatcctagtcctgggaattagtgctgttacaaaatccttcaacgaaggagaatctcgagaggacacatccgtggccggctacaacatcccagcaggcatgcgcgttctcgtcagtgcctgggccatcggccgggatgctggcagtgtggggggacgagacgccggcgaatttaggccggagcgcttcttcatcgtgaatgccaacgggatgttgagcaacaacgtggatgtcaagggccaagaccgagagctgctgcctttttgggtcgggtcgcaggatgtgctctgccggggcgtggagctacaggacctgagcatggaggagaagtatgggatggatcaaggatgtgtgccgcagggagccgctgcaggctatccctga

SEQ ID NO: 18509 - protein, 138 aa, Sorghum bicolor
  misc_feature: Useful for making plants with altered carbohydrate content
  misc_feature: Functional homolog of the protein sequence given in SEQ ID NO 14183
  misc_feature: Ceres ANNOT ID no. 8702953
  misc_feature (32)..(113): SWISSPROT Homolog: EC 1.14.13.21 Flavonoid 3'-monooxygenase
MCTREGQAFELYILVLGISAVTKSFNEGESREDTSVAGYNIPAGMRVLVSAWAIGRDAGSVGGRDAGEFRPERFFIVNANGMLSNNVDVKGQDRELLPFWVGSQDVLCRGVELQDLSMEEKYGMDQGCVPQGAAAGYP

SEQ ID NO: 18510 - DNA, 2349 bp, Sorghum bicolor
  misc_feature: Ceres ANNOT ID no. 8702957
  misc_feature: Encodes the peptide sequence at SEQ ID NO 18511
atgccgccgatgatcgtccggaacagcgccgccgcgtacggctcctcgtcggcactctcgctcagccagccgaacctgctggacagccagcagcagctccagctccagcaggcgctgcagcagcagcacctgctggaccagatcccggcgacgacggcagagagcggcgacaacatgggccgcagcggcggcggccgggggtccgatccgttgatggggggcgacgagtttgagagcaagtccggcagtgagaacgtggacggcgtctccgttgacgaccaggaccccaaccagcgacccagcaagaagaaacgctaccaccgccacacccagcaccagatccaggagatggaagctttcttcaaggaatgcccgcacccggacgacaagcagcgcaaggagctgagccgggagctggggctggagcccctccaggtcaagttctggttccagaacaagcgcacgcaaatgaagaaccagcacgagcggcatgagaactcgcagctgagggcggagaacgagaagctgcgcgccgagaacatgaggtacaaggaggccctcagcagcgcgtcctgccccaactgcggcgggccggcggcgctcggcgagatgtccttcgacgagcaccacctccgcgtcgagaacgcgcggctccgggaggagatcgacaggatctccgccatcgccgccaagtacgtgggcaagcccatggtgtccttccccgtgctgtccagcccgctcgccggggcacgcccgtcgccgctggacatcggtggcggcgtggggggtgccgctgcgtatggcgctgtcgacatgttcggcggcggtgtcgctgtggacctgctgaggggtgccgtgccgcagtcggatgccgacaagcctatgatcgtggagctggccgtcacggccatggaggagctggtccggatggcgcagctggacgagccgctgtggaacgcgccgggccttgatggatctgctgaaacgctgaacgaggaggagtacgcgcacatgttccccggcgggctcggcccaaagcagtacgggttcaagtcagaggcatcgcgcgacagctccgtcgtcatcatgacccatgccaacctcgtcgagatcctcatggacgtgaatcagtatgcgacggtgttctcgagcatcgtgtcgagagctgtgacgctggaggtgctgtccactggcgtggcggggaactacaatggtgcattgcaagtgatgtcagttgagtttcaggtaccttccccactggtgccgaccagggaaagctatttcgtgagatactgcaagcagaatgctgatggatcatgggccgtcgtcgacgtctcgctggacagcctgcgccccaactcagtcctcaagtgccggcgccggccttcaggatgtctgatccaggaaatgcctaatggctactcaaaggtgacctgggtggagcacgtcgaggtggacgacaggtcagtgcacaacatctacaaactgctggttaactcagggcttgcctttggaccaccccggtgggttggaacgttagatccccagtgcgagccccttcccagtgtcatgcccagcaccattccgactagtgatatgggtgtgatcacgagcacggaggggagaaagagcatgctgaagctggctgagaggatggtgatgagcttctgcggtggagtgacggcctcagctgcacaccagtggactacgctctcaggcagtggtgctgaggacgtccgtgtcatgaccaggaagagcgtcgacgaccctggcaggccaccgggcatagtcctcaacgctgccacctctttctggctccccgtcccgcccaagcgtgtcttcgacttccttcgtgatgaaagctctcgcagcgagtgggacatcctctccaatggcggtgttgttcaagaaatggctcacatcgccaatggccgcgatcatggcaactgcgtctcgcttcttcgtgtcaatagcaccaactcgaaccaaagcaacatgctgatcctgcaagagagctgcactgacgcatcaggctcgtacgtcatctatgcgccagtggatgtggtcgcgatgaacgtggtcctcaatggcggcgaccctgactatgtggcactcctaccctctggctttgccatccttcctgacggtccggcaggcagcaacatgcaaggcgatggtggtgttggctcaggtggatcgctcctgacggtggcgttccagatactggtcgactccgtccccacagccaagctctccctggggtcggtggcgacagtgaacagcctcatcgcctgcaccgtggagcgcatcaaggcggcggtctctggcgagagcaatccccagcagtaa

SEQ ID NO: 18511 - protein, 782 aa, Sorghum bicolor
  misc_feature: The sequence is a functional homolog of SEQ ID NO 2670 in the 10/374,780 US patent application
  misc_feature: The sequence is a functional homolog of SEQ ID NO 334 in the 10/225,066 US patent application
  misc_feature: The sequence is a functional homolog of SEQ ID NO 666 in the 11/435,388 US patent application
  misc_feature: The sequence is a functional homolog of SEQ ID NO 244 in the 10/412,699 US patent application
  misc_feature: The sequence is a functional homolog of SEQ ID NO 424 in the 11/435,388 US patent application
  misc_feature: The sequence is a functional homolog of SEQ ID NO 519 in the 11/479,226 US patent application
  misc_feature: The sequence is a functional homolog of SEQ ID NO 58 in the 10/286,264 US patent application
  misc_feature: The sequence is a functional homolog of SEQ ID NO 2324 in the 10/374,780 US patent application
  misc_feature: The sequence is a functional homolog of SEQ ID NO 246 in the 10/412,699 US patent application
  misc_feature: The sequence is a functional homolog of SEQ ID NO 522 in the 11/479,226 US patent application
  misc_feature: The sequence is a functional homolog of SEQ ID NO 596 in the 11/435,388 US patent application
  misc_feature: The sequence is a functional homolog of SEQ ID NO 716 in the 10/225,066 US patent application
  misc_feature: The sequence is a functional homolog of SEQ ID NO 80 in the 10/286,264 US patent application
  misc_feature: The sequence is a functional homolog of SEQ ID NO 92 in the 10/666,642 US patent application
  misc_feature: The sequence is a functional homolog of SEQ ID NO 130 in the 10/666,642 US patent application
  misc_feature: The sequence is a functional homolog of SEQ ID NO 2656 in the 10/374,780 US patent application
  misc_feature: The sequence is a functional homolog of SEQ ID NO 326 in the 10/225,066 US patent application
  misc_feature: The sequence is a functional homolog of SEQ ID NO 70 in the 10/286,264 US patent application
  misc_feature: Ceres ANNOT ID no. 8702957
  misc_feature (298)..(519): Pfam ID: START Pfam Description: START domain
  misc_feature (103)..(159): Pfam ID: Homeobox Pfam Description: Homeobox domain
MPPMIVRNSAAAYGSSSALSLSQPNLLDSQQQLQLQQALQQQHLLDQIPATTAESGDNMGRSGGGRGSDPLMGGDEFESKSGSENVDGVSVDDQDPNQRPSKKKRYHRHTQHQIQEMEAFFKECPHPDDKQRKELSRELGLEPLQVKFWFQNKRTQMKNQHERHENSQLRAENEKLRAENMRYKEALSSASCPNCGGPAALGEMSFDEHHLRVENARLREEIDRISAIAAKYVGKPMVSFPVLSSPLAGARPSPLDIGGGVGGAAAYGAVDMFGGGVAVDLLRGAVPQSDADKPMIVELAVTAMEELVRMAQLDEPLWNAPGLDGSAETLNEEEYAHMFPGGLGPKQYGFKSEASRDSSVVIMTHANLVEILMDVNQYATVFSSIVSRAVTLEVLSTGVAGNYNGALQVMSVEFQVPSPLVPTRESYFVRYCKQNADGSWAVVDVSLDSLRPNSVLKCRRRPSGCLIQEMPNGYSKVTWVEHVEVDDRSVHNIYKLLVNSGLAFGPPRWVGTLDPQCEPLPSVMPSTIPTSDMGVITSTEGRKSMLKLAERMVMSFCGGVTASAAHQWTTLSGSGAEDVRVMTRKSVDDPGRPPGIVLNAATSFWLPVPPKRVFDFLRDESSRSEWDILSNGGVVQEMAHIANGRDHGNCVSLLRVNSTNSNQSNMLILQESCTDASGSYVIYAPVDVVAMNVVLNGGDPDYVALLPSGFAILPDGPAGSNMQGDGGVGSGGSLLTVAFQILVDSVPTAKLSLGSVATVNSLIACTVERIKAAVSGESNPQQ

SEQ ID NO: 18512 - DNA, 786 bp, Sorghum bicolor
  misc_feature: Ceres ANNOT ID no. 8702977
  misc_feature: Encodes the peptide sequence at SEQ ID NO 18513
atgcaaacaacgaactccgacaacaagaagatcccatcgacctccagcgcaaaagcccagcaagccgcagccgcagacgtgtcgtcgtccaagttggagaccagcgccgtggcgccgtcgtccgaggtggagaccaagaccgccaagaaggcgtcgccgccggcgcgaactccggggctcgcgttggaggggtgggggttggcgagctacgactcctcttccgacgaggagcagcagggcgccggtaccgtcgccgtacgcgcgaagtcgtcggaggcggcgaagaagggcgggactagtaagagcggcgtcggcggcaagggcaagggccgcgcgccgtccaaggagaagtacctgctcccggccgggaagaagaagcagcccgccggccgcgagggcgaggaggacgacaagttcatgcccggctcggcggcggacggcatcggcggcggcctgctcgcgccgttcgaccccttcgcggacgccgagctcgacggccacgacggcggcgtcgcggcgcccaaggacgacgtagtgcacctccgcgtgcagcagcgcaacgggaagaagacgctgaccacggtgcaggggctgagcgccgcctacaactacgcccggatcctccgggacctcaagcgggagctctgctgcagcggggtcgtcgtggaggacgaggagctcggcagcgtcatccagctccagggcgaccaccgcaaggccgtcgccgccttcctcgtcaaggccggcatggccaccaaggccaacgtcaaggtccacggcttctga

SEQ ID NO: 18513 - protein, 261 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 13160
  misc_feature: Ceres ANNOT ID no. 8702977
  misc_feature (173)..(254): Pfam ID: SUI1 Pfam Description: Translation initiation factor SUI1
MQTTNSDNKKIPSTSSAKAQQAAAADVSSSKLETSAVAPSSEVETKTAKKASPPARTPGLALEGWGLASYDSSSDEEQQGAGTVAVRAKSSEAAKKGGTSKSGVGGKGKGRAPSKEKYLLPAGKKKQPAGREGEEDDKFMPGSAADGIGGGLLAPFDPFADAELDGHDGGVAAPKDDVVHLRVQQRNGKKTLTTVQGLSAAYNYARILRDLKRELCCSGVVVEDEELGSVIQLQGDHRKAVAAFLVKAGMATKANVKVHGF

SEQ ID NO: 18514 - DNA, 1419 bp, Sorghum bicolor
  misc_feature: Ceres ANNOT ID no. 8702995
  misc_feature: Encodes the peptide sequence at SEQ ID NO 18515
atgggtggtattggcgtcagcccgtgcgatctggacagggagttcgcgccccaaatcgcccagctcctcgccacgcctcctctccaatccgctcaggaatattatgatgaactcatacggtccaagaagcctgatggcattagagtgagctacagtggcaagcatgggaaaggtgtttgtgcaaatagggactttgctgaagacgaccttgttctgaaggaccaaatgttggttggtgctcaggacagccttaacaagattgactgtgttgtgtgtagttactgcttccgcttcattggttctatagagttccaaattgggcgtagattgtatttgcaaagccttggtggtagtgttgatggctctactgagagacattgccatgggagtgatgctgggccaagtactggctgctctggtgcatcaagtgggaatagcaatgctgtgccacaagaggtcctgatgtcacttatggatggtaatatgtcattgcctttaactgatcagttctgtctgccatcagttgttgcttgccctggtggatgtgagggagaactctactgcagccaatcatgtgcggattctgattgggattcttatcactctttgctgtgtgctggatccaagaccgaaccattacggaaatccgcccttcagaaatttgtagggcatgctaatggaaccaatgatatttttttgattgctgccaaggctatcactttcaccttgttgagatataggaaactcaaaagacagcatgggtctcatgaatcgagctcttcgctcctcatggaagcctggaaaccactttcaatgggcttcaaaaagagatggtgggaatgtgttgctttgcctgaagatgttgattccagtgaagaagaattgtttagacagcaaataagggatctggcatttacgtcactgcagcttctcaaggatgcaatctttgatcctgatttccttgacaatggtctagtgttttcgcttgacatctatggccatataattggcatgtttgagatgaacaatcttgatttagttgtcgcatcaccagttgaagactatttcatacacattgatgatcttccagagagtgagaaggaggaagcagagaaggtaacggggccattcctagatgctttaggtgaagactattcagtcccttgtgagggaacggcgttctttcctttgcagagttgcatgaaccactcatgctgtccaaatgctaaagcatttaagagagacgaggacaaggatggccatgcagtgataattgctctgaggcctatcagcaagggtgaagagattaccatctcctacatcgatgaagaccttccatacgaggagaggcaagcacagcttgcagattacgggttcacgtgtacatgcttgaaatgccaagaagagcaaccggtctga

SEQ ID NO: 18515 - protein, 472 aa, Sorghum bicolor
  misc_feature: Useful for making plants with altered alkaloid content
  misc_feature: Functional homolog of the protein sequence given in SEQ ID NO 14644
  misc_feature: Ceres ANNOT ID no. 8702995
  misc_feature (12)..(469): SWISSPROT Homolog: EC 2.1.1.43 Histone-lysine N-methyltransferase
  misc_feature (305)..(448): Pfam ID: SET Pfam Description: SET domain
MGGIGVSPCDLDREFAPQIAQLLATPPLQSAQEYYDELIRSKKPDGIRVSYSGKHGKGVCANRDFAEDDLVLKDQMLVGAQDSLNKIDCVVCSYCFRFIGSIEFQIGRRLYLQSLGGSVDGSTERHCHGSDAGPSTGCSGASSGNSNAVPQEVLMSLMDGNMSLPLTDQFCLPSVVACPGGCEGELYCSQSCADSDWDSYHSLLCAGSKTEPLRKSALQKFVGHANGTNDIFLIAAKAITFTLLRYRKLKRQHGSHESSSSLLMEAWKPLSMGFKKRWWECVALPEDVDSSEEELFRQQIRDLAFTSLQLLKDAIFDPDFLDNGLVFSLDIYGHIIGMFEMNNLDLVVASPVEDYFIHIDDLPESEKEEAEKVTGPFLDALGEDYSVPCEGTAFFPLQSCMNHSCCPNAKAFKRDEDKDGHAVIIALRPISKGEEITISYIDEDLPYEERQAQLADYGFTCTCLKCQEEQPV

SEQ ID NO: 18516 - DNA, 846 bp, Sorghum bicolor
  misc_feature: Ceres ANNOT ID no. 8702997
  misc_feature: Encodes the peptide sequence at SEQ ID NO 18517
atggacttttacacactcatcgacggggaaccaatcattaaattgccaccaaagacaattcagatgagagaaataattttcaccccagcagagcaagaattctactcgtggcttctccaattctatgaagaaatattgatggactatacctttgatcgaatcctagcactgttgaaggaatgtcaacttgcttgtgaccatccttgtcttgtgaaaagtcgaattgattatgaacaatgttctacaatattggagagaagttatgtctcctcgaagatgaaagcaatagtcgatatactgaactcaattatgaacaagcacgcctttactgagagcgatagtaatattgaatcaagtacaattgaatcagctcctgagaaggttttaatattctcccagttcaccaggatgctggacctgctgcagcctttattgaacagcaatggtatacaattcaggaggctcgatgggaagatgaatcggaaagccagagacgaagcagtgaaagacttcaacacaaacccagaggtgacagtagtgcttgcgtctttgaaagcggctggtgttggcctcaacctggttgctgcttcacatgtcatcatcactgatccttggtggaacccttttatagaggatcaagcaattggcagagctcatagaattggtcaaacccgtccggtaactgtgtaccgtttagtggtcaaaggaacgattgaagagcgtgttctacagctgcaggagatgaagagaaaaaatgtaaaacgtgtttatgacgggaacatattgaacgacaagctcactgaggaagacctcaggtttctctttggggggacgaggcagtcctaa

SEQ ID NO: 18517 - protein, 281 aa, Sorghum bicolor
  misc_feature: The sequence is a functional homolog of SEQ ID NO 148 in the 10/666,642 US patent application
  misc_feature: The sequence is a functional homolog of SEQ ID NO 208 in the 10/412,699 US patent application
  misc_feature: Ceres ANNOT ID no. 8702997
  misc_feature (78)..(257): SWISSPROT Homolog: EC 3.6.1.15 Nucleoside-triphosphatase
  misc_feature (144)..(222): Pfam ID: Helicase_C Pfam Description: Helicase conserved C-terminal domain
MDFYTLIDGEPIIKLPPKTIQMREIIFTPAEQEFYSWLLQFYEEILMDYTFDRILALLKECQLACDHPCLVKSRIDYEQCSTILERSYVSSKMKAIVDILNSIMNKHAFTESDSNIESSTIESAPEKVLIFSQFTRMLDLLQPLLNSNGIQFRRLDGKMNRKARDEAVKDFNTNPEVTVVLASLKAAGVGLNLVAASHVIITDPWWNPFIEDQAIGRAHRIGQTRPVTVYRLVVKGTIEERVLQLQEMKRKNVKRVYDGNILNDKLTEEDLRFLFGGTRQS

SEQ ID NO: 18518 - DNA, 978 bp, Sorghum bicolor
  misc_feature: Ceres ANNOT ID no. 8703031
  misc_feature: Encodes the peptide sequence at SEQ ID NO 18519
atggcgttgtggaacggtggtggtggagcctttccggcggcggccgtgctggtggctgcggccgtggcggcgctgctgggcgccggggtgggcgccaccaagttcgacgacgtggtgcagcccagctgggccaacgaccacatggtgtacgacggcgacctcctcaagctccgcctcgacgccaactccggcggaggcttcgtgtccaggagcaagttcctgtacggcaaggccagcgccgacctcaagctcgtgccgggtgactccgccggcgtcgtcaccgctttctatctgtcgtcggccggggacaagcacaacgagttcgacttcgagttcctgggcaacgtgaccggcgagccgtacctggtgcagacgaacctgtacatcgacggcgtgggcaacagggagcagcgcatcgacctgtggttcgaccccaccgccgacttccacacctacgccgtgctgtggaaccccagccaggtggtgttcatggtcgacgacacccccatccgcgtctacgagaaccgccagaacgccacggtgcacggccaccaccaccgcagcaacaacgccaccaacgccagcacatccaccgcgtcgccgccgccgttcccggggccgcagccgatggccgtgtacagctccatctggaacgcggacgactgggcgacgcagggcgggcgcgtgaagacggactggtcgcacgcgccgttcgaggccacgttccgggaggtgcgcgtggacggctgcgcctgggcggccaacgccaccgacggcgacgccggggaggtccggcggtgcagcgagacgtcgtggggaaaagaaggccggtactggtggaaggagaaggagatgtcggagctgtctgtgcaccagagccaccagctcgtgtgggcgcgcgcgcaccacctcgtctacgactactgcgtcgacaccgaccgcttccccgttcagccgcctgagtgcgccggccgctga

SEQ ID NO: 18519 - protein, 325 aa, Sorghum bicolor
  misc_feature: Useful for making plants with altered cell wall content and/or composition
  misc_feature: Functional homolog of the protein sequence given in SEQ ID NO 13782
  misc_feature: Useful for making plants with altered carbohydrate content
  misc_feature: Functional homolog of the protein sequence given in SEQ ID NO 13783
  misc_feature: Ceres ANNOT ID no. 8703031
  misc_feature (34)..(175): SWISSPROT Homolog: EC 2.4.1.207 Xyloglucan:xyloglucosyl transferase
  misc_feature (35)..(235): Pfam ID: Glyco_hydro_16 Pfam Description: Glycosyl hydrolases family 16
  misc_feature (267)..(322): Pfam ID: XET_C Pfam Description: Xyloglucan endo-transglycosylase (XET) C-terminus
MALWNGGGGAFPAAAVLVAAAVAALLGAGVGATKFDDVVQPSWANDHMVYDGDLLKLRLDANSGGGFVSRSKFLYGKASADLKLVPGDSAGVVTAFYLSSAGDKHNEFDFEFLGNVTGEPYLVQTNLYIDGVGNREQRIDLWFDPTADFHTYAVLWNPSQVVFMVDDTPIRVYENRQNATVHGHHHRSNNATNASTSTASPPPFPGPQPMAVYSSIWNADDWATQGGRVKTDWSHAPFEATFREVRVDGCAWAANATDGDAGEVRRCSETSWGKEGRYWWKEKEMSELSVHQSHQLVWARAHHLVYDYCVDTDRFPVQPPECAGR

SEQ ID NO: 18520 - DNA, 2523 bp, Sorghum bicolor
  misc_feature: Ceres ANNOT ID no. 8703052
  misc_feature: Encodes the peptide sequence at SEQ ID NO 18521
atggcggcagcaacaatcaaatttctctaccgtcttgctctggtactctccgtgctccttacctccgccgccggcattgtgtctaacacaacgctcgtcaacaatggcgccaacatcaccgatggcgagacgatggtatctgacggtggctcattcacgctggggttcttcgccccgaccggggcgccaaccaagagatacctcggaatctggttcaccgcgtccccggaggctgtctgctgggtggccaaccgtgatagaccactcaacgacacctccggcgtactggtgttcggcagcgctcggggccttctccttctcgacggctctggccagaccgcgtggtcttccaacacgacggccacctctgcgcctgcggtgacccagctgcttgagtcaggcaacctggtcgtgggcgagcagagcagcggcagcatcctctggcaatcgttcgaccatccgtcgaacaccttgctccccggcatgaggctcggcaagaacccacagaccggagacgagtggtctctcacgtcgtggcgtgcgccaaacgatccgagtccaggggaccatcacctggtactggacacccaggccctgccggcggcgatcgtcttgtggcaaggcaacgtcaagacgtacacgacgggcccttggaacggcctgaggttcagcggcatcccggagatagcttcgtactccgggatgttatcggtccaggttgttgtccgccccgacgaggtggcctacatcgtcaccaccatgcccgacgcgcccttctcacgcctcgtagtgaacgacgacggaacggtggagcgtctggcgtgggagccggtcagccggacctggaacgtctggatgcggtcgccaagggacctctgcgacagctacgccaagtgcggcgcgttcggcctgtgcaactcggccaccgcgtcgacgcagttctgcagctgcatagacgggttcagccccgcatctccgtcacagtggtacatgagggagacctccgatggttgccgtcggcgcacgccgctggactgcagcaacgggacgacgacggatgggttcatggtgttgggaggagtgaaactccctgacacggacaacgcgacggtggacatgagcgcgacgctggagcagtgcagggcgaggtgccttgccaactgctcctgcgtggcctacgccgccgccgacatccgaggaggcggtgatggcagtggctgcgtcatgtggacggatggcgtcgtggacgttcgttacgtggacaaagggcaggatctctatgtgaggctggcaaaatctgaatttgctgcagggaagaggagggatgtggcaagaatcgtgcttccagtaacggtatctctgcttgcactcacgtctgcggccatgtaccttgtttggatatgcagggttagaggtagagccactcgattggcattccttcaagcggccgaacgtccaaacagtgatgaagcgatgataggttccttaagcgcgccaaatgaccttggtgatgatgattttgatcttccatttgttagctttggagatattgtttctgcaactaacaatttttctgagcacaataagctcggacaaggagggttcgggaaggtttataagggcatgctggacgataacaaagaagttgcaattaagaggcttggtaagggttctagacaaggagcagaggaattcagaaatgaagtgcttctaatagccaaattgcagcacagaaacctggtaagacttcttggttactgcatccatggagacgagaagctgctggtttacgagtatttaccaaacaaaagcttggattccttcatttttgatgctgccggtaaacatgttgttgattggccaacaaggttcaagataatcaaaggagtatctagaggaattctttatctccatcaggattcgaggttgactgtaattcacagagatctaaagtcaagcaacatactgttagatacagatatgagtcctaagatatcggattttggtatggcacgaatcttcagtggaaatggacaagaagaaaatactaatcgagttgttgggacgtatggttacatgtctcctgaatatgccatggatggcatcttttctatcaagtctgatacatatagctttggtgtcatactcttggagattataagtggtttgagcatcactgcaactcgattcaccggctttcctaacttattagcttacgcatggagcttatggcaagatgataaggcaattgatatggtggattcagccctttcagggacttgttcgccaaatgaagttttacggtgcatccaaataggactcttgtgtgtgcaagacaatccatacaatagacctcttatgtcatcggttgtgttcatgttggaaaatgaaaccacaccactctcggtcccaatacaacccatgtatttctcacaaaggtatttagatgaccacggaataggagaaaatagtatcagctcttctgtgaatgacatgagtgtcacggtgttggagggacggtag

SEQ ID NO: 18521 - protein, 840 aa, Sorghum bicolor
  misc_feature: Useful for making plants with modulated biomass
  misc_feature: Functional homolog of the protein sequence given in SEQ ID NO 14141
  misc_feature: Useful for making plants with altered cell wall content and/or composition
  misc_feature: Functional homolog of the protein sequence given in SEQ ID NO 14140
  misc_feature: Ceres ANNOT ID no. 8703052
  misc_feature (513)..(794): SWISSPROT Homolog: EC 2.7.11.1 Non-specific serine/threonine protein kinase
  misc_feature (524)..(792): Pfam ID: Pkinase Pfam Description: Protein kinase domain
  misc_feature (200)..(329): Pfam ID: S_locus_glycop Pfam Description: S-locus glycoprotein family
  misc_feature (346)..(417): Pfam ID: PAN_2 Pfam Description: PAN-like domain
  misc_feature (76)..(186): Pfam ID: B_lectin Pfam Description: D-mannose binding lectin
MAAATIKFLYRLALVLSVLLTSAAGIVSNTTLVNNGANITDGETMVSDGGSFTLGFFAPTGAPTKRYLGIWFTASPEAVCWVANRDRPLNDTSGVLVFGSARGLLLLDGSGQTAWSSNTTATSAPAVTQLLESGNLVVGEQSSGSILWQSFDHPSNTLLPGMRLGKNPQTGDEWSLTSWRAPNDPSPGDHHLVLDTQALPAAIVLWQGNVKTYTTGPWNGLRFSGIPEIASYSGMLSVQVVVRPDEVAYIVTTMPDAPFSRLVVNDDGTVERLAWEPVSRTWNVWMRSPRDLCDSYAKCGAFGLCNSATASTQFCSCIDGFSPASPSQWYMRETSDGCRRRTPLDCSNGTTTDGFMVLGGVKLPDTDNATVDMSATLEQCRARCLANCSCVAYAAADIRGGGDGSGCVMWTDGVVDVRYVDKGQDLYVRLAKSEFAAGKRRDVARIVLPVTVSLLALTSAAMYLVWICRVRGRATRLAFLQAAERPNSDEAMIGSLSAPNDLGDDDFDLPFVSFGDIVSATNNFSEHNKLGQGGFGKVYKGMLDDNKEVAIKRLGKGSRQGAEEFRNEVLLIAKLQHRNLVRLLGYCIHGDEKLLVYEYLPNKSLDSFIFDAAGKHVVDWPTRFKIIKGVSRGILYLHQDSRLTVIHRDLKSSNILLDTDMSPKISDFGMARIFSGNGQEENTNRVVGTYGYMSPEYAMDGIFSIKSDTYSFGVILLEIISGLSITATRFTGFPNLLAYAWSLWQDDKAIDMVDSALSGTCSPNEVLRCIQIGLLCVQDNPYNRPLMSSVVFMLENETTPLSVPIQPMYFSQRYLDDHGIGENSISSSVNDMSVTVLEGR

SEQ ID NO: 18522 - DNA, 2514 bp, Sorghum bicolor
  misc_feature: Ceres ANNOT ID no. 8703048
  misc_feature: Encodes the peptide sequence at SEQ ID NO 18523
atggcggttctcaacctcctcgccctgatttttgccacgctactactgcttctcagaagaagctccggcgccggcgccggcatttcgtctgacacgctgaacaacgggggcaacatcaccgatggagagacgctgctctccgccggtggctcattcaccctgggtttcttctccacgtcgaccacggtgccaaccaagaggtacctcgggatctggttcacggcgtctggtacggacgccgtcttgtgggtggccaaccgcgacacgccgctgaacaccacctccggcgtcctggtgatgagtagccgggtgggccttcgccttctcgacggctccggccagaccgcctggtcctcgaacacgaccggcgtctctgcctcttcggtggcgcagctgctcgattccggcaacctcgtcgtgcgcgagcagagcagcagcgccagcgccagcgccaccttccagtggcagtcgttcgaccacccgtcgaacaccttgctcgctggcatgaggttcggcaagaacctaaagaccggcgtggagtggtcactcacgtcgtggctggcgaaggatgacccggcgacgggagcctaccgtcgggtcatgggcacaaggggcctgccggacatcgtcacttggcacggcagcgccaagaagtaccgcgccggcccgtggaacggtcgctggttcagcggcgtgccggagatggattcacagtacaagttgtttaacatccagatggtggacggccccgacgaggtcacctacgtcctcaacaccacggccggcacgcccttcacccgcgtcatgctggacgaggttggcaaggtgcaggtcctgttgtggatctcttccagccgggagtggagggaattcccatggttgccgcgcgacgcctgcgacgactacgcgttgtgcggtgcgttcggcttgtgcaacgtcggcgccgcgtcggcgccgtcctgcagctgcgccgtggggttcagccccgtgaactcgtcggagtggtccaggaaggaatcctctggcgggtgccagagggatgtgcagctggagtgcggcaatggcacggcggcgacggaccggttcacgcttgtgcccggcgtgaagctccctgacacggacaacgcgacggtggacatgggggcgacgctggaccagtgcaaggcgaggtgcctcgccaactgctcgtgcgtggcctatgcccccgccgacatccgagagggtaatggcactggctgcgtcatgtggacagataacatcgttgatgtcaggtacatagaaaatgggcaggatctctatctgaggttggccaagtctgaatcagctacagggaagcgggggcgtgtggcaaaaatcttagttccagtgatggtgtctgtgcttgtactcacggccgctggcctgtaccttgtttggatatgcaagcttagagccaaacgccggaacaaggataatttgaggaaagcgatcctaggatactcgactgcgccatatgaactcggtgatgaaaatgtagagcttccatttgtcagctttggagacattgcagcagcaacaaacaatttttctgaggacaatatgctcgggcaaggtggctttgggaaggtttacaagggtaccctgggacagaacatagaggttgcaatcaaaagactcggtcaaagttcaggacaaggtgtagaggaattcagaaatgaagttgttctgattgcaaaattgcagcacagaaacctggttaggcttcttggatgctgcatcgatggggatgagaagttgctgatttacgaatacttaccaaacagaagcttggattccattatttttgatgctgcaagaaaatatctccttgattggccaacacgtttcaagataatcaaaggagtatctagaggacttctttatctccaccaggattcaaggttgactataattcacagagatatgaaaacgagtaacatactgttggatgcggatatgagccccaagatatctgattttggcatggcaagaatctttggtggaaaccagcatgaagctaatactaatcgtgttgttgggacatatggttacatgtctcctgaatatgcaatggatggcgcattttctgtcaagtcagatacatatagcttcggtgtcataatcttggagattataagtggcttgaagatcagtttaactcattgcaagggcttccctaacctactggcttatgcatggagcttatggatagatgacagagcgatggatcttgtggattcatccctggctaagagttgtttccacaatgaagctttacggtgtatccagatcggattattgtgtgtgcaagacaatccagatagtaggccactcatgtcgtcagtggtgaccatgcttgagaatgaaaccacaccagttccggtaccaatacagccaatgtatttctcataccggggaacaacccaagggacagaagaaaatactagtagttctactaataacatgagcctcacaacagtgttagagggacgctag

SEQ ID NO: 18523 - protein, 837 aa, Sorghum bicolor
  misc_feature: Useful for making plants with modulated biomass
  misc_feature: Functional homolog of the protein sequence given in SEQ ID NO 14141
  misc_feature: Useful for making plants with altered cell wall content and/or composition
  misc_feature: Functional homolog of the protein sequence given in SEQ ID NO 14140
  misc_feature: Ceres ANNOT ID no. 8703048
  misc_feature (511)..(792): SWISSPROT Homolog: EC 2.7.11.1 Non-specific serine/threonine protein kinase
  misc_feature (522)..(792): Pfam ID: Pkinase Pfam Description: Protein kinase domain
  misc_feature (352)..(423): Pfam ID: PAN_2 Pfam Description: PAN-like domain
  misc_feature (207)..(335): Pfam ID: S_locus_glycop Pfam Description: S-locus glycoprotein family
  misc_feature (78)..(193): Pfam ID: B_lectin Pfam Description: D-mannose binding lectin
MAVLNLLALIFATLLLLLRRSSGAGAGISSDTLNNGGNITDGETLLSAGGSFTLGFFSTSTTVPTKRYLGIWFTASGTDAVLWVANRDTPLNTTSGVLVMSSRVGLRLLDGSGQTAWSSNTTGVSASSVAQLLDSGNLVVREQSSSASASATFQWQSFDHPSNTLLAGMRFGKNLKTGVEWSLTSWLAKDDPATGAYRRVMGTRGLPDIVTWHGSAKKYRAGPWNGRWFSGVPEMDSQYKLFNIQMVDGPDEVTYVLNTTAGTPFTRVMLDEVGKVQVLLWISSSREWREFPWLPRDACDDYALCGAFGLCNVGAASAPSCSCAVGFSPVNSSEWSRKESSGGCQRDVQLECGNGTAATDRFTLVPGVKLPDTDNATVDMGATLDQCKARCLANCSCVAYAPADIREGNGTGCVMWTDNIVDVRYIENGQDLYLRLAKSESATGKRGRVAKILVPVMVSVLVLTAAGLYLVWICKLRAKRRNKDNLRKAILGYSTAPYELGDENVELPFVSFGDIAAATNNFSEDNMLGQGGFGKVYKGTLGQNIEVAIKRLGQSSGQGVEEFRNEVVLIAKLQHRNLVRLLGCCIDGDEKLLIYEYLPNRSLDSIIFDAARKYLLDWPTRFKIIKGVSRGLLYLHQDSRLTIIHRDMKTSNILLDADMSPKISDFGMARIFGGNQHEANTNRVVGTYGYMSPEYAMDGAFSVKSDTYSFGVIILEIISGLKISLTHCKGFPNLLAYAWSLWIDDRAMDLVDSSLAKSCFHNEALRCIQIGLLCVQDNPDSRPLMSSVVTMLENETTPVPVPIQPMYFSYRGTTQGTEENTSSSTNNMSLTTVLEGR

SEQ ID NO: 18524 - DNA, 2532 bp, Sorghum bicolor
  misc_feature: Ceres ANNOT ID no. 8703045
  misc_feature: Encodes the peptide sequence at SEQ ID NO 18525
atgacaagacttttgtgccttactgccctgatcttccccattatgctctgcctcacaacatccgccgccggtgccgcgtctgacacactcgacagcggcagcaacatcaccgacggtgcaacgctggtctcggccggcgggtccttcacccttggtttcttctccccgaccggggcgccaaccaagagatacctcgggatctggttcaccgcctcaccggccgaggccatctgttgggtggccaaccgtgaaaagttcctcagcaacacctcaggagttggagtactgaccatcggcagcaccgggagccttcgccttgtcgatggctctggccgcaccgcgtggtcttccaccgcgacgagttcttctgctccgcctgtcgtggcgcaggcgcagctgcttgagtctggcaacctagtggtgcgcgaccagagcggcggcgacgtgctttggcagtcattcgaccacccgtcgaacaccttgctcgccggcatgagattcggtaagaacccacagactggcgccgagtggttcctcacgtcgtggcgtgcgtcgaacgacccgacgccgggtggctaccgtcgtgtgctggacaccaagggactcctggactccgtctcgtggcaaggcaacgccaagaagtaccggacgggcccctggaacgggctgtggttcagtggcatcccggagacggcgtcgtacaaggagatgtactccgtccaggtcgtcgtccgccccgacgagattgcatacaccttcaacgccgccgccggcgcgcccttctgccgcctcgtactgaatgaggtcggcatggtgcagcagcttggttgggaccctgtcagccgggtgtggaacgtcttcacgcaggcgccgagggacgtctgcgacgactacgccaagtgcggcgcgttcggcctgtgcaacgtgaacacggcgtccacgctgttctgcagctgcgtcgtcgggttcagccccgtgaacccctcgcagtggtccatgagggagtccggtggcgggtgccggcggaacgtgccgctggagtgcggcaacgggacgacgacggacgggttcagggtggtgcgggcagtgaagctccccgacactgacaacacgacggtggacatgggcgcgacgctggagcagtgcagggcgaggtgcctcgccaactgctcgtgcgtggcctatgcagccgctgacatccgaggagggggtgatggcagtggctgcgtcatgtggacggatgcaatcgtggatgttcgttacgtagataaagggcaggatatctacctgaggttggcgaagtctgaattagttgagaagaagaggaatatggtgataataatcttgccaccagttacggcatgtgtgcttacgctcatggggatattcattgtttggatatggcacaagcgcaagcttagaggaaaacgtcgaaacttggatagccagaagaagatgatggtaggacagctggatgagtcaaatacacttggtgatgaagatctcgacctaccgttttttagctttggagatattgtttctgcaacaaataattttgctgaagacaatatgctcgggcaaggaggcttcgggaaagtttataagggtattctaggcgaaaatagagaggttgcaatcaaaaggctcagtcagggctctggacagggcatagaggaattcagaaatgaagtagttctaattgcgaaattgcagcacagaaaccttgttaggctccttggttgctgcattcatggagatgagaagttgctaatttacgaatatttaccaaacaaaagcttggattccttcattttcgatgctgcaaagaaaaaagttctcgattggccaacaaggttcaggataatcaaaggaatatcaaggggagttctttatctgcacgaggattcaagattgacaattgtgcaccgagatctcaaaacaagcaacatattgttggatgcagatatgaaccctaagatatcagattttggtatggcaagaatctttggagggaaccaacaagaagcaaatactaacaaagttgttgggacatatggttacatgtctcctgaatatgcaatggatggagctttttctgtcatgtctgatacatatagccttggggttatactgttggagatcataagtggtctaaagtcgtttcaaaaaataagtggtctgaagatcacttcgactcactccacgagcttccgtaacctagtagcttatgcatggagcttatggaatgatggcaaggcaatggatttggtggacccatcccttatcgagagttgtttaccaaatgaagccttgaggtgcatccacataggactcttgtgtgtccaagacaatccaaatagtaggccccttatgtcaacggttgtgttcatgttggagaacgaagccgagttaccttcaaccccaaaacagcccctgtacatctcgcaatggtatgaagcccaagggacaggagagaacacaaacagttccatgatgaataacataagtgtctcggtgttggagggacggtaa

SEQ ID NO: 18525 - protein, 843 aa, Sorghum bicolor
  misc_feature: Useful for making plants with altered cell wall content and/or composition
  misc_feature: Functional homolog of the protein sequence given in SEQ ID NO 14359
  misc_feature: Useful for making plants with modulated biomass
  misc_feature: Functional homolog of the protein sequence given in SEQ ID NO 14141
  misc_feature: Ceres ANNOT ID no. 8703045
  misc_feature (507)..(806): SWISSPROT Homolog: EC 2.7.11.1 Non-specific serine/threonine protein kinase
  misc_feature (519)..(796): Pfam ID: Pkinase Pfam Description: Protein kinase domain
  misc_feature (348)..(419): Pfam ID: PAN_2 Pfam Description: PAN-like domain
  misc_feature (203)..(331): Pfam ID: S_locus_glycop Pfam Description: S-locus glycoprotein family
  misc_feature (74)..(189): Pfam ID: B_lectin Pfam Description: D-mannose binding lectin
MTRLLCLTALIFPIMLCLTTSAAGAASDTLDSGSNITDGATLVSAGGSFTLGFFSPTGAPTKRYLGIWFTASPAEAICWVANREKFLSNTSGVGVLTIGSTGSLRLVDGSGRTAWSSTATSSSAPPVVAQAQLLESGNLVVRDQSGGDVLWQSFDHPSNTLLAGMRFGKNPQTGAEWFLTSWRASNDPTPGGYRRVLDTKGLLDSVSWQGNAKKYRTGPWNGLWFSGIPETASYKEMYSVQVVVRPDEIAYTFNAAAGAPFCRLVLNEVGMVQQLGWDPVSRVWNVFTQAPRDVCDDYAKCGAFGLCNVNTASTLFCSCVVGFSPVNPSQWSMRESGGGCRRNVPLECGNGTTTDGFRVVRAVKLPDTDNTTVDMGATLEQCRARCLANCSCVAYAAADIRGGGDGSGCVMWTDAIVDVRYVDKGQDIYLRLAKSELVEKKRNMVIIILPPVTACVLTLMGIFIVWIWHKRKLRGKRRNLDSQKKMMVGQLDESNTLGDEDLDLPFFSFGDIVSATNNFAEDNMLGQGGFGKVYKGILGENREVAIKRLSQGSGQGIEEFRNEVVLIAKLQHRNLVRLLGCCIHGDEKLLIYEYLPNKSLDSFIFDAAKKKVLDWPTRFRIIKGISRGVLYLHEDSRLTIVHRDLKTSNILLDADMNPKISDFGMARIFGGNQQEANTNKVVGTYGYMSPEYAMDGAFSVMSDTYSLGVILLEIISGLKSFQKISGLKITSTHSTSFRNLVAYAWSLWNDGKAMDLVDPSLIESCLPNEALRCIHIGLLCVQDNPNSRPLMSTVVFMLENEAELPSTPKQPLYISQWYEAQGTGENTNSSMMNNISVSVLEGR

SEQ ID NO: 18526 - DNA, 5577 bp, Sorghum bicolor
  misc_feature: Ceres ANNOT ID no. 8703044
  misc_feature: Encodes the peptide sequence at SEQ ID NO 18527
atgccaagacttccgtcgtaccctgttaccctgatattcctccccgtgttcttgctttcgttcagagcctcggccgctggcactgcatctgacacactcagcagcagcagcaacatcaccgatggcgagacgttggtctcatccggcagcaccttcaccctgggcttcttctcccctaccggcgttccagccaagagataccttggcatctggttcaccgcgtccccggatgccgtctgttgggtggccaaccgcgacagccccctcaacaacacctcgggtgtactggtggtcggcagcaccgggagccttcgccttctcgatggctctggcggccacaccgcgtggtcttccaattccaacaccacgacgacgagcagtcccggtccatccgtggcgcagctgctcgactccggcaaccttgtggtgcgcgagcagagcagcggtgacgtgctctggcagtcgttcgatcacccgtcgaacaccttgctcgccggcatgagaatcggcaagaacccgcagactggcgcggaatggtccctcacgtcgtggcgtgcatcgaacgacccgaccaccggggactgcaggactgcgatggacaccagggggctcccgggcatcgtctcgtggcaaggaaacgccaagaagtaccaaacgggcccctggaacggcctatggttcagcggcctcccggaggtggcgagggtgtcgaacacggatccgtaccccaacgaggtcgtcgtccgcgccgacgagatcgcataccacttcgacgccaggaccgacgcgcccttctcccgcctcgtgctgaacgaggtcggcgtggtgcagcacctggcgtgggatccggcaaacctgctgtggaacatcttggtgcaggcgcccaaggacatctgcgacaactacgccaagtgcggcgcgttcggcctgtgcaacgtgaacacggcgtccacgaggttctgcagctgcgtcgtcgggttcagccccgtcaacccctcgcagtggtccttgggtcaatacggaagcgggtgccagaggaatgtgccgctggaatgccacggcaacgggacgacgacggacgggtttatggtggtgcggggagtgaagctccctgacacggacaacgcgacggtggacacgggcgcgacgatggagcagtgcagggcaaggtgcctcgccaactgcgaatgcgtcgcctacgccgccgccgacatccgaggaggcggtgatggtagtggctgcatcatgtggacgaattacattgttgacattcggtacgtagacaaggggcaggatcgtgatcgtctctacctgaagttggccaggtctgaatttgatatagctgaaaggaacaggaggggtgtggcaaagatcgtgcttccggtcaccgcatctctgctagcagccatggctgtcggcatgtaccttatttggatatgcaagcttagaggcccacgtcaaaataatggtaacgggaagaaagtaatgccaagtaccgagagcacgtcaaatgaacttggcgatgaagaagatcttgagattccatcttttagctttagagatattatctctgcaacaaacaacttttctgagggtaacatgcttggacgaggaggcttcgggaaggtgtataagggtatgctgcccaataatagagaagttgcaatcaaaagacttggtaagggttctagacagggggcagaggaattcagaaatgaagttgttctaattgccaaattgcaacacagaaacctcgtcagacttcttggttgctgcattcatggagatgagaggctgctgatttacgagtatttaccaaacaaaagcttagattgcttcatttttgatcctacaagtaaaagagccctcgattggccaacaagattcaagataatcaaaggaatttctagaggacttctttatctccaacaggattcaaggttgactataattcatagagatatcaaaacaagcaacatactcttggatgcagatatgagcccaaaaatatcggattttggaatggcaagaatatttggcggaaaccaacaagaagcaaatactattcgagttgttgggacatatggttacatgtctcctgaatatgcaatggatggcgccttttcggtcaaatcagatacatatagcttcggcgtcatactcttggagattataagtggtttaaagatcacttcgactcagttcactagcttccctagcttattagcatatgcatggagcttatggaaagatggtaaggcaattgatcttgtggactcatcaattgttgagacttgttcaccagttgaagctttgcgatgtatccacataggactcttgtgtgtgcaagacaatccaaatagtaggccacttatgtcatcggttgtgttcatattggagaacgaaaccacgttaggttctgtcccaaagcagcccatgtacttctcccaatggtatttagaagcccaaggaacaagagaaaatgcaaatagctccatgaatgacgttagtatctcagtgttggagggacggtccagcacagagtatccttttcaggttgaatcgatgccacttaaaggtgttgtcccatttggtttgatttgccatggaaaaaaggaatgccactatcagttcctaatatgtaacaatcgcacaacaatttgcaatataggagggccctttttgtacatggctagaggggacaagcacgtgtgcgctgttgctagaaaaagaatgttgagtcacccacaggccatatggagtgccaaggtagcacatagtagcaagaaaggggtggatccatgccgccagatgtgccacgcctcctactcgatctacggatggtggtgggaaggtggaagaggcggtagtgggaagagaacccatgatgtggaggagatgaaggggaagagagaagttggtagtggaccgagacaagttggcctctctgaggttgacccacatttgcaaaggctagcctctaagatgtccatctctattaatggatttttagaggtgaaacacgaaatctaccagtggtgccagggtgtgaggccgactacggcgaagtcgtcggagaccattgcagtcaccactgtccactacacgtccacaccgctgcttgtctggtctgctcaccggtgcttgggtagtaagtgttctgcactgacacaactacatgataaattgttttcttcacactgcttcataggccagagaacaagaaaagccctgatagatatgatgtatagtgccatcttcatcctcatattcttgagttcactctgtcgatccgacgatcagctgacacatacaaagccgctctttcccaaagacactctcatctcggcgggcagagactttgctcttggcttcttttctcctaccaattcaagcaacaagttatacattggaatttggtacaacaatctcccagagcgcacggtggtatggatcgccaaccgtgacagcccaatcaccgcgcctacatcagcgaagctcgccatctcaaacaattcagggctggtgttgtcagactcccaagggcacatcttttggacggcaacgagcaacacaagtggaggtcctggagcttttgcagtattactcagctcaggaaactttgtccttcgatcgccgaatgacatggacatatggcaaagctttgatcaccccaccgatacaattcttccaaccatgaggcttatgctaagctacaagtcacaaccggcaacacacctctttgcttggaagggccctgacgatccatcaaccggggacatctctatcagcatggatccgggctcctcaggccttcagatgttcatttggaatgggactttgccatacttccgttcttctgttgttagtgatgtcctagtatcccgtggcgtataccagaccaacagtacctcagccacgtaccaagcgatgatagttgacacaggggatgagttgtactatacgttcacagtcttagctggttcaccctacttgcgaatattacttcactacacaggcaagacgaggctcctgatctgggaaaatagcacatcatcctgggcagtcattggtgaggcccctagtgttggctgtgatctctacgcctcttgtggcccgttcggctattgcgatcgcacgaaggcaatgccgacatgccagtgccctgatggttttgagctggtcgacagtctcaacttctctagaggatgccagagaaaggaagagctaaaatgccgaacagagaactatttcttgaccatgcctaatatgaagattcctgacaagttcttatacattaggaatagaacctttgaccagtgtgcagcagagtgcgccagaaactgctcctgtatagcatatgcctattccaacctaagcgctgctggcattatgggcgaagcatcaaggtgtttggtttggactcaccatcttattgacatggagaaggccagtcttttagagaacttgtacatccggcttggcgaatctcctgcatgtctgctgctactaacaatcaccgctcttgtttggacatgtaaaggcagagatgaagctgggggaaagaatatagagttcccatttattacatttgaaaacattgtcacagcaacagacaatttctctgacagcaatatgcttgggaaaggaggttttggcaaagtatacaagggaatgttggaaggaaccaaagaagtagccatcaagagactgagcaagagttctgggcaaggtgccaaggagttcaggaatgaagtagttttgattgcaaagttgcagcacaagaacctagttaagcttcttggttgctgtgttcatgaagatgagaagctgttagtttatgagtacttgcccaacaaaagcttggattacttcctctttgattctgcaagaaaatcaatgcttcagtggcaaacaaggttcaagataatctatggggtggctagaggaattatgtatcttcatcatgactcgagattaacaataattcatagagatctcaaagctagcaacatcttgctagataaggacatgagcccaaagatatcagatttcggcatggctagaatattcagtgccgaccagctccaagcaaatactaacagagttgtagggacatatggttacatgtctcctgaatatgcaatggaaggtgccttttcagtcaagtctgacacctacagttttggtgttttaatgctggagattataagtggtttaaagatcagctcaccacatcttatcatggattttcctaaccttagagcatatgcatggaacatgtggaaagaagggaaaatagaagatctggtggactcatcagtcatggagaattgctcccctgatgaagtttcacgatgtatccatataggactcttgtgtgttcaagacgatccgagttgcaggccactcatgtcggtggttgtgtccatgctggaaaacaaaacgacgccacttccaactccaaatcaacctacatattttgcacttagggactcctaccgacctgaaaaggcagttgacaacaaggaattctctgtaaatgatatgagtctcactgtgctagagggccgttag

SEQ ID NO: 18527 - protein, 1858 aa, Sorghum bicolor
  misc_feature: Useful for making plants with altered cell wall content and/or composition
  misc_feature: Functional homolog of the protein sequence given in SEQ ID NO 14140
  misc_feature: Ceres ANNOT ID no. 8703044
  misc_feature (516)..(799): SWISSPROT Homolog: EC 2.7.11.1 Non-specific serine/threonine protein kinase
  misc_feature (1547)..(1745): SWISSPROT Homolog: EC 2.7.10.2 Non-specific protein-tyrosine kinase
  misc_feature (529)..(797): Pfam ID: Pkinase Pfam Description: Protein kinase domain
  misc_feature (1541)..(1812): Pfam ID: Pkinase Pfam Description: Protein kinase domain
  misc_feature (76)..(191): Pfam ID: B_lectin Pfam Description: D-mannose binding lectin
  misc_feature (1146)..(1257): Pfam ID: B_lectin Pfam Description: D-mannose binding lectin
  misc_feature (352)..(424): Pfam ID: PAN_2 Pfam Description: PAN-like domain
  misc_feature (1412)..(1481): Pfam ID: PAN_2 Pfam Description: PAN-like domain
  misc_feature (205)..(335): Pfam ID: S_locus_glycop Pfam Description: S-locus glycoprotein family
  misc_feature (1272)..(1400): Pfam ID: S_locus_glycop Pfam Description: S-locus glycoprotein family
MPRLPSYPVTLIFLPVFLLSFRASAAGTASDTLSSSSNITDGETLVSSGSTFTLGFFSPTGVPAKRYLGIWFTASPDAVCWVANRDSPLNNTSGVLVVGSTGSLRLLDGSGGHTAWSSNSNTTTTSSPGPSVAQLLDSGNLVVREQSSGDVLWQSFDHPSNTLLAGMRIGKNPQTGAEWSLTSWRASNDPTTGDCRTAMDTRGLPGIVSWQGNAKKYQTGPWNGLWFSGLPEVARVSNTDPYPNEVVVRADEIAYHFDARTDAPFSRLVLNEVGVVQHLAWDPANLLWNILVQAPKDICDNYAKCGAFGLCNVNTASTRFCSCVVGFSPVNPSQWSLGQYGSGCQRNVPLECHGNGTTTDGFMVVRGVKLPDTDNATVDTGATMEQCRARCLANCECVAYAAADIRGGGDGSGCIMWTNYIVDIRYVDKGQDRDRLYLKLARSEFDIAERNRRGVAKIVLPVTASLLAAMAVGMYLIWICKLRGPRQNNGNGKKVMPSTESTSNELGDEEDLEIPSFSFRDIISATNNFSEGNMLGRGGFGKVYKGMLPNNREVAIKRLGKGSRQGAEEFRNEVVLIAKLQHRNLVRLLGCCIHGDERLLIYEYLPNKSLDCFIFDPTSKRALDWPTRFKIIKGISRGLLYLQQDSRLTIIHRDIKTSNILLDADMSPKISDFGMARIFGGNQQEANTIRVVGTYGYMSPEYAMDGAFSVKSDTYSFGVILLEIISGLKITSTQFTSFPSLLAYAWSLWKDGKAIDLVDSSIVETCSPVEALRCIHIGLLCVQDNPNSRPLMSSVVFILENETTLGSVPKQPMYFSQWYLEAQGTRENANSSMNDVSISVLEGRSSTEYPFQVESMPLKGVVPFGLICHGKKECHYQFLICNNRTTICNIGGPFLYMARGDKHVCAVARKRMLSHPQAIWSAKVAHSSKKGVDPCRQMCHASYSIYGWWWEGGRGGSGKRTHDVEEMKGKREVGSGPRQVGLSEVDPHLQRLASKMSISINGFLEVKHEIYQWCQGVRPTTAKSSETIAVTTVHYTSTPLLVWSAHRCLGSKCSALTQLHDKLFSSHCFIGQRTRKALIDMMYSAIFILIFLSSLCRSDDQLTHTKPLFPKDTLISAGRDFALGFFSPTNSSNKLYIGIWYNNLPERTVVWIANRDSPITAPTSAKLAISNNSGLVLSDSQGHIFWTATSNTSGGPGAFAVLLSSGNFVLRSPNDMDIWQSFDHPTDTILPTMRLMLSYKSQPATHLFAWKGPDDPSTGDISISMDPGSSGLQMFIWNGTLPYFRSSVVSDVLVSRGVYQTNSTSATYQAMIVDTGDELYYTFTVLAGSPYLRILLHYTGKTRLLIWENSTSSWAVIGEAPSVGCDLYASCGPFGYCDRTKAMPTCQCPDGFELVDSLNFSRGCQRKEELKCRTENYFLTMPNMKIPDKFLYIRNRTFDQCAAECARNCSCIAYAYSNLSAAGIMGEASRCLVWTHHLIDMEKASLLENLYIRLGESPACLLLLTITALVWTCKGRDEAGGKNIEFPFITFENIVTATDNFSDSNMLGKGGFGKVYKGMLEGTKEVAIKRLSKSSGQGAKEFRNEVVLIAKLQHKNLVKLLGCCVHEDEKLLVYEYLPNKSLDYFLFDSARKSMLQWQTRFKIIYGVARGIMYLHHDSRLTIIHRDLKASNILLDKDMSPKISDFGMARIFSADQLQANTNRVVGTYGYMSPEYAMEGAFSVKSDTYSFGVLMLEIISGLKISSPHLIMDFPNLRAYAWNMWKEGKIEDLVDSSVMENCSPDEVSRCIHIGLLCVQDDPSCRPLMSVVVSMLENKTTPLPTPNQPTYFALRDSYRPEKAVDNKEFSVNDMSLTVLEGR

SEQ ID NO: 18528 - DNA, 2538 bp, Sorghum bicolor
  misc_feature: Ceres ANNOT ID no. 8703040
  misc_feature: Encodes the peptide sequence at SEQ ID NO 18529
atggagatacgcttggattgtggagcaacaagcccaacaggcccagatgctgatggccggagctgggacagcgacaccaattccaagtttgcgcctgcactgaaaggaattgcagcaactgcttcataccaggactcttcactaccatccgctacgccttacatgactgctcgcatcttcacctcaaattacacctattcctttcctgttagtcctggctgcatgttcgtgcgcctctacttctatcctaccaattacgttagcaaccatgctgctgcagatgcttactttggtgtcacagccggcaatctgacccttttatatgacttcaatgcctcccaaactgctgcggcagttactccagttagtgtcgccttctttgttcgtgaatactacataaacgttactgaaggcagcctaaacctcactttctccccatccacacaccacaatggctcttatgcattcatcaacgggatcgaaattgtgcccacacctgacctcttcacaacaccaaaaccaacactagtcaatggaggaaacatggatcttgctggaacggggttccaaacaatgtaccggcttaatgtaggaggccaggccatcccaccacaaggagatgttgacttctaccgttcatggggagacgacagtttttacatatatgcttctgattatggtgtgacttttgggaaagacaacaatcttacaatcacgtatacacccagtgtaccaaactacactgcaccatttaatgtctatgcaactgctcgctctatggggccaaatgcccagatcaacctgaaccacaatcttacatggattttacctgttgatgctgggttctactacctcctaaggttccatttctgtgagatccagtatccgataacaaaggtgaatcagaggtcattcttcatctacatcaacaatcagacagcacaacagcaaatggatgtcatcgcgtttagcggaggaattggcaacacagtgtacagagattatgttaccatcacagctggttctggtcagacggatttatgggttgccctccacccagatctttcgacgagacctgagtacttcgatgcaatattgaatggtctggaggtcttcaagctgcagaattatggaaacaatagtcttaatgggctcaaccctccccttccatctgttgaaactaataatgggaaatctagtggcagaaacaaaagttctgtgccggcaatcgttggtggagctgttggtggttttgctgcgctgctcattgcctttattggtgtgtgcatcatctgcagaagaaaggaggtagcaaaggaatctgggaaacccgatgatggccagtggactcctctcactgattacagcaagtcacggtcaaacacctcagggaagacaacaactacagggagccgtacatcaacattgccatctaatctttgccgccacttctcatttggtgaaatccaggcagccaccaataattttgatcaaacctcgctcctcggcaaaggtggttttggaaatgtgtaccttggagagatagatagtggcacaatggtggcaatcaagcgtggtaacccaacgtctgagcagggtgtgcacgagttccagactgagattgagatgttgtcgaagctccgacaccgtcaccttgtgtcgctgattgggtattgcgatgatatgaatgagatgattctagtgtatgattacatggccaatgggactctgagggagcacttgtacaacaccaagaagccagcactctcctggaagaagcggcttgagatatgtatcggtgccgctcggggactgcattacctgcacacaggtgcaaagcataccatcatacacagagatgtcaagaccaccaacattttgttggatgacaaattggttgctaaggtttctgactttgggctgtcaaagactagtccaaatgtcgataacacccatgtgagcacggttgtgaagggaagctttggataccttgaccctgagtacttccgacggcagcagctcactgagaaatctgatgtctactcatttggagtcgtgctgtttgaggtcctctgtgcacgccctgccctgagcccctcgcttccaaaggagcaagtgagcctcgccgactgggcactgcactcccagaagaaaggcattcttgggcagatcatcgacccatatctgcaagggaaaatctctccccaatgtttcatgaagttcgcggagaccgcagagaagtgtgtggctgatcacagcatcgatagaccatctatggccgatgtcctctggaaccttgaatttgcactccagctgcaggagagtgcggaggacagtagcagcgtcaccgacgggacatcttcaaacacgtctccacttaccatcctcaggcttcactcggatgaaccaacgacagacaccaccaccaccacatcaacgagtatgagcatgacaggacggagcctcgcaagtgtggattcagatgggctgaccccaagcagtgtcttctcgcagctcatgcatccaggtggcagatga

SEQ ID NO: 18529 - protein, 845 aa, Sorghum bicolor
  misc_feature: Useful for making plants with modulated biotic stress sensitivity
  misc_feature: Functional homolog of the protein sequence given in SEQ ID NO 14099
  misc_feature: Ceres ANNOT ID no. 8703040
  misc_feature (484)..(778): SWISSPROT Homolog: EC 2.7.11.1 Non-specific serine/threonine protein kinase
  misc_feature (496)..(766): Pfam ID: Pkinase_Tyr Pfam Description: Protein tyrosine kinase
MEIRLDCGATSPTGPDADGRSWDSDTNSKFAPALKGIAATASYQDSSLPSATPYMTARIFTSNYTYSFPVSPGCMFVRLYFYPTNYVSNHAAADAYFGVTAGNLTLLYDFNASQTAAAVTPVSVAFFVREYYINVTEGSLNLTFSPSTHHNGSYAFINGIEIVPTPDLFTTPKPTLVNGGNMDLAGTGFQTMYRLNVGGQAIPPQGDVDFYRSWGDDSFYIYASDYGVTFGKDNNLTITYTPSVPNYTAPFNVYATARSMGPNAQINLNHNLTWILPVDAGFYYLLRFHFCEIQYPITKVNQRSFFIYINNQTAQQQMDVIAFSGGIGNTVYRDYVTITAGSGQTDLWVALHPDLSTRPEYFDAILNGLEVFKLQNYGNNSLNGLNPPLPSVETNNGKSSGRNKSSVPAIVGGAVGGFAALLIAFIGVCIICRRKEVAKESGKPDDGQWTPLTDYSKSRSNTSGKTTTTGSRTSTLPSNLCRHFSFGEIQAATNNFDQTSLLGKGGFGNVYLGEIDSGTMVAIKRGNPTSEQGVHEFQTEIEMLSKLRHRHLVSLIGYCDDMNEMILVYDYMANGTLREHLYNTKKPALSWKKRLEICIGAARGLHYLHTGAKHTIIHRDVKTTNILLDDKLVAKVSDFGLSKTSPNVDNTHVSTVVKGSFGYLDPEYFRRQQLTEKSDVYSFGVVLFEVLCARPALSPSLPKEQVSLADWALHSQKKGILGQIIDPYLQGKISPQCFMKFAETAEKCVADHSIDRPSMADVLWNLEFALQLQESAEDSSSVTDGTSSNTSPLTILRLHSDEPTTDTTTTTSTSMSMTGRSLASVDSDGLTPSSVFSQLMHPGGR

SEQ ID NO: 18530 - DNA, 2490 bp, Sorghum bicolor
  misc_feature: Ceres ANNOT ID no. 8703042
  misc_feature: Encodes the peptide sequence at SEQ ID NO 18531
atggccgccctccttcttcttcccattttcgtcttcatcatcacttcaccctgccaatcggaatcggatgacacgctcacacaagcaaagccactctaccccggagacacgctcgtctccaggaacggtgtgttcgctcttggcttcttctccccttccaactccaacgagagcttgtacctcgggatctggtaccagtacaacggcactcgtgatgtcactgtgtgggtcgctaatcgcgacaacccggtcaccacctctgcgaagctcgccatcaccaacgaccaacagctcgcgctgctgtccgactccggccgtgctctatggacgacgacgacgacggcggcggcggcggccaccaccaccaccggagttgtcgcggtgctactcaactctggaaactttgtcctccggtcagccaacggcggcggcaccgccatatggtggcaaagcttcgaccacccatccgccaccatcctcccgacgatgaaggttttgctcagctacaagggaatcgtgaacacgagcatagtcgcttgcaagagccccggcgacatgtcccccggggacttctccggcagcatcgatcccagctcaaacctccagttcttcgtttggaacagcggccggccctactaccgcatcagttttttcgacgacgtctcagtgttcagcttcggcggcggcgctacctccgccgtcgtgcacccgtcggtgatcaacacaggtgacgaggtctactacacgtacaacgtcaacgtctcccaccacggctcaccgttgacgcgtgttttgctcaagcacgacggcagcatgagcctcctgacccggcagaacagcaacactacgtcctcacagtggacacccagctttgagcgtcccggccctggctgcgacctctacgcgtcgtgcggcgcgttcggctactgcgaccacacagaggctgtgccaagctgccggtgcctcgatgggttcgagcccatcgacggcctcgacatttccaggggatgccggaggaacgacgcgctggagtgcggcggaggggaggaccgtttcgtgactttgcccgggatgacggttcccgataagttcttgcagatcggcaacacaaccttggagcagtgcgccgccgagtgcagcgcgaactgctcttgcacggcgtatgcttacgtcaacgtgagcagcgccggcgctttggtcgacacgtcgatgaggtgcctgctttggacgggagatctcgtcgacacagggaaagcatcagctgccagctctggtcagaacctgtacctccggcttgccagatctcatgttcaacacaagagaatctcactaaaatttttgcttccgatcatagcatgcctgctgcttcttgcatccatagctttcttcttgacatgcaaatacagaggcaaacggcaaaagaagaaaacagagaggagaaagatgctagagtatttgaggtctacggatgaagctggggaaaatttggagtctccatttattagctttgaagacattgtcgcagcaactgacaatttcgcggactccaatgagcttgggaagggaggatttggcaaggtttacaagggagtgttgcaaggtaccaaggaagtagctgtcaaaagacttagcaagggttcaggacaaggcacagaggagtttcgaaatgaagcagtcttgattgcaaatttgcaacacaagaacctagttaagcttattggttgttgcgttcaccaagatgagaagctgttggtttatgaatacttgcccaacaagagcttggattacttcatttttgactctgcaagaaagcacgtgcttccatggccaataaggtgtaagataatgcaagggatagctagaggaattttgtatctgcatcaggattcaagattaacaataatccatagagatctcaaggcaagcaacgtcttgttggataaggagatgaaccccaagatatcagattttggtatggcaaggatattcagtggcaacgagcttgaagcaaatactaatcgtcttgttgggacatatggttacatgtcccctgagtatgtgatggaaggcgccttttcagttaagtcagacacctacagctttggtgttttattgttggagatggttagtggactaaagatcagctcaccacatcgcatcgagggtttttctaacctcatagaatatgcatggaatttatggagagatggcaacatagaagactttgttgactcatctcttatggagagttgctccctcgacgaagttgcaagatgcatccatataggactgttgtgtgttcaaaacagcccgaattgtaggccactcatgtcagaagttgtgtttatgttggagaacaaaaccacggcactcccatcaccaaaaaaacccatgtgtttcgcatgtagggattcccaacctgaaaaggccggcgacaacaaggaattgtccattaatggcatgagcctcacaacgctaggggggcgctag

SEQ ID NO: 18531 - protein, 829 aa, Sorghum bicolor
  misc_feature: Useful for making plants with altered cell wall content and/or composition
  misc_feature: Functional homolog of the protein sequence given in SEQ ID NO 14359
  misc_feature: Ceres ANNOT ID no. 8703042
  misc_feature (470)..(796): SWISSPROT Homolog: EC 2.7.11.1 Non-specific serine/threonine protein kinase
  misc_feature (513)..(784): Pfam ID: Pkinase Pfam Description: Protein kinase domain
  misc_feature (345)..(416): Pfam ID: PAN_2 Pfam Description: PAN-like domain
  misc_feature (71)..(187): Pfam ID: B_lectin Pfam Description: D-mannose binding lectin
  misc_feature (201)..(333): Pfam ID: S_locus_glycop Pfam Description: S-locus glycoprotein family
MAALLLLPIFVFIITSPCQSESDDTLTQAKPLYPGDTLVSRNGVFALGFFSPSNSNESLYLGIWYQYNGTRDVTVWVANRDNPVTTSAKLAITNDQQLALLSDSGRALWTTTTTAAAAATTTTGVVAVLLNSGNFVLRSANGGGTAIWWQSFDHPSATILPTMKVLLSYKGIVNTSIVACKSPGDMSPGDFSGSIDPSSNLQFFVWNSGRPYYRISFFDDVSVFSFGGGATSAVVHPSVINTGDEVYYTYNVNVSHHGSPLTRVLLKHDGSMSLLTRQNSNTTSSQWTPSFERPGPGCDLYASCGAFGYCDHTEAVPSCRCLDGFEPIDGLDISRGCRRNDALECGGGEDRFVTLPGMTVPDKFLQIGNTTLEQCAAECSANCSCTAYAYVNVSSAGALVDTSMRCLLWTGDLVDTGKASAASSGQNLYLRLARSHVQHKRISLKFLLPIIACLLLLASIAFFLTCKYRGKRQKKKTERRKMLEYLRSTDEAGENLESPFISFEDIVAATDNFADSNELGKGGFGKVYKGVLQGTKEVAVKRLSKGSGQGTEEFRNEAVLIANLQHKNLVKLIGCCVHQDEKLLVYEYLPNKSLDYFIFDSARKHVLPWPIRCKIMQGIARGILYLHQDSRLTIIHRDLKASNVLLDKEMNPKISDFGMARIFSGNELEANTNRLVGTYGYMSPEYVMEGAFSVKSDTYSFGVLLLEMVSGLKISSPHRIEGFSNLIEYAWNLWRDGNIEDFVDSSLMESCSLDEVARCIHIGLLCVQNSPNCRPLMSEVVFMLENKTTALPSPKKPMCFACRDSQPEKAGDNKELSINGMSLTTLGGR

SEQ ID NO: 18532 - DNA, 1128 bp, Sorghum bicolor
  misc_feature: Ceres ANNOT ID no. 8703058
  misc_feature: Encodes the peptide sequence at SEQ ID NO 18533
atgcatttctgcgtgtttggtttcctgaagaggcagatcatcaagcaaataggcgcacggagaatacagaaaccattatttcagattgctggagaagatagatcaacatcagctgcagatgacaacatatatgaagatgattcggtgaaaagatcaattttgagctcaccattagttgagttcagcactgtttattcagcaacgaacaatttcagtgaaaagcttggtgaaggtggatttggtccagttttcaaggggatactgccagatggccaagagattgctattaagaggctatctaaaagctctgggcagggattggaagagttcaagaatgaggtgacggtgctatccaagctgcaacaccggaacttagtgaggctttttggttgttgtattcatggagaagagaagatgatgttgtatgaatacatgcccaataagagtcttgactcatttattttcagctggaaattgcgatacaagattattcagggaattggaagagggctactgtaccttcatcaggattccaggctgaaaattattcacagggatctcaaagcaagcaatattttactagatgatgatttcaaccccaagatatccgactttggcatggctcgaattttcggtgaacaccagcttcaagaccttactcgtcgaattgtcggaacctatggttacatctccccggagtatgcaatggagggtaaattctctgacaagtctgacgtcttcagtttcggtgtgctggtcctagagattgtgagtggccgcaggaacagctcttttgtcgatgatgaatggtcaatgaacctcttgggctatgcatggaccctgtggaaggaaggcagtgtctcagagcttatcgatccgcttatgggaacaacatacacttacgacgaagtctgcagatgcattcaggtgggtctcctgtgcgtgcaggagttaccagctgaaaggccaaccatgtccatggtgctcaggatgttgagcggtgatgttacgattccgtctcccaagcaagctgcattttttgttggaagggctcctcgtcttcctgcggatgacaacagtactgaatctgggaatcaattaacgtacacggatcttcagggcagatag

SEQ ID NO: 18533 - protein, 375 aa, Sorghum bicolor
  misc_feature: Useful for making plants with modulated biomass
  misc_feature: Functional homolog of the protein sequence given in SEQ ID NO 14141
  misc_feature: Useful for making plants with altered cell wall content and/or composition
  misc_feature: Functional homolog of the protein sequence given in SEQ ID NO 14140
  misc_feature: Useful for making plants with altered carbohydrate content
  misc_feature: Functional homolog of the protein sequence given in SEQ ID NO 14360
  misc_feature: Ceres ANNOT ID no. 8703058
  misc_feature (32)..(332): SWISSPROT Homolog: EC 2.7.11.1 Non-specific serine/threonine protein kinase
  misc_feature (69)..(332): Pfam ID: Pkinase Pfam Description: Protein kinase domain
MHFCVFGFLKRQIIKQIGARRIQKPLFQIAGEDRSTSAADDNIYEDDSVKRSILSSPLVEFSTVYSATNNFSEKLGEGGFGPVFKGILPDGQEIAIKRLSKSSGQGLEEFKNEVTVLSKLQHRNLVRLFGCCIHGEEKMMLYEYMPNKSLDSFIFSWKLRYKIIQGIGRGLLYLHQDSRLKIIHRDLKASNILLDDDFNPKISDFGMARIFGEHQLQDLTRRIVGTYGYISPEYAMEGKFSDKSDVFSFGVLVLEIVSGRRNSSFVDDEWSMNLLGYAWTLWKEGSVSELIDPLMGTTYTYDEVCRCIQVGLLCVQELPAERPTMSMVLRMLSGDVTIPSPKQAAFFVGRAPRLPADDNSTESGNQLTYTDLQGR

SEQ ID NO: 18534 - DNA, 561 bp, Sorghum bicolor
  misc_feature: Ceres ANNOT ID no. 8703072
  misc_feature: Encodes the peptide sequence at SEQ ID NO 18535
atgctgctttggtgtacgtgccgacaaacggctagtgggccagcccatccgcgcggactggctgccgtccggcggaaagcagaagtgggctcaacaaaaaaatctacggcccaaaaaaaaggaagcggagctgcttttcttctccgcgagctttccccacctccacctccccctccccgtcctcccgagctgcggcggccgcatcgattgctagggcgaaaacccgctcgactctcccggcgatttccggctctcagggggagacaggctgggcgcaaggagaccgctctcgacttggcgaagttcgtcgacaagggcgtccaggtgaagctcaccggcggccgccaagttacaggaactctaaagggatatgaccagcttctcaacttagtgctagatgaagcagttgagtctgaaagagagcaagatgatccattgaagctatcagggaaaaccagacagcttggcctcattgtgtgcagaggcacggcagtcatgctggtctcaccgaccgatggaactgatgagatcgccaaccctttccttgcggacggagcataa

SEQ ID NO: 18535 - protein, 186 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 14645
  misc_feature: Useful for making plants with modulated time to senescence
  misc_feature: Functional homolog of the protein sequence given in SEQ ID NO 14646
  misc_feature: Ceres ANNOT ID no. 8703072
  misc_feature (97)..(170): Pfam ID: LSM Pfam Description: LSM domain
MLLWCTCRQTASGPAHPRGLAAVRRKAEVGSTKKSTAQKKGSGAAFLLRELSPPPPPPPRPPELRRPHRLLGRKPARLSRRFPALRGRQAGRKETALDLAKFVDKGVQVKLTGGRQVTGTLKGYDQLLNLVLDEAVESEREQDDPLKLSGKTRQLGLIVCRGTAVMLVSPTDGTDEIANPFLADGA

SEQ ID NO: 18536 - DNA, 1926 bp, Sorghum bicolor
  misc_feature: Ceres ANNOT ID no. 8703075
  misc_feature: Encodes the peptide sequence at SEQ ID NO 18537
atggctcatcgaccgtttaaggcagatcaacaagtcgcagcgcagtcaagcaaggcacgtcggtccaagagcacgagcacacgacgttgccggcgcgggagtccgagatctgaaggcgcgggaggaagggaacgggcgagaggatctccagcagcccgcgagcgggcgcggcggttaacgcgtcccagatcccggcgcggcgcggcgcctcccgcccgggccctgccggcgagagcagcgaggcgcgcgggcggcccgatgaggcggcggccgttcctggaccagcggcggccgtcgttcaagcgccggtggcagcagcggccgtggtgggtgcgcctcgcgctctccctcctcctcgcactcgcgtgcgtcctcctcctcgccgtcctcctcggctcccccgaccccggcgcctcgccgtccacctccgccgcgtcctccggatccgagaccacctccgcacctctcctccgtcagagatcttacctggagggcatcacggatgcgctcaacatgactgacgaaatgctgagcgcccgctcgttctcgaggcagctcatggaccagatttatctagccaaaacttatgtcatcgttgccaaggaggcaaacaacctgcagttcgtggcggagcttagtgcccaggtacggcgggcgcagagcatccttgcgcacgctgcagcccatgggggcacggtgatggagcaggaagcagagaaggcgatcagggatatgtcggtgctgctcttccaggcgcagcagcttcggtatgacagtggtatcacaatcatgaagttgaaaggccagattcagtccctagaggagaagtcgaaagctgaggcagacaagagcacaaaatatggccagattgcagctgaggagctcccaaagggactttattgccttggtgtccgattaaccatggaatggttcaaaagtcctgagcttcagagaaagttttcagacaggagcccatcagtgcagagcaatctaagggataacagcctctatcatttctgtgtcttctcagacaacatccttgctgtttcagttgttgtcaattctacggctataaactcgaggcaccctgacaaggttgtttttcacctagtgactgatgacttgaactatgctccgatgaaggcgtggtttgccatgaatgactacagaggagtcactgtggacatacaaaaggtggaggacttcacctggctcaatgcatcatatgttcccgttcttaaacagctacagaacgctgctacccagaagttctacttctctggcagtggtaatcgtggaacaccaattaaattcaggaacccaaagtacttatcaatgcttaaccacttgaggttctacattccggaaatatatcctgaattgcagaaggtggtatttcttgatgatgatatcgttgttcagaaggacctgtcagaattgtttactatcaacctcaatggtaatgtgatgggtgctgtagagacttgcatggagacattccacagatttcataagtatcttaatcattcccaccctctaatccgtgctcattttgaccctgatgcttgtggctgggcatttggtatgaatgtgcttgatctggtcgaatggaggaacaagaatgtgacaggcatatatcattattggcaggagcgcaattctgatcataccctatggaagcttgggtctttaccacctgggcttcttgctttctatggcttggttgaagcattggatcccaaatggcatgttttgggacttggctacacaactgtggatcctgctactatcaaggaaggtgcagtactgcactacaatggaaatatgaagccatggctcaaaattggaatggagaagtacaagagcttttgggatagctatgtggactattcacatcctttgattcagcagtgcttcatgcgttga

SEQ ID NO: 18537 - protein, 641 aa, Sorghum bicolor
  misc_feature: Useful for making plants with altered cell wall content and/or composition
  misc_feature: Functional homolog of the protein sequence given in SEQ ID NO 13961
  misc_feature: Useful for making plants with altered carbohydrate content
  misc_feature: Functional homolog of the protein sequence given in SEQ ID NO 13960
  misc_feature: Ceres ANNOT ID no. 8703075
  misc_feature (301)..(616): Pfam ID: Glyco_transf_8 Pfam Description: Glycosyl transferase family 8
MAHRPFKADQQVAAQSSKARRSKSTSTRRCRRGSPRSEGAGGRERARGSPAARERARRLTRPRSRRGAAPPARALPARAARRAGGPMRRRPFLDQRRPSFKRRWQQRPWWVRLALSLLLALACVLLLAVLLGSPDPGASPSTSAASSGSETTSAPLLRQRSYLEGITDALNMTDEMLSARSFSRQLMDQIYLAKTYVIVAKEANNLQFVAELSAQVRRAQSILAHAAAHGGTVMEQEAEKAIRDMSVLLFQAQQLRYDSGITIMKLKGQIQSLEEKSKAEADKSTKYGQIAAEELPKGLYCLGVRLTMEWFKSPELQRKFSDRSPSVQSNLRDNSLYHFCVFSDNILAVSVVVNSTAINSRHPDKVVFHLVTDDLNYAPMKAWFAMNDYRGVTVDIQKVEDFTWLNASYVPVLKQLQNAATQKFYFSGSGNRGTPIKFRNPKYLSMLNHLRFYIPEIYPELQKVVFLDDDIVVQKDLSELFTINLNGNVMGAVETCMETFHRFHKYLNHSHPLIRAHFDPDACGWAFGMNVLDLVEWRNKNVTGIYHYWQERNSDHTLWKLGSLPPGLLAFYGLVEALDPKWHVLGLGYTTVDPATIKEGAVLHYNGNMKPWLKIGMEKYKSFWDSYVDYSHPLIQQCFMR

SEQ ID NO: 18538 - DNA, 1227 bp, Sorghum bicolor
  misc_feature: Ceres ANNOT ID no. 8703093
  misc_feature: Encodes the peptide sequence at SEQ ID NO 18539
atgatggagctctactctggatatcttgaagatcatttcaacctccacaagctaagcatcggcagcgccgcctcgccgccggagtacatgacgtcggcgtcgccggcgcagttcgcggcggtgcccctcagaatggggtacgggcggccggcgccgtcgactgcgccgccggcgccagtaatggcgggcatgtggagcagcgaggccttcaaggtcgtcgacagcggccacggcaccagcgcgtccaccgtcatggaggccgacaccaagttcgagacaaggctagaagatgttcaggtagcacttgagccaacaagaagtacggatcaggaaacaagcaagccgccagagagggtcatgagaaggctcgcgcagaacagagaggctgctcggaagagtcgcctgcggaaaaaggcctacatccaccagctagagacaagccggatgaagctggcccagttagagctggagcttcaacgggctcgacagcagggtgcatatgcaaatgggaacatgggagactcagctctcggttatgcagggtcgatagatccaggtgtcagcgcgttcgagatcgagtacagccactgggtggacgagcagaagaggcacacggcggagctgatgtcggcgctccaggggcagcagacgtcggagctggagctccgcctgctggtggagacggggctcagcaactacgagcacctcttcaggatcaaggcgatggccgccaacgcggacgtgttccacgtcatgtcgggcatgtggaagacccccgccgagaggttcttcctctggatcggcggcttccggccgtcggaagtcctcaagatcctgagcccgcagctggagccgctgacggagccgcagcgcatgctggtcggcggcctccagcacacgtcgacgcaggcggaggacgccctgtcgcagggcatggagaagctgcagcagaacctcgcggagaccctgacggcggaggccgacccgttcgggccccccgacgcctacatgctgcagatggccaccgcggtggacaggctcaaagagctcgtcggcttcgtcacccaggcggaccatctccggctgacgacgctgcagcagatgcacaagatcctgacgacgcggcaggcggccaggggcctcctggcgctgggcgactacttccagcgcctccgcacgctgagctcgctgtgggcggcgcgcccgcgggaggcggcgattagctag

SEQ ID NO: 18539 - protein, 408 aa, Sorghum bicolor
  misc_feature: The sequence is a functional homolog of SEQ ID NO 1493 in the 10/374,780 US patent application
  misc_feature: The sequence is a functional homolog of SEQ ID NO 1563 in the 10/412,699 US patent application
  misc_feature: Useful for making plants with modulated biomass
  misc_feature: Useful for making plants with modulated flowering time
  misc_feature: Functional homolog of the protein sequence given in SEQ ID NO 13559
  misc_feature: The sequence is a functional homolog of SEQ ID NO 1786 in the 10/412,699 US patent application
  misc_feature: The sequence is a functional homolog of SEQ ID NO 2024 in the 10/374,780 US patent application
  misc_feature: The sequence is a functional homolog of SEQ ID NO 352 in the 10/412,699 US patent application
  misc_feature: The sequence is a functional homolog of SEQ ID NO 819 in the 11/479,226 US patent application
  misc_feature: The sequence is a functional homolog of SEQ ID NO 928 in the 11/435,388 US patent application
  misc_feature: The sequence is a functional homolog of SEQ ID NO 1497 in the 10/374,780 US patent application
  misc_feature: The sequence is a functional homolog of SEQ ID NO 1567 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
  misc_feature: Ceres ANNOT ID no. 8703093
  misc_feature (114)..(166): Pfam ID: bZIP_1 Pfam Description: bZIP transcription factor
MMELYSGYLEDHFNLHKLSIGSAASPPEYMTSASPAQFAAVPLRMGYGRPAPSTAPPAPVMAGMWSSEAFKVVDSGHGTSASTVMEADTKFETRLEDVQVALEPTRSTDQETSKPPERVMRRLAQNREAARKSRLRKKAYIHQLETSRMKLAQLELELQRARQQGAYANGNMGDSALGYAGSIDPGVSAFEIEYSHWVDEQKRHTAELMSALQGQQTSELELRLLVETGLSNYEHLFRIKAMAANADVFHVMSGMWKTPAERFFLWIGGFRPSEVLKILSPQLEPLTEPQRMLVGGLQHTSTQAEDALSQGMEKLQQNLAETLTAEADPFGPPDAYMLQMATAVDRLKELVGFVTQADHLRLTTLQQMHKILTTRQAARGLLALGDYFQRLRTLSSLWAARPREAAIS

SEQ ID NO: 18540 - DNA, 1227 bp, Sorghum bicolor; identical to SEQ ID NO: 18538
  misc_feature: Ceres ANNOT ID no. 8703095
  misc_feature: Encodes the peptide sequence at SEQ ID NO 18541

SEQ ID NO: 18541 - protein, 408 aa, Sorghum bicolor; identical to SEQ ID NO: 18539
  misc_feature: The sequence is a functional homolog of SEQ ID NO 1493 in the 10/374,780 US patent application
  misc_feature: The sequence is a functional homolog of SEQ ID NO 1563 in the 10/412,699 US patent application
  misc_feature: Useful for making plants with modulated biomass
  misc_feature: Useful for making plants with modulated flowering time
  misc_feature: Functional homolog of the protein sequence given in SEQ ID NO 13559
  misc_feature: The sequence is a functional homolog of SEQ ID NO 1786 in the 10/412,699 US patent application
  misc_feature: The sequence is a functional homolog of SEQ ID NO 2024 in the 10/374,780 US patent application
  misc_feature: The sequence is a functional homolog of SEQ ID NO 352 in the 10/412,699 US patent application
  misc_feature: The sequence is a functional homolog of SEQ ID NO 819 in the 11/479,226 US patent application
  misc_feature: The sequence is a functional homolog of SEQ ID NO 928 in the 11/435,388 US patent application
  misc_feature: The sequence is a functional homolog of SEQ ID NO 1497 in the 10/374,780 US patent application
  misc_feature: The sequence is a functional homolog of SEQ ID NO 1567 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
  misc_feature: Ceres ANNOT ID no. 8703095
  misc_feature (114)..(166): Pfam ID: bZIP_1 Pfam Description: bZIP transcription factor

SEQ ID NO: 18542 - DNA, 735 bp, Sorghum bicolor
  misc_feature: Ceres ANNOT ID no. 8703142
  misc_feature: Encodes the peptide sequence at SEQ ID NO 18543
atgagtgaaacagggcacactgtacaagtcactaacctctcgagcagagtatctgaaagtgatcttcatgagttcttttcgttctctggtcctattgagcacatagaacttatcagatcagaagattatggtgccactgcttatgtgacattcaaggaacgctttgccttggaaactgcagtattgctcagtggggctactattgtggatcagccagtatgcataacttattggggacaacctgaggagacttttaatttctgggacaggccaacttgggagaccgaagaggaaatcgaatacaggaactaccagacatgccagtacaacactactccgcaggaagcttttacagtggctcaagatatcatgaagacgatgctagcaaagggatacgtgctcagcaaggatgctttggctaaggctagagcctttgatgagtcccatggattaacagctgcagctgcagccagggctgcagagctgagcaagagaatcggtttaactgacagggtcaatgctggtgttggtgcaatgcgatcagtcgatgagacatatcgtgtaagggagacaaccaagacggttgctactgccactggaagaactgcagctaaggtggtaaatggcatcgtcaccagcagctacttctctgcaggagccatgatgctgtctgatgctcttactagggctgccaaggccgcggcagatctggctgctcatggtaggcagagttga

SEQ ID NO: 18543 - protein, 244 aa, Sorghum bicolor
  misc_feature: Useful for making plants with modulated biomass
  misc_feature: Functional homolog of the protein sequence given in SEQ ID NO 13029
  misc_feature: Ceres ANNOT ID no. 8703142
MSETGHTVQVTNLSSRVSESDLHEFFSFSGPIEHIELIRSEDYGATAYVTFKERFALETAVLLSGATIVDQPVCITYWGQPEETFNFWDRPTWETEEEIEYRNYQTCQYNTTPQEAFTVAQDIMKTMLAKGYVLSKDALAKARAFDESHGLTAAAAARAAELSKRIGLTDRVNAGVGAMRSVDETYRVRETTKTVATATGRTAAKVVNGIVTSSYFSAGAMMLSDALTRAAKAAADLAAHGRQS

SEQ ID NO: 18544 - DNA, 2220 bp, Sorghum bicolor
  misc_feature: Ceres ANNOT ID no. 8703140
  misc_feature: Encodes the peptide sequence at SEQ ID NO 18545
atggctaacagggtcgccgtcgccagcgtcatcgccgcggtgggcatcgtggccgtgatcggcaccatcgccgcggtgaccagcgccaagaaagtggacgacaacgacgccggcggcttgttttccagcgtgaagctctccacggtgtgcgcctcgacgctgtacccgcagaagtgcgagcagagcctgaagcccgtcgtgaacgacacctccgacccggaggacgtcctccgggccgcgttcaacgtggccctggacgaggtcgccgccgccttccagcggtccgcgcacatcggcaagggcgccacggacaacctcaccaagaacgccatggaggtgtgcaagaagctcctagacgacgccaccgaggacctcggggccatgtcgaggctcaagccccaggacgtggtgcgccacgtcaaggacctccgggtctgggtctctggcgtcatgacctacgtctacacctgcgccgacggattcgagaagcccgagctcaaggaggccatggacaaggtgctgcagaactccaccgagctcagcagcaacgcgctcgccatcctcacccgcctcggcgagctcctgccggaggaagccaaagctctgaacgccaccttggcgggtgcggggcacggccgccggcttcttggctggcagatgggcgaggccgaggaggtgaccagcggaggccgcgggcttctggccgtcgatgacaagctgggcgagatcgcggacgtcgcgagcgcaaaccggaagctcctgtcggacacgctggacgagatcgccggcatgtcccacggcgcgaacggccggcgcctgcttagcaccctgtggtctcagataaccagcacccagggagaggacgtcctcgcccaccaacaaaagctgggcgtgtcgccagacgacgagaccgatcacgccgcccggcgcaaccttctgtcgaccgagctcgacagcatcgccagcacgtccgccgaggcaaaccgccagcttctcgcggcggaggagctccccgacgagctcgccggcaagcgccagctgctgtcccggacgctcatggggatcgacgaggcggccaccgaggccaagcgccagcttgatgaggcaacgacggagaacaccatgtctgagactgagcacagggtactgaccactgacctcgtcggcacgttcgacgagatccaagacgggcgcagcggggcgccgcccggcaacttccccaagtggatgtcggccacccagcggaggctcctgcagctgcccagcctgcagaagcccaacaaggtggtggcccaggacggcagcggcgacttcaagaccatcagcgaggccatcgccgccgtgcccaagaccttcgagggccgcttcgtcatctacgtgaagtccggcgtgtacaaggagtacgtcaccgtgcccaagaacatggccaacatcttcatgtacggcgacgggccgacgaagacggtggtgaccggcgacaagagcaacacaggcgggttcgccaccatcgccacgcccaccttttccgcggagggcaacgggttcatctgcaagtcgatgggtttcgtcaacacggcggggccggatggtcaccaggcggtggcgatgcacgtgcagggggacatgtcggtgttcttcaactgccggttcgaggggtaccaggacacgctgtacgtgcacgcgaaccggcagttcttccgcaactgcgaggtgctgggcaccgtggacttcatcttcggcaactcggcggcgctgttccagaactgcctgatgacggtgcgcaagcccggggacagccagtccaacatggtgacggcgcaggggaggacggaccccaacatgcccacggggatcgtgctccagggctgccgcatcgtgccggagcaggcgctcttccccgtgcggctccaggtgcccagctacctcggccggccatggaaggagtacgcgaggacggtggtgatggagagcaccatcggcgacctcatcaggccggaagggtgggcggagtggatgggcgacctcggcctcaagacgctctactacgccgagtacgccaacaccggcccgggcgccggcaccagcaagagggtcaactggccgggctaccgcgtcatcggacaggccgaggccacgcacttcaccgccggcgtcttcatcgacggcatgacgtggctccagagcaccggcacgccaaacgtcatgggcttcaccaaatga

SEQ ID NO: 18545 - protein, 739 aa, Sorghum bicolor
  misc_feature: Useful for making plants with altered cell wall content and/or composition
  misc_feature: Functional homolog of the protein sequence given in SEQ ID NO 14647
  misc_feature: Ceres ANNOT ID no. 8703140
  misc_feature (406)..(736): SWISSPROT Homolog: EC 3.1.1.11 Pectinesterase
  misc_feature (427)..(723): Pfam ID: Pectinesterase Pfam Description: Pectinesterase
  misc_feature (40)..(187): Pfam ID: PMEI Pfam Description: Plant invertase/pectin methylesterase inhibitor
MANRVAVASVIAAVGIVAVIGTIAAVTSAKKVDDNDAGGLFSSVKLSTVCASTLYPQKCEQSLKPVVNDTSDPEDVLRAAFNVALDEVAAAFQRSAHIGKGATDNLTKNAMEVCKKLLDDATEDLGAMSRLKPQDVVRHVKDLRVWVSGVMTYVYTCADGFEKPELKEAMDKVLQNSTELSSNALAILTRLGELLPEEAKALNATLAGAGHGRRLLGWQMGEAEEVTSGGRGLLAVDDKLGEIADVASANRKLLSDTLDEIAGMSHGANGRRLLSTLWSQITSTQGEDVLAHQQKLGVSPDDETDHAARRNLLSTELDSIASTSAEANRQLLAAEELPDELAGKRQLLSRTLMGIDEAATEAKRQLDEATTENTMSETEHRVLTTDLVGTFDEIQDGRSGAPPGNFPKWMSATQRRLLQLPSLQKPNKVVAQDGSGDFKTISEAIAAVPKTFEGRFVIYVKSGVYKEYVTVPKNMANIFMYGDGPTKTVVTGDKSNTGGFATIATPTFSAEGNGFICKSMGFVNTAGPDGHQAVAMHVQGDMSVFFNCRFEGYQDTLYVHANRQFFRNCEVLGTVDFIFGNSAALFQNCLMTVRKPGDSQSNMVTAQGRTDPNMPTGIVLQGCRIVPEQALFPVRLQVPSYLGRPWKEYARTVVMESTIGDLIRPEGWAEWMGDLGLKTLYYAEYANTGPGAGTSKRVNWPGYRVIGQAEATHFTAGVFIDGMTWLQSTGTPNVMGFTK

SEQ ID NO: 18546 - DNA, 1698 bp, Sorghum bicolor
  misc_feature: Ceres ANNOT ID no. 8703183
  misc_feature: Encodes the peptide sequence at SEQ ID NO 18547
atgtccaccccgtcggcgccaccgccctgcccgcacctcgccgcgcaccgcctgtcgtcgcgcccgctgcgcttcctccgccgctgcctgcgcgtgcgcccgctcggccgccccgagatccggcgggacccgcgcgagctgccgcgctgctcgccctgcgccgccgcggccccgtcccccacctcccgcctctacgcctgcctctcctgcgccgccgtcttctgcccctcccacgccgcctcgcacgcctccgcctccgcggggcccggccaccagatcgccgtcgacgtcgaccgcgccgagctcttctgcgccgcctgcggggaccaggtctacgatcccgatttcgaccacgccgtcttcctcgcccagtcctcctcgctcctcccctccacctccgcctcctccccgtccccgtccgcggcgctccgcaagcgccggcgcgtggattaccgcgcatgggcgccagatccggccgagttcgcgctcatgagctccgcggaccccaccacatccgcctccgccgccgcaccggcggggctgcgggggctcaacaatctcggcaacacctgcttcatgaactccgtgctccaggcgctcctccacgcgcccccgcttcggaactacttcctcggcgatcgccacaatcggttcctctgcccgcgccgcacgcccgtcagacaccgcgccacggacgccgacgccgccagggtcgcgtgcctcgcttgtgacctcgacgagatctactctgcggccttctccggggagcgcatgccgtacagccccgccaagtttctatatagttggtggcagcatgcatcaaacctcgcaagctacgagcaacaggatgctcatgaattctttatttccatccttgaccatatccatgaaaatataaaggacgaccaacaaaagtcacatgcccaagcccaaggccatggggactgttgcattgcccacagagtgttttctggtatcctgaggtcagatgtcacctgcacaagctgtgggttcacatccacaacttttgagccctgtatggacatttctttggacatggatgctggagataacagttcttttggtgttgcaaatacaaagccgcatgtgcgcaatggggaacgtggcttggctggcatgaattccaaggtgtcaacactaatgaggtgtttggaacggtttacaaggtctgagagacttgatgctgagcaaaagttcttctgtgaacactgcaacgagaggcaagagtccctgaagcaaatgtccattcgcaggcttccattagtttcctgctttcacataaagagatttgagcattcatcagtcaaaaaggtgtcgaggaaagttgatcactgtttgcagtttcctttctcccttgacatggcaccttatttgtcatcatctattctcagaagtagatatggtaaccgcatatttcctgcagaagctagtgatgcagatgcagtttcagaaatgtcatcagaatttgaaatatttgcagtgatcacgcatagcggtaagctagaagctggccattatgtgacatatctgaggttaaacaatcattggtacaaatgtgatgatgcctgggtaaccagagttgaggagcatactgtcaggacttctcaggcatacatgctcttctatgtgcagaagacgctttactacaaagcttgtgaaagagcagccacagtctaa

SEQ ID NO: 18547 - protein, 565 aa, Sorghum bicolor
  misc_feature: Useful for making plants with altered alkaloid content
  misc_feature: Functional homolog of the protein sequence given in SEQ ID NO 14648
  misc_feature: Ceres ANNOT ID no. 8703183
  misc_feature (240)..(558): SWISSPROT Homolog: EC 3.1.2.15 Ubiquitin thiolesterase
  misc_feature (179)..(549): Pfam ID: UCH Pfam Description: Ubiquitin carboxyl-terminal hydrolase
MSTPSAPPPCPHLAAHRLSSRPLRFLRRCLRVRPLGRPEIRRDPRELPRCSPCAAAAPSPTSRLYACLSCAAVFCPSHAASHASASAGPGHQIAVDVDRAELFCAACGDQVYDPDFDHAVFLAQSSSLLPSTSASSPSPSAALRKRRRVDYRAWAPDPAEFALMSSADPTTSASAAAPAGLRGLNNLGNTCFMNSVLQALLHAPPLRNYFLGDRHNRFLCPRRTPVRHRATDADAARVACLACDLDEIYSAAFSGERMPYSPAKFLYSWWQHASNLASYEQQDAHEFFISILDHIHENIKDDQQKSHAQAQGHGDCCIAHRVFSGILRSDVTCTSCGFTSTTFEPCMDISLDMDAGDNSSFGVANTKPHVRNGERGLAGMNSKVSTLMRCLERFTRSERLDAEQKFFCEHCNERQESLKQMSIRRLPLVSCFHIKRFEHSSVKKVSRKVDHCLQFPFSLDMAPYLSSSILRSRYGNRIFPAEASDADAVSEMSSEFEIFAVITHSGKLEAGHYVTYLRLNNHWYKCDDAWVTRVEEHTVRTSQAYMLFYVQKTLYYKACERAATV

SEQ ID NO: 18548 - DNA, 1476 bp, Sorghum bicolor
  misc_feature: Ceres ANNOT ID no. 8703202
  misc_feature: Encodes the peptide sequence at SEQ ID NO 18549
atgtgggatcttaacgactcgccggccgccccgccgccgtcgccgtccgccgacgactccggcgcgtcctcctcgtcggcggccgcgccagtcgagatacccgacgacgccgacgacgactccaccgccgccgctgcagccgtagtcacgcgccagttcttcccggccccggccgccatcggcgcggcgcccgccggctcgtccaacgcgcgcgcgggctggctccgcctgtccgccgcggcgccaccgcccgccgcgggcagcaacggcggcgtcgcaccggctggcggccccgcggcagggtcggcggcgacagcggcggctggtggcaagaagagccggcgcggtccgcggtcgcgcagctcgcagtaccgcggcgtcacgttctaccggcggacggggcggtgggagtcgcacatatgggattgcggcaagcaggtgtatttgggcggatttgacaccgctcatgcggcggctcgggcgtacgatcgggcggcgatcaagttccgcggcgtggaggctgacatcaatttcagcttggaggattaccaagacgacatgaagcagcagatgggccacctgagcaaggaggagttcgttcacgtgctccggcggcagagcacggggttcccccggggcagctccaagttcagaggcgtgacgctccacaagtgcgggaggtgggaggcgcgcatgggccagttcctcggcaagaagtacgtctacttgggcctgttcgacaccgaggaggaagccgccagggcgtacgaccgcgcggccatcaagtgcaacggcaaggacgccgtgacaaactttgatcccagcatttacgcggaggagctcgagccggcggcatcgacgggcggcggcagtggcggcggtgacgatgaacacaatctggacctgtcgctggggagctcggcggggaacaaaaggggcagccttgacggcggcgggggcggcgacgacgagacctcggaccagcgcgtccccatggcgttcgacatcgactggcagacggccgcgccccggagcaccaaagcaaagctggacgcgagctcgaagcaaccccagatgctgccccctcctcttcctcctcctcctgccttgcaagtcgcccaccacctgccgttgccgttcagccccaggcatccgcaattcctgagcaacggcgatccggggaccgcgggaggcctgtccctggcgatcggcggtgccggcggcggaggcggaggcgggcattggactccccagctacagcatcagcagcagcaccaccaacagaggctgcacggcggcgtctgggcgaacggtggcggcacgagctggccgccgccgccgcacccgccgccaccgaccaccgccgcgacggcagctgcagcatcatcacgattccctccctacgttgttacgacgcaaggcccggcgggctgggttcagaagaatggcttccattcgctggccaggcccacctag

SEQ ID NO: 18549 - protein, 491 aa, Sorghum bicolor
  misc_feature: The sequence is a functional homolog of SEQ ID NO 1785 in the 11/479,226 US patent application
  misc_feature: Useful for making plants with modulated flowering time
  misc_feature: Ceres ANNOT ID no. 8703202
  misc_feature (122)..(172): Pfam ID: AP2 Pfam Description: AP2 domain
  misc_feature (215)..(266): Pfam ID: AP2 Pfam Description: AP2 domain
MWDLNDSPAAPPPSPSADDSGASSSSAAAPVEIPDDADDDSTAAAAAVVTRQFFPAPAAIGAAPAGSSNARAGWLRLSAAAPPPAAGSNGGVAPAGGPAAGSAATAAAGGKKSRRGPRSRSSQYRGVTFYRRTGRWESHIWDCGKQVYLGGFDTAHAAARAYDRAAIKFRGVEADINFSLEDYQDDMKQQMGHLSKEEFVHVLRRQSTGFPRGSSKFRGVTLHKCGRWEARMGQFLGKKYVYLGLFDTEEEAARAYDRAAIKCNGKDAVTNFDPSIYAEELEPAASTGGGSGGGDDEHNLDLSLGSSAGNKRGSLDGGGGGDDETSDQRVPMAFDIDWQTAAPRSTKAKLDASSKQPQMLPPPLPPPPALQVAHHLPLPFSPRHPQFLSNGDPGTAGGLSLAIGGAGGGGGGGHWTPQLQHQQQHHQQRLHGGVWANGGGTSWPPPPHPPPPTTAATAAAASSRFPPYVVTTQGPAGWVQKNGFHSLARPT

SEQ ID NO: 18550 - DNA, 738 bp, Sorghum bicolor
  misc_feature: Ceres ANNOT ID no. 8703205
  misc_feature: Encodes the peptide sequence at SEQ ID NO 18551
atgaggcttcaccatctccatgtggcttacttggacaaagcggcggcaggctcgccgccgccgtcgtctccaccatccatctcactagtagcatctcagagctcatctgctgccatccctctggccctccagcaatattgtctgcgcccgcttgcgcccaagatctccttccctgaggcgaggaagatggtcgtccttcctgagtttgctcgcgtcaggaatgcttcttcgaggctgctaaactgcacggtgcaagtgccgacggcgggtggcacgacgcggtggaacccgtcgccggatcagataagggtgctggagatgctttaccgcggggggatgcgcacgcccaactcgttccagatcgagcagatcacggaggagctcggcaagtacggccgaatcgagggcaagaacgtcttctactggttccagaaccacaaagcccgcgagcgccagaagcagaagcgagctgccctcctcacccttagcaccaccgccacttccacgctgctaccattatcaccagcagctgctgaaaccaaagatggagttgagacgaaaaaggaagaagcgtgtgaagatgcatcgagccgcaagcggaggtgcaggacctgggatggcgatgtcgtccatggtggcggcggcgacgatgccgctaaggaggtagctgacgactactacaccgatgatgtgaccctggagctcttcccgttgcgtcctcaagggaaagctagctag

SEQ ID NO: 18551 - protein, 245 aa, Sorghum bicolor
  misc_feature: The sequence is a functional homolog of SEQ ID NO 1331 in the 10/666,642 US patent application
  misc_feature: The sequence is a functional homolog of SEQ ID NO 1333 in the 10/666,642 US patent application
  misc_feature: The sequence is a functional homolog of SEQ ID NO 1332 in the 10/666,642 US patent application
  misc_feature: Ceres ANNOT ID no. 8703205
  misc_feature (91)..(152): Pfam ID: Homeobox Pfam Description: Homeobox domain
MRLHHLHVAYLDKAAAGSPPPSSPPSISLVASQSSSAAIPLALQQYCLRPLAPKISFPEARKMVVLPEFARVRNASSRLLNCTVQVPTAGGTTRWNPSPDQIRVLEMLYRGGMRTPNSFQIEQITEELGKYGRIEGKNVFYWFQNHKARERQKQKRAALLTLSTTATSTLLPLSPAAAETKDGVETKKEEACEDASSRKRRCRTWDGDVVHGGGGDDAAKEVADDYYTDDVTLELFPLRPQGKAS

SEQ ID NO: 18552 - DNA, 972 bp, Sorghum bicolor
  misc_feature: Ceres ANNOT ID no. 8703237
  misc_feature: Encodes the peptide sequence at SEQ ID NO 18553
atggcgccctgccggcagaccttcgcccgctacaccatggcgctgctgtttgctgcggctgctgtctcagcgcagctctccaccgacttctacggtgagacatgccccgacgcgctggacatcattgagtccgccgtgagagccgctatctccaaggagtcccgcatgggggcctccctgctccgcctccatttccacgactgctttgtcaatgcaagtggctgtgacgggtcagtgctgctcgacgacaccacgggcttcaccggcgagaagacggcgaagccgaacaagaactcgctccgtgggttcgacgtggttgacgacatcaaggcgcagctcgaggactcctgccagcagacggtctcctgcgccgacatcctcgccgtcgccgcccgcgactccgtcgtcgccctcggtgggcctacgtgggacgtggagctcggccgccgtgacgggacgacggcgagcctggacgacgcgaacaacgacctcccggcgccgaccctggacctcggcgacctcatcaaggccttcgccaagaagggcctgagcgcgaacgaaatgatcgcgctgtcgggcgggcacacgatcgggcaggcgcggtgcgtcaacttccgcggccgcctctacaacgagaccaccagcctggacgcgtcgctggcgtcgtcgctgaagccgcggtgcccgagcgcggacggcaccggcgacgacaacacgtcgccgctggacccggccacgtcctacgtcttcgacaacttctactacaggaacctgctgcggaacaagggcctgctccactcggaccagcagctcttcaacggcggctccgcggacacgcagaccacctcctacgcgtccgacaaggccggcttcttcgatgatttccgcgacgccatggtgaagatgggtgccatcggcgtcgtcactgggtccggagggcaggtcaggctgaactgccggaagacgaactaa

SEQ ID NO: 18553 - protein, 323 aa, Sorghum bicolor
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13606
  misc_feature: Useful for making plants with modulated oxidative stress sensitivity
  misc_feature: Functional homolog of the protein sequence given in SEQ ID NO 13607
  misc_feature: Ceres ANNOT ID no. 8703237
  misc_feature (27)..(323): SWISSPROT Homolog: EC 1.11.1.7 Peroxidase
  misc_feature (42)..(287): Pfam ID: peroxidase Pfam Description: Peroxidase
MAPCRQTFARYTMALLFAAAAVSAQLSTDFYGETCPDALDIIESAVRAAISKESRMGASLLRLHFHDCFVNASGCDGSVLLDDTTGFTGEKTAKPNKNSLRGFDVVDDIKAQLEDSCQQTVSCADILAVAARDSVVALGGPTWDVELGRRDGTTASLDDANNDLPAPTLDLGDLIKAFAKKGLSANEMIALSGGHTIGQARCVNFRGRLYNETTSLDASLASSLKPRCPSADGTGDDNTSPLDPATSYVFDNFYYRNLLRNKGLLHSDQQLFNGGSADTQTTSYASDKAGFFDDFRDAMVKMGAIGVVTGSGGQVRLNCRKTN

SEQ ID NO: 18554 - DNA, 1365 bp, Sorghum bicolor
  misc_feature: Ceres ANNOT ID no. 8703219
  misc_feature: Encodes the peptide sequence at SEQ ID NO 18555
atgaagctcccgctgctgcggccgctgtggccgggcctgggccccgcggcggggccggccgacgcggcgccggagccggccaagccgtcgctgccggcaacgtggctgctgctgcacgcgctcttctgcgccacctccatggccgtcggcttccgcttctcccgcctcatcgtctacctcctcttcctgcccaccccgcccatcaaccccgccgcgcacctcgtctcgctcgtgtccccacccgccgtcgtgctcgcgggcgccaacgccacggccatggcaacgatcaccacgacaacgaccacgacgaccaccgtcaccaccaccaccaccgtggccgccgagatcggtgaccacccgcagccgcagcaccaccaccaccaccacggccccgtcttcgtcggccgacatccgatccgcgtccgcgcctggccccacccggacccaagcgagctcctcaaggcgcaccgcatccttgccgccgtccagaacgcgcagcgcagcaccaagcgccgtggcgcgggacccgcgaggcctgtcattgccgtcaccccgaccaccacctccgcgctccaggtgccgtcgctgacgtctctggcgcacaccctccgcctcgttgacgcccagctcgtgtggatcgtcgtcgagccgggccaccgcaccgacgccgtcgccgcggtgctgtcccgctccaacctcgacttcctccacatcaccggcgctggcgactccacggcgagcctgcgattgcacgccctcagggaaattcggacgaagcggatggacggcatcgtggtgttcgctgacgagaacagcatcctccgtaccgagctgttcgacgaggcgcagaaggtgaccaccgtgggcgccgtgcccgtcggcatccttggcgaggacgacggcaccagcgagtccttcctccaggcgccgtcgtgcgacgcggaagggaacctggtgggctaccgcatctcggaggagaccgtgttgccggcgaaccggagcgacatgctgatgtccagcaggctggagtgggccggcttcgtggtgaacgcgcgggcgctgtgggaggacaccaaggagcggccggtgtgggtgcgcgatctcagcgccatcgacgacgccgacgctcgcgctgccagccctctcgcgctcgtcaccgacgccggccgcgtcgagccgctcgccagctgtgcccaggcggctctcgcgtggtcgctgcgttccgacagtctccacgaggtcaaattcccacacgagtggaaaatcgatcctccactgctgaataccggtgcccgtcagcaaactgttgaaccagagacacaaccgatgcaaactactctagcaagcactgaagaccagcactag

SEQ ID NO: 18555 - protein, 454 aa, Sorghum bicolor
  misc_feature: Useful for making plants with altered carbohydrate content
  misc_feature: Functional homolog of the protein sequence given in SEQ ID NO 14649
  misc_feature: Ceres ANNOT ID no. 8703219
  misc_feature (135)..(238): SWISSPROT Homolog: EC 2.4.1.135 Galactosylgalactosylxylosylprotein 3-beta-glucuronosyltransferase
  misc_feature (199)..(410): Pfam ID: Glyco_transf_43 Pfam Description: Glycosyltransferase family 43
MKLPLLRPLWPGLGPAAGPADAAPEPAKPSLPATWLLLHALFCATSMAVGFRFSRLIVYLLFLPTPPINPAAHLVSLVSPPAVVLAGANATAMATITTTTTTTTTVTTTTTVAAEIGDHPQPQHHHHHHGPVFVGRHPIRVRAWPHPDPSELLKAHRILAAVQNAQRSTKRRGAGPARPVIAVTPTTTSALQVPSLTSLAHTLRLVDAQLVWIVVEPGHRTDAVAAVLSRSNLDFLHITGAGDSTASLRLHALREIRTKRMDGIVVFADENSILRTELFDEAQKVTTVGAVPVGILGEDDGTSESFLQAPSCDAEGNLVGYRISEETVLPANRSDMLMSSRLEWAGFVVNARALWEDTKERPVWVRDLSAIDDADARAASPLALVTDAGRVEPLASCAQAALAWSLRSDSLHEVKFPHEWKIDPPLLNTGARQQTVEPETQPMQTTLASTEDQH

SEQ ID NO: 18556 - DNA, 261 bp, Sorghum bicolor
  misc_feature: Ceres ANNOT ID no. 8703251
  misc_feature: Encodes the peptide sequence at SEQ ID NO 18557
atggctcacggcacggtattttggcacggcccggctcgacggctatcgggtccgggccggcacggcccgaggtgccagccgtgcacggagctgttggaccggtccgccttctcccacccaaactccctctccgaggcaaccttgcggttgcgtcgcaacctcagctacttccgcatcaactacgtcgatgtcgtcgcattctccctcacggtctcgctcttggtgcacgccttctacctcctcgacatcctcgccgcctag

SEQ ID NO: 18557 - protein, 86 aa, Sorghum bicolor
  misc_feature: The sequence is a functional homolog of SEQ ID NO 2244 in the 10/374,780 US patent application
  misc_feature: The sequence is a functional homolog of SEQ ID NO 82 in the 10/412,699 US patent application
  misc_feature: The sequence is a functional homolog of SEQ ID NO 922 in the 10/225,066 US patent application
  misc_feature: Ceres ANNOT ID no. 8703251
  misc_feature (28)..(77): SWISSPROT Homolog: EC 3.2.1.51 Alpha-L-fucosidase
MAHGTVFWHGPARRLSGPGRHGPRCQPCTELLDRSAFSHPNSLSEATLRLRRNLSYFRINYVDVVAFSLTVSLLVHAFYLLDILAA

SEQ ID NO: 18558 - DNA, 1458 bp, Sorghum bicolor
  misc_feature: Ceres ANNOT ID no. 8703259
  misc_feature: Encodes the peptide sequence at SEQ ID NO 18559
atggacacctcgcaccactatccatggctcaacttctccctcgctcaccacggtgatctcgaggaggaggagaggggcgcagccgccgagctggccgcgatagccggcgccgcgccgccgccgaagctggaggacttcctcggcggaggcgtcatcaacggagagagcgccagaagcggcggcggtgttccggtggccgcgccggaggtgtcggcgcccgcggagatgtacgactcggacctcaagttcatagccgccgccgggttcctgggcggcggctcggctgctggaccggtggcgacgtcgcccctgtcttccctcgaccaggccgaccccaagctggccttgcctgcggccgccgcggcggcgccggcgccggagcagaggaaggccgtcgactcttttgggcagcgcacgtccatctaccgcggcgtcacacggcaccggtggactggcaggtacgaggcacatctatgggacaacagctgccggcgtgaagggcagagccgcaagggccgccaaggtggctatgataaggaggagaaggcagccagggcgtatgatcttgcagctttgaagtactggggttctagtaccaccaccaactttccggttgctgagtatgaaaaggagctcgaagagatgaagaccatgactcggcaagagtttgttgcttcccttcgaaggaagagcagtggattctccaggggtgcttctatttacagaggtgtaaccagacatcaccagcatgggcggtggcaagcaaggatcggaagggtggccggtaacaaggacctctaccttggaacattcagcaccgaggaggaagctgcggaggcctatgacatagcggccatcaagttcagaggcctgaacgctgttacaaactttgagatcagccggtataacgttgagagcataatgaacagcaacattccaatggggagcatgtcggccggtggccggagcaacaaggcactggagtcccctccatcgggctcacctgacgccatgcccgtcgaagccagcacggcgcccctgtttgccgctcttccggtgaagtatgaccagcagcagcaggactacctgtcgatgctcgcgttgcagcaccaccagcaagggaacctgcaggggctagggttcggcctgtactcatccggagtgaacctggatttcgcaaactcccatagcactgcttcgtcgatgacccactgctatgtcaatggcggcacggtctcctcacatgagcagcaccagcaccaccagcagctgcaggatcatcagcagcagggcgagagtgagacgcaacagagctccaacagctgctcctccctcccattcgccacaccgatcgctttcaatgggtcctatgaaagctccatgacggcggcaggcccctttggatactcctacccaaatgtggcagcctttcagacgccgatctatggaatggaatga

SEQ ID NO: 18559 - protein, 485 aa, Sorghum bicolor
  misc_feature: The sequence is a functional homolog of SEQ ID NO 1014 in the 10/225,066 US patent application
  misc_feature: The sequence is a functional homolog of SEQ ID NO 2496 in the 10/374,780 US patent application
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: The sequence is a functional homolog of SEQ ID NO 1900 in the 10/412,699 US patent application
  misc_feature: The sequence is a functional homolog of SEQ ID NO 358 in the 10/666,642 US patent application
  misc_feature: The sequence is a functional homolog of SEQ ID NO 676 in the 11/435,388 US patent application
  misc_feature: Useful for biocontainment applications
  misc_feature: Functional homolog of the protein sequence given in SEQ ID NO 13650
  misc_feature: Ceres ANNOT ID no. 8703259
  misc_feature (239)..(291): Pfam ID: AP2 Pfam Description: AP2 domain
  misc_feature (140)..(197): Pfam ID: AP2 Pfam Description: AP2 domain
MDTSHHYPWLNFSLAHHGDLEEEERGAAAELAAIAGAAPPPKLEDFLGGGVINGESARSGGGVPVAAPEVSAPAEMYDSDLKFIAAAGFLGGGSAAGPVATSPLSSLDQADPKLALPAAAAAAPAPEQRKAVDSFGQRTSIYRGVTRHRWTGRYEAHLWDNSCRREGQSRKGRQGGYDKEEKAARAYDLAALKYWGSSTTTNFPVAEYEKELEEMKTMTRQEFVASLRRKSSGFSRGASIYRGVTRHHQHGRWQARIGRVAGNKDLYLGTFSTEEEAAEAYDIAAIKFRGLNAVTNFEISRYNVESIMNSNIPMGSMSAGGRSNKALESPPSGSPDAMPVEASTAPLFAALPVKYDQQQQDYLSMLALQHHQQGNLQGLGFGLYSSGVNLDFANSHSTASSMTHCYVNGGTVSSHEQHQHHQQLQDHQQQGESETQQSSNSCSSLPFATPIAFNGSYESSMTAAGPFGYSYPNVAAFQTPIYGME

SEQ ID NO: 18560 - DNA, 960 bp, Sorghum bicolor
  misc_feature: Ceres ANNOT ID no. 8703352
  misc_feature: Encodes the peptide sequence at SEQ ID NO 18561
atgaaggaccgccacctctcgctgaaccagacgcagcgggtccgcctcgaggccgcactccatgagctccagtcccttgcgcccgccgccgcgtccgccgccgctgtcaccgtcgcggacaccattcccgtcaatcaggaggacaacatcctcaaggggcacgggacgtcggaccaggacggggaggtggtggcgacgctctgcggggtggttgagcgggtcaacaaactggtatacgtccgtactctccgggcgagatacaagccggaggttggtgatatcatagttggccgtgtgattgagattgctccaaagcgctggaggttggagataaattttagccaagatgctgttctgatgctttcgtctatgaatttgcccgatggtattcagagaaggagaactgctgttgatgaactcaatatgcggagtatctttgaagaaaatgatgttatctgtgctgaagttcgcggcttccaacatgatggatctctgcacctacaggcaaggagtgaaaaatatggaaagctcgagaggggtcaattgctgatggtacctccatacttggttaaacgaaagaagcagcattttcatcatcttgagcagtacaatgtcgacttgattcttggttgcaatggattcatctgggttggtgagcatgttgtggtgggtgaaacaacaaaaacgacaggaggtcagcagaggttcagcactgaagcagagaattttaccccattagaaacgaggaagcatatttgccggcttgccaatgctgtgcgtgtgctctcagccctaggattcactttgatcgttgaactgataattgagaccatggaagcaagtgtgtcatcaaatgtagagataaatgccatgctcggtgctgaattctatgtccagacagcagagagagaggctaagcgtcgagctgatctgttgagaaagaagaatggggcaaggtaa

SEQ ID NO: 18561 - protein, 319 aa, Sorghum bicolor
  misc_feature: Useful for making plants with altered lignin content
  misc_feature: Functional homolog of the protein sequence given in SEQ ID NO 14650
  misc_feature: Ceres ANNOT ID no. 8703352
MKDRHLSLNQTQRVRLEAALHELQSLAPAAASAAAVTVADTIPVNQEDNILKGHGTSDQDGEVVATLCGVVERVNKLVYVRTLRARYKPEVGDIIVGRVIEIAPKRWRLEINFSQDAVLMLSSMNLPDGIQRRRTAVDELNMRSIFEENDVICAEVRGFQHDGSLHLQARSEKYGKLERGQLLMVPPYLVKRKKQHFHHLEQYNVDLILGCNGFIWVGEHVVVGETTKTTGGQQRFSTEAENFTPLETRKHICRLANAVRVLSALGFTLIVELIIETMEASVSSNVEINAMLGAEFYVQTAEREAKRRADLLRKKNGAR

SEQ ID NO: 18562 - DNA, 1791 bp, Sorghum bicolor
  misc_feature: Ceres ANNOT ID no. 8703409
  misc_feature: Encodes the peptide sequence at SEQ ID NO 18563
atggcggggctcccgctgtccgtcgtcgccttccacctgtgcctcctcgcgtcgtcgtcgtcgtcgtctgctcttcggccggcgacaaccgcgagcgagagcgacggcggcggcagccgtgccggcaggaccgcctaccacttccagcccgccaagaactggcagaacgggccgatgtactacaacggcatgtaccatttcttctaccagtacaacccgcacggcgcgctctgggacatcggcaatctctcctggggccactccgtctccggcgacctcgtcaactgggccgcactggacacggcgctggacccgacgtcgcccttcgacgccaacggctgctggtcgggctccgccaccatcctccccggcggcaccccggccatcctctacacgggcatcgacgccagcggggagcaggtgcagaacgtggcgttcccgaggaaccctgccgaccctctcctccgcgagtgggacaagcccagctacaaccccgtcatcccgctccccgccgacgtccccggcgacaagttccgggacccctcgacggcgtggctgggccgcgacgggctgtggcgcatcgtggtgtccgccgaggtccgcggcgtggcgtccacgctcgtgtaccggagcccggacttcctccgctgggagcgcgcggccaccgcgccgctgcacgcctcgcgcgccgcgggtatggtggagtgcccggacctgttcccggtgaaggaggagagcggtggcgacgacgacggtgaagggctcgacgcgtcggcgagcggcgatggggtgcggcacgtgttgaagctcagcgtgatggacacgctccaggactactacatggtggggcggtacgacgccgcggcggacgcgttcgtgccggcggagcccgagcgcggcgacgacgtgcgcgcctggcggcggctggactacggccacgtgtacgcgtccaagtccttcttcgacgcgcgccacagccggcgcgtgctgtgggcgtgggccaacgagtccgacagccaggccgacgacgtcgccaagggctggtccggcgttcagacgttcccgaggaagctgtggctggacgaggacgggaagcagctgcggcagtggccggtggaggagatcgagacgctacggaggaagcgcgtcggcctgcgccgcggaacggtgctgagcgccggaggcatgaacgagatcgtcggcgtcgccgggtcgcaggcggacgtggaggtcgagttcaaggtcccgagcctggctgaggccgaggcgctggacgccaaccggctgctggacccgcagaagctgtgcggggagaagggcgcctcggtgccgggcggcgtcgggccgttcgggctcatcgtgttggcctccggcgacctgcgggagcacaccaccgtcttcttccgggtgttcaggcaccagggcaggtacaggcttctcatgtgcaccgacctaacgaggtcgacgacgagggccggcgtgtacaagccgccatacggaggattcgtggacgtcgacgtagaggagcacgagaccatcaaattgagaaccctgattgatcactcgatgctggagagcttcggagctgaagggcggatctgcatcactgctcgagtgtaccctgagcacgcggagacgagcaacagccacttgttcgtgttcaacaatggcacgggcaaggtggaggtgcccaagctcgaggcatgggagctcgccgcggcgaccgtgaatgctgttggggatgccggcctgatcgtgtctcaatctaaagacgaaagtgaatcctattaa

SEQ ID NO: 18563 - protein, 596 aa, Sorghum bicolor
  misc_feature: Useful for making plants with altered carbohydrate content
  misc_feature: Functional homolog of the protein sequence given in SEQ ID NO 13880
  misc_feature: Ceres ANNOT ID no. 8703409
  misc_feature (33)..(585): SWISSPROT Homolog: EC 3.2.1.26 Beta-fructofuranosidase
  misc_feature (47)..(371): Pfam ID: Glyco_hydro_32N Pfam Description: Glycosyl hydrolases family 32 N terminal
  misc_feature (413)..(531): Pfam ID: Glyco_hydro_32C Pfam Description: Glycosyl hydrolases family 32 C terminal
MAGLPLSVVAFHLCLLASSSSSSALRPATTASESDGGGSRAGRTAYHFQPAKNWQNGPMYYNGMYHFFYQYNPHGALWDIGNLSWGHSVSGDLVNWAALDTALDPTSPFDANGCWSGSATILPGGTPAILYTGIDASGEQVQNVAFPRNPADPLLREWDKPSYNPVIPLPADVPGDKFRDPSTAWLGRDGLWRIVVSAEVRGVASTLVYRSPDFLRWERAATAPLHASRAAGMVECPDLFPVKEESGGDDDGEGLDASASGDGVRHVLKLSVMDTLQDYYMVGRYDAAADAFVPAEPERGDDVRAWRRLDYGHVYASKSFFDARHSRRVLWAWANESDSQADDVAKGWSGVQTFPRKLWLDEDGKQLRQWPVEEIETLRRKRVGLRRGTVLSAGGMNEIVGVAGSQADVEVEFKVPSLAEAEALDANRLLDPQKLCGEKGASVPGGVGPFGLIVLASGDLREHTTVFFRVFRHQGRYRLLMCTDLTRSTTRAGVYKPPYGGFVDVDVEEHETIKLRTLIDHSMLESFGAEGRICITARVYPEHAETSNSHLFVFNNGTGKVEVPKLEAWELAAATVNAVGDAGLIVSQSKDESESY

SEQ ID NO: 18564 - DNA, 1188 bp, Sorghum bicolor
  misc_feature: Ceres ANNOT ID no. 8703412
  misc_feature: Encodes the peptide sequence at SEQ ID NO 18565
atggtgtccgaccaggagatcgcaagctgcgtcgagtccgtcctccgtggctccgccggcgggcccggggaggcctcgctcgccgccgtgttgcagcaggcggaggccacgctcggcgtcgacctctcccacaaggcgggcttcatccgcgaccagatggacctcttcttcggcccgaacctccagccgcagccgccgaccaagccccagccggcgcctcccccgcctcaggccctcgttgcctcctcggccgctgtgccgcagctccagcctcagcatcagcatcaggtcctgccgcaggtgcaggggcagccgcaagcgccgcctccggaccaacagctgcagccacagctcccgcaactccagccgcggctcgtcttccagaccattccgcagctccccgccatggcccccgtccccgcggtttccgcgccgcccgccgtgccggccatggcgttctacccgccgccgccgctcgccttccgctacaccaccggcctcgctggggccgccacgggtggcaccgtctccttccagcagccggcccctggggctggtggcactgctccccccaccgccgctgcaccgcaggtcgcgggcgacaacaaggaaagcgcttctaagcggaagagaggtggacctggtggtttaaataaagtttgtgcaatttcacctgaacttcaaaccattgttggtgagactgccatgtcaagaactcagattgtgaagcagctctgggcctatatcaggcagaacaatcttcaagatcctgatgacaaaaggaagatcatttgcaatgacgaacttcgcgtggtttttgaaactgacaccaccgacatgtttaaaatgaataaattgttggctaagcacataaccccacttgacccaaaagatcaagtaaaaagaatgaaggctcctaccgtggctcctcaacctggccctcccattaatcagccctccgtagttatttctgacgcactagcaaagttcattggaacagatggaacatttcctcaagatgatgcccagaaatacctgtgggattacataaaagcaaaccaacttgaggatgtcatcaatgaatcaatattatgtgattcaaaacttcaagagctatttggctgtgagagcattcctatgtcaggactatcagaaatgcttggtcaccacttcatcaagaaaacatag

SEQ ID NO: 18565 - protein, 395 aa, Sorghum bicolor
  misc_feature: Useful for making plants with modulated biomass
  misc_feature: Useful for making plants with modulated drought sensitivity
  misc_feature: Useful for making plants with modulated flowering time
  misc_feature: Functional homolog of the protein sequence given in SEQ ID NO 12918
  misc_feature: Ceres ANNOT ID no. 8703412
  misc_feature (217)..(292): Pfam ID: SWIB Pfam Description: SWIB/MDM2 domain
  misc_feature (318)..(392): Pfam ID: SWIB Pfam Description: SWIB/MDM2 domain
  misc_feature (3)..(58): Pfam ID: DEK_C Pfam Description: DEK C terminal domain
MVSDQEIASCVESVLRGSAGGPGEASLAAVLQQAEATLGVDLSHKAGFIRDQMDLFFGPNLQPQPPTKPQPAPPPPQALVASSAAVPQLQPQHQHQVLPQVQGQPQAPPPDQQLQPQLPQLQPRLVFQTIPQLPAMAPVPAVSAPPAVPAMAFYPPPPLAFRYTTGLAGAATGGTVSFQQPAPGAGGTAPPTAAAPQVAGDNKESASKRKRGGPGGLNKVCAISPELQTIVGETAMSRTQIVKQLWAYIRQNNLQDPDDKRKIICNDELRVVFETDTTDMFKMNKLLAKHITPLDPKDQVKRMKAPTVAPQPGPPINQPSVVISDALAKFIGTDGTFPQDDAQKYLWDYIKANQLEDVINESILCDSKLQELFGCESIPMSGLSEMLGHHFIKKT

SEQ ID NO: 18566 - DNA, 1764 bp, Sorghum bicolor
  misc_feature: Ceres ANNOT ID no. 8703408
  misc_feature: Encodes the peptide sequence at SEQ ID NO 18567
atgaacgggaagcagagcctacgccatggccgaacagcgtaccacttccagcctgccaagaactggatgaacgggcctttgtaccacaagggcatgtaccacctgttcttccagtacaacccgcacggcccactgttcggcaccggtaagctctcctggggccactccgtctccggcgacctcgtgaactgggccttcctgggcacagcgctggacccgacgtcgccgttcgacgccgagggctgctggtcgggttccaccaccacgctcgccgatggccgcccggccatcctctacaccgggcgcgacgccaacgacgtgcaggtgcagaacgtggcgttccccaagaacccgtcggacccgctcctccgggagtggcacaagcccagctgcaacccggtcgtcccgcagcccgccgacgtgacgcgcaacaacttccgggaccccaccacggcgtggctgggccgcgacgggctctggcggttcgccgtcgtggccgaggtcggcggcgtcggctccaccgtggtgtaccgcagcgcggacttcgtccactgggagcggaacgccgcgccgctgcacgcgtcccccgacgtgcctgtctgggagtgccccgacctgttcccggtggcagagcgcggcacggaggggctcgacacgtcggtgagcgccgggcccggggtgaggcacgtcctcaagctcagcaaggccgccgacgaggactactacgtggtcggccggtacgacgatgagaccgacacgttcgcgccggtggacgacggcgaccacgacgtccggaactggcgccggatcgaccacggccacctgttcggggccaagacgttcttcgacgcgcggaagaagcggcgcgtgctgtgggcgtgggtggacgagacggacagccgctccgacgacgtcggcaaggactggacgggcatccagacgttcccgagggcgctgtggctggacgccgacgggaagcagctggtgcagtggccggtggaggagatcgagacgctgcggagggagcgagtcgcgctggttggggcggagatcggctccggcggccttcacgagatcgccggcgtcgatgccctgcaggcggacgtggaggtcgtgttcgacctcccgagcctggaggacgccgaggagctggaccccaagtggctgcaagatccccagaagctgtgtgtgtatgcggagaagaaggacgcttcctcaccgggccctggcggcgtcgggccgttcgggctcgtcgtgatggcgtccggcgacatgcgggagcagaccaccgtgttcttcagggtgttcaggcacggtggcacgtacaaggtcctcatgtgcgccgacctgacaaggtcatcgacaaaagagggggtgcacaagccagtctacgcaggatttgttgacgtggacgtggagaaggacaggagcatatcgctaagaacactgattgaccactctgtcatcgagagcttcggaggcgggggccggacgtgcatcacggcccgagtgtaccctgagcacgtggtagcaggaggcagtagccacctgtacctgttcaacaacggagctcacccagtgactgtgtccaagctggaggcctgggagctagggacggcaagcgtcaacgttgaagaagactaccagccacatagccctaattcaacagatggggagaaggtaagtgaggcattaggggtgactggtcactacggtagtcctaattcaatagctggagagatgggaagtgaggcatttggttga

SEQ ID NO: 18567 - protein, 587 aa, Sorghum bicolor
  misc_feature: Useful for making plants with altered carbohydrate content
  misc_feature: Functional homolog of the protein sequence given in SEQ ID NO 13880
  misc_feature: Ceres ANNOT ID no. 8703408
  misc_feature (11)..(544): SWISSPROT Homolog: EC 3.2.1.26 Beta-fructofuranosidase
  misc_feature (15)..(332): Pfam ID: Glyco_hydro_32N Pfam Description: Glycosyl hydrolases family 32 N terminal
  misc_feature (373)..(496): Pfam ID: Glyco_hydro_32C Pfam Description: Glycosyl hydrolases family 32 C terminal
MNGKQSLRHGRTAYHFQPAKNWMNGPLYHKGMYHLFFQYNPHGPLFGTGKLSWGHSVSGDLVNWAFLGTALDPTSPFDAEGCWSGSTTTLADGRPAILYTGRDANDVQVQNVAFPKNPSDPLLREWHKPSCNPVVPQPADVTRNNFRDPTTAWLGRDGLWRFAVVAEVGGVGSTVVYRSADFVHWERNAAPLHASPDVPVWECPDLFPVAERGTEGLDTSVSAGPGVRHVLKLSKAADEDYYVVGRYDDETDTFAPVDDGDHDVRNWRRIDHGHLFGAKTFFDARKKRRVLWAWVDETDSRSDDVGKDWTGIQTFPRALWLDADGKQLVQWPVEEIETLRRERVALVGAEIGSGGLHEIAGVDALQADVEVVFDLPSLEDAEELDPKWLQDPQKLCVYAEKKDASSPGPGGVGPFGLVVMASGDMREQTTVFFRVFRHGGTYKVLMCADLTRSSTKEGVHKPVYAGFVDVDVEKDRSISLRTLIDHSVIESFGGGGRTCITARVYPEHVVAGGSSHLYLFNNGAHPVTVSKLEAWELGTASVNVEEDYQPHSPNSTDGEKVSEALGVTGHYGSPNSIAGEMGSEAFG

SEQ ID NO: 18568 - DNA, 2826 bp, Sorghum bicolor
  misc_feature: Ceres ANNOT ID no. 8703404
  misc_feature: Encodes the peptide sequence at SEQ ID NO 18569
atggcgtccgcgcaggagaaggccacgtcgggtgtgctgaggaacgcggcggcgctgctcgacgaaatgcagctcatgggagaaacgcagggtgcgaagaaggtgatcaactccgagctgtggcacgcgtgcgcggggccgctggtgtgcttaccgcagcgagggagcctcgtctactacttcccccaggggcacagcgagcaggttgctgctaccactaaaaagataccgaattctcgcattccaaactacccgagtctcccgtcgcagctgctatgccaagtccacaacatcactttgcatgctgacaaagaaactgatgagatttatgcccagatgaccctgcaaccagtacactcggaaacagacgtcttcccaattccatctcttggtgcttataccaaaagcaagcatcccactgaatatttctgcaaaaatctaactgcaagtgatacaagcacacatggtggtttctcagtgccacggagagctgcagagaagttgtttccgcaattgcctcctaatcaggagcttatcgttcgagatttgcatgataacatgtggacattccgtcacatttatcgtggccagccaaagcgccatcttctaacaaccggatggagtctttttgttggggcgaaacggcttaaagctggggactctgtcttatttatcagggatgagaagtcacagctccttgtgggtgttaggcgggccacccgacaacaaccggctttgtcatcatccgtcctgtctactgacagtatgcacataggtgttcttgctgcagcagctcatgcagcatcaagtggtggctcatttactatctactacaatcctcggacaagcccgtcgccatttgtgattcctcttgcaaggtacaataaggcaacatatctgcaaccatcagtcggaatgagattcgcgatgatgtttgagacagaagagtcaatcaagcgcagatgcacaggtacaattgtgggaattagtgactatgacccgatgcgatggccaaactcaaaatggcgcaacttgcaggtagaatgggatgaacatgggtatggagaaagacctgaaagagttagtctatgggatatcgaaactccagagaacatggtcttcccttctccattgaattcaaagcggcaatgtcttcctagttatgcagttcctggcctacaaattggatctgtaaatatgtcatcaattccaagggcacaaggaagtccttttggtaacttgcagcaaatgccagggagtggctcagacttagctttgctgcttctcaatcaatctggccagaaccttggtagtccaattgcctgtcaacaatcatcattttccagcattattcaaaatgctaagcacagctatttccctccatcgacatttggtgcttccactggttcaatgaagcaagaaaccatgccttcgaatgaagctccgcagcagttgaatgctcttggtattcagaaaggtgatcaagtaagctgtgaagtccagccaggtattgattcaatttctgcacgggagatgagtgttaaaccaagaggaccaagaagcacagattcatactcaagtcaaagcatttcggatcaaaacggcaagggcgagcctagaacaaaatctcgaaggagcaagaagagctcgtctcacaaaaccatttcagataaatctgagctttcttcactaccttctcagatttgtgacaagcagaggcatggttcagaaccaacattggttgactgtggagccgaacaagctacctgtgggaatattgaagattcatctggtgcacctacacgaggtgattttgcaggagaactgcaagttctggaggttgaacagcatgaactactttcaccaccaaagttagaatcatcaaagtcacctgatggagggaagtccgtcagctcgttcccaaaccaagggtgtttctcacagttccttgagggcctggattggatgattccgccttcctactaccaagactccaatggcattcaatcagctaccgcatcggataacatttttaatccgtctgaaggtataccttccgcaatgaatacggatggcatggaggcgtttcaaacctcttgcctttctgagtgctttcctaattcaattcaagagttcatcaacagtccagatataaatacactgacatttatgtcgcctgagatgcaacatttggatgcccaacacgacggcagcaacttgccgagcacatccaactcctatgtgcagatgagtttctcagaggagagtcagagtgcatccttaagtggcctgcacatggaagctatccatataaacagctcatgttctcaaccactggcaacggggagctttgatgcagggacgttctcaaaactgtcaaacatgaaagaatgtcaagccttgcctctacaagagatccacaacggttctatgggaacaccttcgtgcagtatggatgcagcggccgagtacagcatggatcgaagcgtgaagccaatgaaaccaccggtccggacatatacaaaggttcaaaagttaggatcagttggaagatctattgacgtcacacggttcagagattaccatgagttgaggtcagccattgcatgcatgtttggactccaggggaaactggaacatcctggcggttcagactggaagcttgtttatgtcgactacgagaacgacgttcttctcgttggagacgatccatgggaggagttcatcaactgtgtgagatgcattcggatcttatcgccttcggaagtacaacagatgagcgagaatggcgtgcatgtcttgaacgactgcatccaaatagcttag

SEQ ID NO: 18569 - protein, 941 aa, Sorghum bicolor
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: Ceres ANNOT ID no. 8703404
  misc_feature (264)..(346): Pfam ID: Auxin_resp Pfam Description: Auxin response factor
  misc_feature (142)..(242): Pfam ID: B3 Pfam Description: B3 DNA binding domain
  misc_feature (750)..(930): Pfam ID: AUX_IAA Pfam Description: AUX/IAA family
MASAQEKATSGVLRNAAALLDEMQLMGETQGAKKVINSELWHACAGPLVCLPQRGSLVYYFPQGHSEQVAATTKKIPNSRIPNYPSLPSQLLCQVHNITLHADKETDEIYAQMTLQPVHSETDVFPIPSLGAYTKSKHPTEYFCKNLTASDTSTHGGFSVPRRAAEKLFPQLPPNQELIVRDLHDNMWTFRHIYRGQPKRHLLTTGWSLFVGAKRLKAGDSVLFIRDEKSQLLVGVRRATRQQPALSSSVLSTDSMHIGVLAAAAHAASSGGSFTIYYNPRTSPSPFVIPLARYNKATYLQPSVGMRFAMMFETEESIKRRCTGTIVGISDYDPMRWPNSKWRNLQVEWDEHGYGERPERVSLWDIETPENMVFPSPLNSKRQCLPSYAVPGLQIGSVNMSSIPRAQGSPFGNLQQMPGSGSDLALLLLNQSGQNLGSPIACQQSSFSSIIQNAKHSYFPPSTFGASTGSMKQETMPSNEAPQQLNALGIQKGDQVSCEVQPGIDSISAREMSVKPRGPRSTDSYSSQSISDQNGKGEPRTKSRRSKKSSSHKTISDKSELSSLPSQICDKQRHGSEPTLVDCGAEQATCGNIEDSSGAPTRGDFAGELQVLEVEQHELLSPPKLESSKSPDGGKSVSSFPNQGCFSQFLEGLDWMIPPSYYQDSNGIQSATASDNIFNPSEGIPSAMNTDGMEAFQTSCLSECFPNSIQEFINSPDINTLTFMSPEMQHLDAQHDGSNLPSTSNSYVQMSFSEESQSASLSGLHMEAIHINSSCSQPLATGSFDAGTFSKLSNMKECQALPLQEIHNGSMGTPSCSMDAAAEYSMDRSVKPMKPPVRTYTKVQKLGSVGRSIDVTRFRDYHELRSAIACMFGLQGKLEHPGGSDWKLVYVDYENDVLLVGDDPWEEFINCVRCIRILSPSEVQQMSENGVHVLNDCIQIA

SEQ ID NO: 18570 - DNA, 984 bp, Sorghum bicolor
  misc_feature: Ceres ANNOT ID no. 8703400
  misc_feature: Encodes the peptide sequence at SEQ ID NO 18571
atggcggccaatgtgggcgcgggcaggagtgccgtcggcggcggcggtggtggtggagcgggtggcactggcactgctgctgccagcggcagcgtggcgacgacagcggtgtgccgccccatcggctcgcggtggacgccgacgcccgagcagatcaggatactcaaggagttctactacggctgcggcatccggtcgcccaactcggagcagatccagcgcatcaccgccatgctgcgccagcacggcaagatcgagggcaagaacgtcttctactggttccagaaccacaaggcccgcgaacgccagaagcgccgcctcaccaacctcgacgtcaacgtgcccaccgccgcagccgccggcgcggccgacgccagcacccacctaggcgtcctctcgctgtcgtcgccttcaggcgcggcgcctccctcgcccaccctcggcttctacgccggcaatggcggcgccggctcgaccgtgctgctggacacgagttccgactgcgctgccatggccactgagacatgcttcctgcaggactacatgggcgtgatgggcacgggcagcgcggccgccgcgtcgccgtgggcatgcttctcgtcgtcgaacactatggcggcggccgcggcacgggcaccgacggtgacgcgggcgcccgagacgctccctctcttcccgacgggcggcgacgacagccagccccggcggccgcggcacggagtcccagttccagttgcagcaggcgaggccatccgcggcggcagcagcagcagcaggtacctgccgttctggggtgccgcgcccacaactgccagtgccacttccattgggatccagcagcaacaccagctgctgcagctgcaagagcagtacagcttttacagcaacgccatgcccggcaccggcagccaagatgcatcagcagcatccctggagctcagcctcagctcctggtgctccccttaccctgcagggaccatgtga

SEQ ID NO: 18571 - protein, 327 aa, Sorghum bicolor
  misc_feature: The sequence is a functional homolog of SEQ ID NO 1670 in the 10/374,780 US patent application
  misc_feature: The sequence is a functional homolog of SEQ ID NO 1681 in the 10/412,699 US patent application
  misc_feature: Ceres ANNOT ID no. 8703400
  misc_feature (41)..(103): Pfam ID: Homeobox Pfam Description: Homeobox domain
MAANVGAGRSAVGGGGGGGAGGTGTAAASGSVATTAVCRPIGSRWTPTPEQIRILKEFYYGCGIRSPNSEQIQRITAMLRQHGKIEGKNVFYWFQNHKARERQKRRLTNLDVNVPTAAAAGAADASTHLGVLSLSSPSGAAPPSPTLGFYAGNGGAGSTVLLDTSSDCAAMATETCFLQDYMGVMGTGSAAAASPWACFSSSNTMAAAAARAPTVTRAPETLPLFPTGGDDSQPRRPRHGVPVPVAAGEAIRGGSSSSRYLPFWGAAPTTASATSIGIQQQHQLLQLQEQYSFYSNAMPGTGSQDASAASLELSLSSWCSPYPAGTM

SEQ ID NO: 18572 - DNA, 1386 bp, Sorghum bicolor
  misc_feature: Ceres ANNOT ID no. 8703413
  misc_feature: Encodes the peptide sequence at SEQ ID NO 18573
atgatgaacgccaagaagattaagctgcacgactaccaccgctacggatcgccgctgtgtgacccgcagctgtttccggccaccgccgcggcggggctccccttccacccggctccggggctcgtgggctccctgccgcagccgcatggcggcggctgggttcacgaggagcacaccacgacgactccgaggtccgtgctcgcgacgcaggggctgcaggggggcagctgcgtcggctccgacgccgccgcgttcttcgccgccgaggagctgatgatgggcatgccgcggttcgactgccctctcggcgggacgccgccgccgctcccggacctgacagcttttgccaagagaccgccgtttggccggccgacgacggaggccgagcagctgtaccaccgtcgtccagtcgacccgctgccgatccgcgacggctcggtgaggacgtactacgtccagccgcagcagcgcgacggcgccacagaggcgcctccttcactcgagctgccattccagcggcgtcagcagcagcagcagcagcaacaacaagaacgagtgcatgggttgttcggcaacgcttccgccggcaggctgctcggcggcaccggcggcgaacctaaagcacactcctttccagctcatgttgcgccgagcacgcttctcccagtgatggaggcgccggcggtcatgcagcagagccctatggagaacctgctgtccaggagctgcagcatcatcggtgcggcggcgacccacgtcgggagcggaaacgccgtcgccgccgccgccgctgcgccggggcaaggcgcgccgagcaagacgcggatccggtggacgcaggatctccacgagcgcttcgtcgactgcgtgaaccagctcggcggcgcggacaaggcgactcccaaggggattctgaagctgatgaactctgatggactcacaatctaccacatcaagagccaccttcagaaataccgcattgccaagtacatgccagcatcgacgtctgaagggaaacaggagaaaagagccgccggaaatgacgtgcagaatctcgaccccactgggatgaagatcactgaagcactacgcttccagctcgacgtgcagatgcgcctccacgagcagctcgagatccagaggaacctgcagctgaggatcgaggagcaggggaagaagctgcagaagatgctcgaggagcagatgaaggtgagcaggaccgtgatggagccgcagcagggcgccgccgccgccgccgccgccgccttcctcggcgtcggcgagagggatgaggaggaagtggaggacgcgttcgacgacgtgcaggagcagctgctggcggccatggccagcagcgacgccgggttccagtcgaagataagctag

SEQ ID NO: 18573 - protein, 461 aa, Sorghum bicolor
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
  misc_feature: Ceres ANNOT ID no. 8703413
  misc_feature (275)..(326): Pfam ID: Myb_DNA-binding Pfam Description: Myb-like DNA-binding domain
MMNAKKIKLHDYHRYGSPLCDPQLFPATAAAGLPFHPAPGLVGSLPQPHGGGWVHEEHTTTTPRSVLATQGLQGGSCVGSDAAAFFAAEELMMGMPRFDCPLGGTPPPLPDLTAFAKRPPFGRPTTEAEQLYHRRPVDPLPIRDGSVRTYYVQPQQRDGATEAPPSLELPFQRRQQQQQQQQQERVHGLFGNASAGRLLGGTGGEPKAHSFPAHVAPSTLLPVMEAPAVMQQSPMENLLSRSCSIIGAAATHVGSGNAVAAAAAAPGQGAPSKTRIRWTQDLHERFVDCVNQLGGADKATPKGILKLMNSDGLTIYHIKSHLQKYRIAKYMPASTSEGKQEKRAAGNDVQNLDPTGMKITEALRFQLDVQMRLHEQLEIQRNLQLRIEEQGKKLQKMLEEQMKVSRTVMEPQQGAAAAAAAAFLGVGERDEEEVEDAFDDVQEQLLAAMASSDAGFQSKIS

SEQ ID NO: 18574 - DNA, 921 bp, Sorghum bicolor
  misc_feature: Ceres ANNOT ID no. 8703417
  misc_feature: Encodes the peptide sequence at SEQ ID NO 18575
atggagggagcaggcgcggcccggaagaggtcccggccggagtcggcgaacgggtatgccgccggcgggaagcgctccaaagacacggagtcatttcaaactggtcaatcaagcaaatcgaagccttgcaccaagtttttcagtaccattgggtgcccatttggtgagggatgccattttctgcactttgtccccggtggttacccagcagttgcaaaaatgctcaatctaggtagccctgctgtatctgcgccatcaagaactcatgtggatcatgccgctcttactggcgcctctcatcaagcttcgatgggcaagacacgcatgtgcaccaagtacaatacgacggaaggctgcaaatttggtgataagtgccactttgctcatagcgaaagagagcttgggaagccagcctacatgtctcatgaaggacctcctatgggtggtcgatatggaggccgacctgaacctctgcaacaagcttccatgggtcctccagcaggaaactttggtgcttcggcgactgccaagatcagtgtggatgcctctcttgccggtggcataatcggtaagggtggggtcaacactaagcagataagcagagttacaggcgtcaagctctccatccgcgaccacgagtctaaccccagccagaagaacattgagcttgaaggcaattttgaccagatcaagcaagccagtgacatggtgagggacctcattgcgaccatcagcgcaagcatgccggcaaaaaacctatctgcttccgctgctccagcaggaggccgaggcggtggtcttgggggcaggagcaactacaagacgaagctgtgcgagaacttcgtgaagggtgcctgcactttcggcgaccggtgccactttgcccatggcgagaccgagcagcggagaggtgctgcttga

SEQ ID NO: 18575 - protein, 306 aa, Sorghum bicolor
  misc_feature: Useful for making plants with altered alkaloid content
  misc_feature: Functional homolog of the protein sequence given in SEQ ID NO 13274
  misc_feature: Ceres ANNOT ID no. 8703417
  misc_feature (105)..(131): Pfam ID: zf-CCCH Pfam Description: Zinc finger C-x8-C-x5-C-x3-H type (and similar)
  misc_feature (273)..(298): Pfam ID: zf-CCCH Pfam Description: Zinc finger C-x8-C-x5-C-x3-H type (and similar)
  misc_feature (175)..(237): Pfam ID: KH_1 Pfam Description: KH domain
MEGAGAARKRSRPESANGYAAGGKRSKDTESFQTGQSSKSKPCTKFFSTIGCPFGEGCHFLHFVPGGYPAVAKMLNLGSPAVSAPSRTHVDHAALTGASHQASMGKTRMCTKYNTTEGCKFGDKCHFAHSERELGKPAYMSHEGPPMGGRYGGRPEPLQQASMGPPAGNFGASATAKISVDASLAGGIIGKGGVNTKQISRVTGVKLSIRDHESNPSQKNIELEGNFDQIKQASDMVRDLIATISASMPAKNLSASAAPAGGRGGGLGGRSNYKTKLCENFVKGACTFGDRCHFAHGETEQRRGAA

SEQ ID NO: 18576 - DNA, 1878 bp, Sorghum bicolor
  misc_feature: Ceres ANNOT ID no. 8703451
  misc_feature: Encodes the peptide sequence at SEQ ID NO 18577
atgtcccccaacctggacagcgccatcaagagccaggtgccggcgctgctcctgaggcgtctcttcggagcgtcccggcgggacgaggccaagcagctccagcggaccccggcgccggcgccggtggggaggcggcgggtgttcgtgcagacggagacaggctgcgtgcttggcatggacctggaccgcggggacaacgcgcacaccgtcaagcgccggctgcagctcgcgctcaacgtgcccaccggcgagacctcgctcaccttcggcgatcgcatcctggagaacgacctctccttcatacgcccggactcgccgctgctgctcacccggaacagcatcaaccggagctgctccaccccgtgcctctgccccgtctccaaggacttcgagcacaaggactgcagcggcctggttgagatgctcggctgctccagcagctgcgcccgggtgaagcgcctcgtcgacgacgtggtgactgccatcaggagcggcgtggatccggtctccatcagcagcggccttggtggctcatactacttcaggaacgtcttgggcgacagggttgctattgtgaagccgacggacgaggagccctttgcgccaaacaatcccaaggggttcgtcgggagggcgcttggtcagccgggcctgaagaaatctgtgcgagtgggagagacagggtttagggaggttgctgcgttcctgttggaccatgataactttgccaatgtccctgccacagctctggtgaagataacacactccattttcaacataaattgtccggtaaatggaggaaatctggcaccggctcatgaccagcaacagcaagttaacagcaagattgcttcgttccagcagttcatcgcccatgactttgacgccagcgaccatggcacttcaagcttccctgttgctgctgttcataggatcggcatactcgatatccggattttcaacactgacaggcatgccggcaatgtgctggtgaggaagcttaatggtggcacaggtcgctttggttgccagacagagctgttcccaattgatcatggcatgtgcttgccggagaacttggaggacccttacttcgagtggattcattgggctcaggcgtccattccgttctctgaggaggaactcgagtacatcaggaatcttgatccaacgaaagatgtgcagatgctgcgcagagaacttccaatgatacgtgaggcctgccttcgtgtcctggtcctgtgcacgatcttccttaaggaggctgcagctttcggactctgcttggcagagataggtgagatgatgacaagggagttcagagggatggaggaggaaccaagccagctggaggttgtgtgtatggaggccaggaagagagtagcagagtgggagcccttctctgccacagctgaacatggagaagatactgatttccaattctccatggatgtgttaggagaatacaatgatgtaatgcgatcaccaaggttcagcggcccgggttccaaggggtccagtttcagaagccctttgtctaagctcatcgagagcgttgacgagggcagtgatggccatgaagatcaaatcgagtctgatcgagtcttctatgctggatggaatacacccaacaatcctagcagcagcaaacctataggtcagaatggcattgcttcaaaaagtgccatgaacaggagtgctgatgaacaacttccatcaagtatgtgttttgtcaggctgtcggatatgagtgcagatgagtgggatgtattccttgaaaaattcaaggaactgctgaaagaggcactacacgagagcgcaaggacagcagcaggtcaaaggatgaagcagcgcctgggcacttcatgcaagttttga

SEQ ID NO: 18577 - protein, 625 aa, Sorghum bicolor
  misc_feature: Useful for making plants with altered protein content
  misc_feature: Functional homolog of the protein sequence given in SEQ ID NO 13479
  misc_feature: Ceres ANNOT ID no. 8703451
  misc_feature (161)..(261): SWISSPROT Homolog: EC 2.7.1.67 1-phosphatidylinositol 4-kinase
  misc_feature (174)..(439): Pfam ID: PI3_PI4_kinase Pfam Description: Phosphatidylinositol 3- and 4-kinase
MSPNLDSAIKSQVPALLLRRLFGASRRDEAKQLQRTPAPAPVGRRRVFVQTETGCVLGMDLDRGDNAHTVKRRLQLALNVPTGETSLTFGDRILENDLSFIRPDSPLLLTRNSINRSCSTPCLCPVSKDFEHKDCSGLVEMLGCSSSCARVKRLVDDVVTAIRSGVDPVSISSGLGGSYYFRNVLGDRVAIVKPTDEEPFAPNNPKGFVGRALGQPGLKKSVRVGETGFREVAAFLLDHDNFANVPATALVKITHSIFNINCPVNGGNLAPAHDQQQQVNSKIASFQQFIAHDFDASDHGTSSFPVAAVHRIGILDIRIFNTDRHAGNVLVRKLNGGTGRFGCQTELFPIDHGMCLPENLEDPYFEWIHWAQASIPFSEEELEYIRNLDPTKDVQMLRRELPMIREACLRVLVLCTIFLKEAAAFGLCLAEIGEMMTREFRGMEEEPSQLEVVCMEARKRVAEWEPFSATAEHGEDTDFQFSMDVLGEYNDVMRSPRFSGPGSKGSSFRSPLSKLIESVDEGSDGHEDQIESDRVFYAGWNTPNNPSSSKPIGQNGIASKSAMNRSADEQLPSSMCFVRLSDMSADEWDVFLEKFKELLKEALHESARTAAGQRMKQRLGTSCKF

SEQ ID NO: 18578 - DNA, 459 bp, Sorghum bicolor
  misc_feature: Ceres ANNOT ID no. 8703473
  misc_feature: Encodes the peptide sequence at SEQ ID NO 18579
atgaagtttattgctgcctacctgcttgctgtcctcggtgggaacctcagcccctctgctgaggacttggcagccattctggagtcagttggctgtgaagttgacaatgaaaagatggaactcctgttgtcccaactgagcggtaaggacattaccgagctcattgctgcaggcagggagaagtttgcttcagtcccatgtggcggtggcggcgtggctgtcgcggcagctgcgcctgctgctggcggagctgctcctgcagctgaggcgaagaaagaagagaaggtggaagagaaggaagaaagtgatgatgtaagatcattgttctcccattctggctgcagcaaatatttttcctatcagagcagcagtcctatgctactctgttctgatataatcttcatgagcaaaataccactatcaaagctctattgccatctcgcttgcattccatcttga

SEQ ID NO: 18579 - protein, 152 aa, Sorghum bicolor
  misc_feature: Useful for making plants with altered oil content
  misc_feature: Useful for making plants with modulated biomass
  misc_feature: Functional homolog of the protein sequence given in SEQ ID NO 13447
  misc_feature: Ceres ANNOT ID no. 8703473
  misc_feature (17)..(109): Pfam ID: Ribosomal_60s Pfam Description: 60s Acidic ribosomal protein
MKFIAAYLLAVLGGNLSPSAEDLAAILESVGCEVDNEKMELLLSQLSGKDITELIAAGREKFASVPCGGGGVAVAAAAPAAGGAAPAAEAKKEEKVEEKEESDDVRSLFSHSGCSKYFSYQSSSPMLLCSDIIFMSKIPLSKLYCHLACIPS

SEQ ID NO: 18580 - DNA, 2163 bp, Sorghum bicolor
  misc_feature: Ceres ANNOT ID no. 8703540
  misc_feature: Encodes the peptide sequence at SEQ ID NO 18581
atggcgacctctgcgctggactccctcccggcgccgctccggtcgctgcggctcaagacgaagcagcaggagctcctgctccgcgtctcggcgctggcgctcatctacgtgctcgccttcgccgtccgcctcttctccgtcctccgctacgagtccatgatccacgagttcgacccctacttcaactaccgcaccacgctcttcctcaccgagaacggcttcagcgagttctggaactggttcgactccgagagctggtacccgctcggccgcgtcgtcgggggcacgctcttcccgggtctcatggtgaccgccgcactgctccaccgcctcctccgcgcgctctccctcgccgtccacatccgcgaggtctgcgtactcacggcgcccttcttcgccgccaacaccacgctcgtcgcctacgccttcggccgcgagatctgggactccggggcggggctcgtcgccgccgcgctcatcgccatcgttcctggctacatctcccgctccgttgcggggtcctacgataacgagggcgtcgccatcttcgccctgctgctcaccttctacctcttcgtgcgcgccgtcaacacggggtcgctcgcctgggcgcttgcctcggcgttcggctacttctacatggtgtcggcgtggggaggctacgtgttcatcatcaatctaatcccactctacgtgcttgtgctgcttgtcactgggaggtattcgcagaggctctacgtggcctacaattgcatgtatgtgcttgggatgttgcttgcgatgcagatccgttttgttggattccagcatgtgcagtccggggagcacatggctgctatgggagtcttcttcctcttgcaggttttcttcttcttggactgggtgaaatacctgctaaatgatgccagactattcaagtcattccttcgaactactcttacatgtgtgattactgttggcaccctggctcttggaattggtactgcatcaggttacatctccccttggacaggacggttttactccctgcttgatcctacctatgcaaaggaccatataccaatcattgcgtctgtttctgagcatcagccaacagcatggtcatctttcatgtttgacttccacatcctccttttcctgttcccagctggcctttatttctgtttcaaacgcctgtcagatgccactatattcattgttatgtatggcctcacgagtatgtactttgctggtgtgatggtccggttaattcttgtggcagcaccagccgtttgtcttattagtgctattgctgcatctgctacaataaagaatctgaccactttgatccgggcaaagagcagaagtccacagactacttctggaaaaacaactggctcaaaggcagctgcaaagggtgcagttgatcaaagtttaccattccaacacaatgcagctattgctcttcttctgggtgccttttacttgctaagtaggtatgccatacactgcacttgggtgacatctgaggcttattcttctccatctatagttttggccgcaaggggtcataatggtggaagagtcatctttgatgattatcgtgaggcatactattggcttcgtcagaacactcctcctgatgctaagattatgtcttggtgggactatggataccaaattacagctatgggtaacagaactgtcattgttgataataatacatggaataacacacacatagctacagttggacgtgctatgtcatcttatgaagatgaagcatatgagatcatgcaatcacttgatgtgaactacgtgcttgttgtatttggaggtgttaccggatattcttcagatgatatcaacaagttcttatggatggtacgcattggtggaggagttttccctgtaatcaaagagccagattaccttgttaatggggagtatcgtattgacaagggggcagcaccaaaaatgctgaactgcctaatgtacaagctttgttactaccgatttggagaacttaccacggaatatggaaagcctccagggtatgatcgtgtaagaggagtggagattggcaacaaagacataaaacttgaatacttggaggaggcatttacaacttcaaactggatagtgcgcatatacaaggtgaaacccccaaagaacaggtcctga

SEQ ID NO: 18581 - protein, 720 aa, Sorghum bicolor
  misc_feature: Useful for making plants with altered carbohydrate content
  misc_feature: Functional homolog of the protein sequence given in SEQ ID NO 13872
  misc_feature: Ceres ANNOT ID no. 8703540
  misc_feature: Down-regulated in shoot tissues in response to salicylic acid treatment
  misc_feature (16)..(719): SWISSPROT Homolog: EC 2.4.1.119 Dolichyl-diphosphooligosaccharide--protein glycotransferase
  misc_feature (26)..(671): Pfam ID: STT3 Pfam Description: Oligosaccharyl transferase STT3 subunit
MATSALDSLPAPLRSLRLKTKQQELLLRVSALALIYVLAFAVRLFSVLRYESMIHEFDPYFNYRTTLFLTENGFSEFWNWFDSESWYPLGRVVGGTLFPGLMVTAALLHRLLRALSLAVHIREVCVLTAPFFAANTTLVAYAFGREIWDSGAGLVAAALIAIVPGYISRSVAGSYDNEGVAIFALLLTFYLFVRAVNTGSLAWALASAFGYFYMVSAWGGYVFIINLIPLYVLVLLVTGRYSQRLYVAYNCMYVLGMLLAMQIRFVGFQHVQSGEHMAAMGVFFLLQVFFFLDWVKYLLNDARLFKSFLRTTLTCVITVGTLALGIGTASGYISPWTGRFYSLLDPTYAKDHIPIIASVSEHQPTAWSSFMFDFHILLFLFPAGLYFCFKRLSDATIFIVMYGLTSMYFAGVMVRLILVAAPAVCLISAIAASATIKNLTTLIRAKSRSPQTTSGKTTGSKAAAKGAVDQSLPFQHNAAIALLLGAFYLLSRYAIHCTWVTSEAYSSPSIVLAARGHNGGRVIFDDYREAYYWLRQNTPPDAKIMSWWDYGYQITAMGNRTVIVDNNTWNNTHIATVGRAMSSYEDEAYEIMQSLDVNYVLVVFGGVTGYSSDDINKFLWMVRIGGGVFPVIKEPDYLVNGEYRIDKGAAPKMLNCLMYKLCYYRFGELTTEYGKPPGYDRVRGVEIGNKDIKLEYLEEAFTTSNWIVRIYKVKPPKNRS

SEQ ID NO: 18582 - DNA, 909 bp, Sorghum bicolor
  misc_feature: Ceres ANNOT ID no. 8703551
  misc_feature: Down-regulated in shoot tissues in response to salicylic acid treatment
  misc_feature: Encodes the peptide sequence at SEQ ID NO 18583
atggccgtggaggaggcgagcagcagcggcggtggcggcgaggaggggtgcggggcgtggacccgcgagcaggagaaggcgttcgagaacgcggtggcgacgacgatgggcggcgaggaggacggggacgcgaggtgggagaagctagcggaggccgtcgaggggaagacgccggaggaggtcaggcggcactacgagctgctggtggaggacgtcgacggcatcgagtcgggccgcgtgccgcttccgacgtacgcggctgacggcgccgccgaggaagggggtggcggcggcggcggcgggaagaagggaggtgggggaggagggacccacggggacaaggggtcggcgaagtcggccgagcaggagcgcaggaagggcatcgcctggacagaggacgagcacagattgttcctccttggacttgaaaagtatggcaaaggtgactggcggagcatctcacgtaactttgtgatctcaaggactccaactcaagtagctagtcatgcacagaagtactttatccgtctgaactcaatgaacagagagaggcggcgatcaagtatacatgacatcaccagtgtgaacaatggagatgcatcaacggcacagggtccaatcacaggtcaaacaaatggtcaggctgcaaatcctgggaaaccatctaagcaatccccacagccagcgaatacacctccaggcgtcgatgcttatggcacaacaattggacagccagttggtggccctcttgtctcagctgttggaactcctgttacactacctgtttctgctccacctcatctggcctatggcatgcatgccccggttccaggagccgtagtacctggtgctccagtaaacattgctccgatgccctatccaatgccacccccatcatctcatgggtga

SEQ ID NO: 18583 - protein, 302 aa, Sorghum bicolor
  misc_feature: The sequence is a functional homolog of SEQ ID NO 36 in the 10/286,264 US patent application
  misc_feature: The sequence is a functional homolog of SEQ ID NO 864 in the 10/412,699 US patent application
  misc_feature: Useful for making plants with modulated nitrogen use efficiency
  misc_feature: Functional homolog of the protein sequence given in SEQ ID NO 14651
  misc_feature: The sequence is a functional homolog of SEQ ID NO 1973 in the 11/479,226 US patent application
  misc_feature: The sequence is a functional homolog of SEQ ID NO 880 in the 11/435,388 US patent application
  misc_feature: Useful for making plants with altered lignin content
  misc_feature: Useful for making plants with modulated low light sensitivity
  misc_feature: Functional homolog of the protein sequence given in SEQ ID NO 12938
  misc_feature: The sequence is a functional homolog of SEQ ID NO 976 in the 11/435,388 US patent application
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
  misc_feature: The sequence is a functional homolog of SEQ ID NO 1404 in the 11/479,226 US patent application
  misc_feature: The sequence is a functional homolog of SEQ ID NO 662 in the 10/412,699 US patent application
  misc_feature: The sequence is a functional homolog of SEQ ID NO 944 in the 11/435,388 US patent application
  misc_feature: Ceres ANNOT ID no. 8703551
  misc_feature (127)..(174): Pfam ID: Myb_DNA-binding Pfam Description: Myb-like DNA-binding domain
  misc_feature (17)..(69): Pfam ID: Myb_DNA-binding Pfam Description: Myb-like DNA-binding domain
MAVEEASSSGGGGEEGCGAWTREQEKAFENAVATTMGGEEDGDARWEKLAEAVEGKTPEEVRRHYELLVEDVDGIESGRVPLPTYAADGAAEEGGGGGGGGKKGGGGGGTHGDKGSAKSAEQERRKGIAWTEDEHRLFLLGLEKYGKGDWRSISRNFVISRTPTQVASHAQKYFIRLNSMNRERRRSSIHDITSVNNGDASTAQGPITGQTNGQAANPGKPSKQSPQPANTPPGVDAYGTTIGQPVGGPLVSAVGTPVTLPVSAPPHLAYGMHAPVPGAVVPGAPVNIAPMPYPMPPPSSHG

SEQ ID NO: 18584 - DNA, 1158 bp, Sorghum bicolor
  misc_feature: Ceres ANNOT ID no. 8703553
  misc_feature: Encodes the peptide sequence at SEQ ID NO 18585
atgatctccccctcctcctcctgctcctgcgacgccttcctttctcgaagcccccaatttattcccttccccgtaatcccgcacgcatccttgccgaagccaaattggcactcctcttatctcgccgcgccgccaccgctccatttccgctctcccccaaaacctcgaaaccctactcgcgggattccgcggggccgccgcttgcttagggttcatccaccccgcggcgtcagctccgggtccgcatccatggccgtggaggaggcgagcagcagcggcggtggcggcgaggaggggtgcggggcgtggacccgcgagcaggagaaggcgttcgagaacgcggtggcgacgacgatgggcggcgaggaggacggggacgcgaggtgggagaagctagcggaggccgtcgaggggaagacgccggaggaggtcaggcggcactacgagctgctggtggaggacgtcgacggcatcgagtcgggccgcgtgccgcttccgacgtacgcggctgacggcgccgccgaggaagggggtggcggcggcggcggcgggaagaagggaggtgggggaggagggacccacggggacaaggggtcggcgaagtcggccgagcaggagcgcaggaagggcatcgcctggacagaggacgagcacagattgttcctccttggacttgaaaagtatggcaaaggtgactggcggagcatctcacgtaactttgtgatctcaaggactccaactcaagtagctagtcatgcacagaagtactttatccgtctgaactcaatgaacagagagaggcggcgatcaagtatacatgacatcaccagtgtgaacaatggagatgcatcaacggcacagggtccaatcacaggtcaaacaaatggtcaggctgcaaatcctgggaaaccatctaagcaatccccacagccagcgaatacacctccaggcgtcgatgcttatggcacaacaattggacagccagttggtggccctcttgtctcagctgttggaactcctgttacactacctgtttctgctccacctcatctggcctatggcatgcatgccccggttccaggagccgtagtacctggtgctccagtaaacattgctccgatgccctatccaatgccacccccatcatctcatgggtga

SEQ ID NO: 18585 - protein, 385 aa, Sorghum bicolor
  misc_feature: The sequence is a functional homolog of SEQ ID NO 36 in the 10/286,264 US patent application
  misc_feature: The sequence is a functional homolog of SEQ ID NO 864 in the 10/412,699 US patent application
  misc_feature: Useful for making plants with modulated nitrogen use efficiency
  misc_feature: Functional homolog of the protein sequence given in SEQ ID NO 14651
  misc_feature: The sequence is a functional homolog of SEQ ID NO 1973 in the 11/479,226 US patent application
  misc_feature: The sequence is a functional homolog of SEQ ID NO 880 in the 11/435,388 US patent application
  misc_feature: Useful for making plants with altered lignin content
  misc_feature: Useful for making plants with modulated low light sensitivity
  misc_feature: Functional homolog of the protein sequence given in SEQ ID NO 12938
  misc_feature: The sequence is a functional homolog of SEQ ID NO 976 in the 11/435,388 US patent application
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
  misc_feature: The sequence is a functional homolog of SEQ ID NO 1404 in the 11/479,226 US patent application
  misc_feature: The sequence is a functional homolog of SEQ ID NO 662 in the 10/412,699 US patent application
  misc_feature: The sequence is a functional homolog of SEQ ID NO 944 in the 11/435,388 US patent application
  misc_feature: Ceres ANNOT ID no. 8703553
  misc_feature (210)..(257): Pfam ID: Myb_DNA-binding Pfam Description: Myb-like DNA-binding domain
  misc_feature (100)..(152): Pfam ID: Myb_DNA-binding Pfam Description: Myb-like DNA-binding domain
MISPSSSCSCDAFLSRSPQFIPFPVIPHASLPKPNWHSSYLAAPPPLHFRSPPKPRNPTRGIPRGRRLLRVHPPRGVSSGSASMAVEEASSSGGGGEEGCGAWTREQEKAFENAVATTMGGEEDGDARWEKLAEAVEGKTPEEVRRHYELLVEDVDGIESGRVPLPTYAADGAAEEGGGGGGGGKKGGGGGGTHGDKGSAKSAEQERRKGIAWTEDEHRLFLLGLEKYGKGDWRSISRNFVISRTPTQVASHAQKYFIRLNSMNRERRRSSIHDITSVNNGDASTAQGPITGQTNGQAANPGKPSKQSPQPANTPPGVDAYGTTIGQPVGGPLVSAVGTPVTLPVSAPPHLAYGMHAPVPGAVVPGAPVNIAPMPYPMPPPSSHG

SEQ ID NO: 18586 - DNA, 747 bp, Sorghum bicolor
  misc_feature: Ceres ANNOT ID no. 8703586
  misc_feature: Encodes the peptide sequence at SEQ ID NO 18587
atggtcgtctgctccatgcgcaagtcgttcaaggactcgctcaaggtgctcgaggccgacatccagcacgcaaacaccctggcagcggatttctccagggactacgacggggcctgcctccagatgcgcatgtcctacagccccgccgcccacttcttcctcttcctcgtgcagtggaccgactgcagcctcgccggcgcgcttgggctgctcaggatcctaatctacaaggtttatgtggatgggagtaccaccatgtccacgcacgagaggaaagcaagcatcagggaattttatgctgtcatatttccatcccttatgcaactgcccaaggggatcagcgacgttgatgaccgaaggcagaaggcggtgtgcaccgagagataccggaggagagatgaggacgagggcaagaggccagtttcagagatagacatcgaaagggaggaagagtgtggcatttgcatggagatgaatagcaaggtggtgctacccagctgcagtcatgctatgtgcatgaagtgctaccgtcaatggcgatcaagatctcaatcctgtcccttctgtcgggacagcctcaaaagagtaaactccggcgacctgtggatgttcaccgattgccgggacatagttgacatggcgacagtgaccagagagaacatcaggcgcctgtttatgtacatcgagaagctgcctctcgttacgccggataacatcttctatgcctatgattctcatgtaaaatag

SEQ ID NO: 18587 - protein, 248 aa, Sorghum bicolor
  misc_feature: Useful for making plants with altered lignin content
  misc_feature: Functional homolog of the protein sequence given in SEQ ID NO 13283
  misc_feature: Ceres ANNOT ID no. 8703586
  misc_feature (152)..(189): Pfam ID: zf-C3HC4 Pfam Description: Zinc finger, C3HC4 type (RING finger)
MVVCSMRKSFKDSLKVLEADIQHANTLAADFSRDYDGACLQMRMSYSPAAHFFLFLVQWTDCSLAGALGLLRILIYKVYVDGSTTMSTHERKASIREFYAVIFPSLMQLPKGISDVDDRRQKAVCTERYRRRDEDEGKRPVSEIDIEREEECGICMEMNSKVVLPSCSHAMCMKCYRQWRSRSQSCPFCRDSLKRVNSGDLWMFTDCRDIVDMATVTRENIRRLFMYIEKLPLVTPDNIFYAYDSHVK

SEQ ID NO: 18588 - DNA, 1428 bp, Sorghum bicolor
  misc_feature: Ceres ANNOT ID no. 8703604
  misc_feature: Encodes the peptide sequence at SEQ ID NO 18589
atgacacgctgcaccgtcttgctccagatcctcctcccaacgctgctcttggtttctgccatcacattcacaggcgcggacgccggcggcatcggcgtcaactacggcacgcggggcacgacgctcccggcgccaaccgacgtggcgcggttcctggcccgggacaccatcgtggaccgcgtcaggctgttggacgccgacccggtcctgctgcaggccttcgccggcaccggcctcgccgtggacgtgacggttcccaacggcgtggtcccgcgcctggtgagcctggccttcgcgcggcgctgggtgcgcgacaacgtggcgccgtacgcgggcgccaccaacatctcgcggctcctggtcggcgacgaggtgaccaccgaggccaaccggacgctgctgctggcgctggtgccggccatgcagaacctgcacaccgcgctggtcgccgcgtccctgcacggccgggtcaaggtctccaccacgcactcgctcggggtgctcaccaccacggagcagccgtcgtcggcgcggttccgcgacggctacgacacggccatcgtgaggccgatgctcaggttcctccgcgcgacgggcgcgccgttcatggtgaacgcgtacccgttctacgggctcaccaacgacaccattagcctcgacttcgcgctgttccgggtgaacgacggtgtcatggaccggggatccgggctggtgtacggcaacatgctggacgcgcagctcgacgccgtgcactcggcggtcaggcggctgggcttcggggacgtcgacatcgtcgtgtcggagaccgggtggccgtcggccggggaggactgggaggtcggcgtcggcgccgacctcgcccgggagtacaacaagaacgccatccggcacctcggctccggcgtcggcacgccgctcatgcccaaccgcaccttcgaggtctccatcttctccctcttcgacgagaacctcaagcccggcccggtgtcggagaggaacttcggcctgttccgcggcgacatgacgccggtctacgacgtcggcatctttacagatccggagacccttgagccggtgagcgcgaaggtgacgcccgcgccgagctcgccgggagcggcgggtggacggcggcagtggtgcgtgccgaaaccggcggcggacgagatggtgctgcaggagaacatcgacttcgcgtgcggccaagagggcgtcgactgtgccgcgatccggccaggcggcgtctgctacgagccggacacggtgcagggccatgcggcgtacgccatgaacctctacttccagtccaacggccaccatgcctatgactgtgactttggacagaccggcgtcgttaccactgctgatcccaatccgttaatggtcttcagaattattttttttcactttgttagtataagaactttttag

SEQ ID NO: 18589 - protein, 475 aa, Sorghum bicolor
  misc_feature: Useful for making plants with altered cell wall content and/or composition
  misc_feature: Functional homolog of the protein sequence given in SEQ ID NO 14652
  misc_feature: Ceres ANNOT ID no. 8703604
  misc_feature (31)..(457): SWISSPROT Homolog: EC 3.2.1.39 Glucan endo-1,3-beta-D-glucosidase
  misc_feature (31)..(349): Pfam ID: Glyco_hydro_17 Pfam Description: Glycosyl hydrolases family 17
  misc_feature (378)..(462): Pfam ID: X8 Pfam Description: X8 domain
MTRCTVLLQILLPTLLLVSAITFTGADAGGIGVNYGTRGTTLPAPTDVARFLARDTIVDRVRLLDADPVLLQAFAGTGLAVDVTVPNGVVPRLVSLAFARRWVRDNVAPYAGATNISRLLVGDEVTTEANRTLLLALVPAMQNLHTALVAASLHGRVKVSTTHSLGVLTTTEQPSSARFRDGYDTAIVRPMLRFLRATGAPFMVNAYPFYGLTNDTISLDFALFRVNDGVMDRGSGLVYGNMLDAQLDAVHSAVRRLGFGDVDIVVSETGWPSAGEDWEVGVGADLAREYNKNAIRHLGSGVGTPLMPNRTFEVSIFSLFDENLKPGPVSERNFGLFRGDMTPVYDVGIFTDPETLEPVSAKVTPAPSSPGAAGGRRQWCVPKPAADEMVLQENIDFACGQEGVDCAAIRPGGVCYEPDTVQGHAAYAMNLYFQSNGHHAYDCDFGQTGVVTTADPNPLMVFRIIFFHFVSIRTF

SEQ ID NO: 18590 - DNA, 366 bp, Sorghum bicolor
  misc_feature: Ceres ANNOT ID no. 8703590
  misc_feature: Encodes the peptide sequence at SEQ ID NO 18591
atgttctccggcgactggacgccgccgtgcggcagctgctgcaccaagaagtacgcgagcctcgtgcagatcccatggagggtgttctgcaagaaggggtgcaacgcggacggcgacacctgggacgagtgcataggaaaatgtactgaaatatgctacaaagatccggtgttagaagatcgccagtggagcgcctatattgatcgatctccagggcaggatagttactctttgtttgatgtcccaacggagaaggtcgaagagatcaagcccaataggccgtccaagccgccagctcctgaacctgatgtgaaacgaactaagagtccagattgtactgaagatgtgccatgcacatcggcctag

SEQ ID NO: 18591 - protein, 121 aa, Sorghum bicolor
  misc_feature: Useful for making plants with modulated nitrogen use efficiency
  misc_feature: Functional homolog of the protein sequence given in SEQ ID NO 14299
  misc_feature: Ceres ANNOT ID no. 8703590
MFSGDWTPPCGSCCTKKYASLVQIPWRVFCKKGCNADGDTWDECIGKCTEICYKDPVLEDRQWSAYIDRSPGQDSYSLFDVPTEKVEEIKPNRPSKPPAPEPDVKRTKSPDCTEDVPCTSA

SEQ ID NO: 18592 - DNA, 1005 bp, Sorghum bicolor
  misc_feature: Ceres ANNOT ID no. 8703602
  misc_feature: Encodes the peptide sequence at SEQ ID NO 18593
atggccggggactggcaggagctgggccaagcggcggccatcggcctcctcttcgcctacctggtcgccaagctcatctccaccgtgatcgccttcaaggaggacaacctccgcatcacgcgctcccctccgtcctcccccaccgcagcagcccccgccccggccaccccgttccccgcggagcctcgcctcccctcccacgacggctccaccgacggcggaagcgccagcgacagtgactgggagggcgtggagagcaccgagctcgacgaagagttcagcgccgcctccgccttcgtcgcggcctccgccgcctccggcaccagcgtccccgaggaggcgcagctgcgcctctacggcctctacaagatcgccaccgaggggccctgcaccgcgccgcagccatccgcgctcaagctcaaggcccgtgccaaatggaatgcttggcataagctgggtgctatgcctacagaagaagctatgcaagagtacatcacaattgttcaggagctattccctaactgggatgcaggtgcaagtgcgaaaaggaaagatgaagataacatggcttctgcatcagcttcgaaggggcccatgggacctgtgtttagcagtttgatgtatgaggaagatgaaggaaatgattcagaacttggtgacatccatgtttcggcgagggaaggagcaactgaagacatagtgaagtttctggcagctggtgtggaagtcaacgtgagagatactgaaggtagaactccgttgcattgggctgttgatcgtggccatctaagtgctgttgaggttcttgctaaagcaaatgcagatttgaatgctaaggacaatgaagggcaaacagcactccactatgctgccgtttgtgaaagagaagacattgcagaattgctcgtcaagcatcatgctgatcttcagatcaaggatgaggatgggaacacagcacaggacttgtgcccttcgagctggtcttttatgaaccaggcaaactga

SEQ ID NO: 18593 - protein, 334 aa, Sorghum bicolor
  misc_feature: The sequence is a functional homolog of SEQ ID NO 1840 in the 10/374,780 US patent application
  misc_feature: The sequence is a functional homolog of SEQ ID NO 1846 in the 10/374,780 US patent application
  misc_feature: Ceres ANNOT ID no. 8703602
  misc_feature (113)..(182): SWISSPROT Homolog: EC 5.3.3.8 Dodecenoyl-CoA isomerase
  misc_feature (212)..(322): SWISSPROT Homolog: EC 2.7.11.1 Non-specific serine/threonine protein kinase
  misc_feature (249)..(281): Pfam ID: Ank Pfam Description: Ankyrin repeat
  misc_feature (282)..(314): Pfam ID: Ank Pfam Description: Ankyrin repeat
  misc_feature (89)..(176): Pfam ID: ACBP Pfam Description: Acyl CoA binding protein
MAGDWQELGQAAAIGLLFAYLVAKLISTVIAFKEDNLRITRSPPSSPTAAAPAPATPFPAEPRLPSHDGSTDGGSASDSDWEGVESTELDEEFSAASAFVAASAASGTSVPEEAQLRLYGLYKIATEGPCTAPQPSALKLKARAKWNAWHKLGAMPTEEAMQEYITIVQELFPNWDAGASAKRKDEDNMASASASKGPMGPVFSSLMYEEDEGNDSELGDIHVSAREGATEDIVKFLAAGVEVNVRDTEGRTPLHWAVDRGHLSAVEVLAKANADLNAKDNEGQTALHYAAVCEREDIAELLVKHHADLQIKDEDGNTAQDLCPSSWSFMNQAN

SEQ ID NO: 18594 - DNA, 387 bp, Sorghum bicolor
  misc_feature: Ceres ANNOT ID no. 8703622
  misc_feature: Encodes the peptide sequence at SEQ ID NO 18595
atgaggcaggcgaggccgtactcggggatcttctgcggcggggtgtcggcgcggacggggccgcacgcgctgccgctggcgcgcatcaagaagatcatgaagcgctccgcgggggagaccgcggacggcggcgccaggatgatctccggcgaggcgcccgtggtgttctccaaggcgtgcgagctcttcgtcgccgagctcacgcgccgcgcctgggccgccacgctcgacggcaagcgccgcaccgtgcacagggaggacgtcgccacggccgtgcacaacaccgacctcttcgacttcctcgtcgacgtcgtcacggcggacactgccggcggcgacgacgacgtgcacgatgacgacaacgtcggcgacggcgccctggggtaa

SEQ ID NO: 18595 - protein, 128 aa, Sorghum bicolor
  misc_feature: The sequence is a functional homolog of SEQ ID NO 712 in the 11/479,226 US patent application
  misc_feature: Useful for making plants with altered lignin content
  misc_feature: Useful for making plants with altered terpenoid content
  misc_feature: Functional homolog of the protein sequence given in SEQ ID NO 13125
  misc_feature: The sequence is a functional homolog of SEQ ID NO 102 in the 10/225,068 US patent application
  misc_feature: The sequence is a functional homolog of SEQ ID NO 230 in the 10/714,887 US patent application
  misc_feature: The sequence is a functional homolog of SEQ ID NO 230 in the 11/435,388 US patent application
  misc_feature: The sequence is a functional homolog of SEQ ID NO 310 in the 10/412,699 US patent application
  misc_feature: The sequence is a functional homolog of SEQ ID NO 727 in the 11/479,226 US patent application
  misc_feature: The sequence is a functional homolog of SEQ ID NO 94 in the 10/374,780 US patent application
  misc_feature: The sequence is a functional homolog of SEQ ID NO 1190 in the 10/412,699 US patent application
  misc_feature: The sequence is a functional homolog of SEQ ID NO 837 in the 10/374,780 US patent application
  misc_feature: The sequence is a functional homolog of SEQ ID NO 1188 in the 10/412,699 US patent application
  misc_feature: The sequence is a functional homolog of SEQ ID NO 835 in the 10/374,780 US patent application
  misc_feature: The sequence is a functional homolog of SEQ ID NO 1107 in the 10/374,780 US patent application
  misc_feature: Useful for making plants with altered alkaloid content
  misc_feature: Functional homolog of the protein sequence given in SEQ ID NO 13648
  misc_feature: The sequence is a functional homolog of SEQ ID NO 1908 in the 11/479,226 US patent application
  misc_feature: The sequence is a functional homolog of SEQ ID NO 2126 in the 10/374,780 US patent application
  misc_feature: The sequence is a functional homolog of SEQ ID NO 314 in the 10/374,780 US patent application
  misc_feature: The sequence is a functional homolog of SEQ ID NO 846 in the 10/225,066 US patent application
  misc_feature: The sequence is a functional homolog of SEQ ID NO 1109 in the 10/374,780 US patent application
  misc_feature: The sequence is a functional homolog of SEQ ID NO 1108 in the 10/374,780 US patent application
  misc_feature: The sequence is a functional homolog of SEQ ID NO 1189 in the 10/412,699 US patent application
  misc_feature: The sequence is a functional homolog of SEQ ID NO 836 in the 10/374,780 US patent application
  misc_feature: Ceres ANNOT ID no. 8703622
  misc_feature (24)..(101): SWISSPROT Homolog: EC 2.7.7.7 DNA-directed DNA polymerase
  misc_feature (22)..(92): Pfam ID: CBFD_NFYB_HMF Pfam Description: Histone-like transcription factor (CBF/NF-Y) and archaeal histone
MRQARPYSGIFCGGVSARTGPHALPLARIKKIMKRSAGETADGGARMISGEAPVVFSKACELFVAELTRRAWAATLDGKRRTVHREDVATAVHNTDLFDFLVDVVTADTAGGDDDVHDDDNVGDGALG

SEQ ID NO: 18596 - DNA, 258 bp, Sorghum bicolor
  misc_feature: Ceres ANNOT ID no. 8703645
  misc_feature: Encodes the peptide sequence at SEQ ID NO 18597
atggccggcggcgggtcggcggcagagtcgccggcgagctcgtgcgtgtcgtcggacgcggaggacgaggtggtggtgcagccgcagccgaagccgatggtggtggtggggtgcccgcagtgcctcatgtacgtgatgctgtccggggaggagcagcagcccaagtgcccgcggtgcaagagccccgtgctgctgcacttcctccgcgccggcgacgacatcaacggcggcaagctgccggcggccggccggcagtaa

SEQ ID NO: 18597 - protein, 85 aa, Sorghum bicolor
  misc_feature: Useful for biocontainment applications
  misc_feature: Functional homolog of the protein sequence given in SEQ ID NO 13871
  misc_feature: Ceres ANNOT ID no. 8703645
MAGGGSAAESPASSCVSSDAEDEVVVQPQPKPMVVVGCPQCLMYVMLSGEEQQPKCPRCKSPVLLHFLRAGDDINGGKLPAAGRQ

SEQ ID NO: 18598 - DNA, 1242 bp, Sorghum bicolor
  misc_feature: Ceres ANNOT ID no. 8703697
  misc_feature: Encodes the peptide sequence at SEQ ID NO 18599
atgtcttttcggagcatggttcgtgatataagggaaagttttgggaatatatcgaggcggaactttgaggtgagaattcaccacagagggaagtctcttggatcttcaagtgacttgcaagacaagcctgctgaaattcagcaaagcaggtgggctagccttcctcctgagttactccgcgatgtgatgaaaagattggaggaagatgacagtagctggccggatcgcaaggatgttgtttgttgtgcctctgtttgtacaacctggagggatatgtgtaaggatatagtgagaagtccagaacattgtgcaaagctcacatttccaatatctcttaaacagcctggaccccgagacggagtaatccaatgtttcataaaaagggataaatcaaaactaacataccggctctacttgtcccttagctctgctgtgcttgatgagaatggaaagttcctattagcagcgaaaaggagccgcaggatggcgcacacggagtatgctatttttatgggttcaaggaatttctcccgatcgagtactggctacattgggaaattaaggtcaaatttccttggaactaaatttatcatctatgacacacagcctccgtacaatgctgggaaactttgcgcacaggaacgtgcccccagccgtcggttgtcttccaggaaagtttcaccaagagttccaacagggagctaccccattgctcaggtaaactacaagctgaatgtgctcggaacccgggggccaaggcggatgcagagtgctatgcattccatccccgcgtcagcacttgagcctggcggtgtcgtgcctggacaatcgaaagagctcctcccaaggctattcgatgagtccttcagcagcacagcaacttctttctccaagtactctgtcgtggacagctccatggacctgatcagctgccgattctccgagctcattggaggggctctggaagaaagcagcgacgacttcgagaaggagaggcctttggttttgcgcaacaaggcgccaaggtggcacgagcagctgcagtgctggtccctcaatttccgggggggtgtcactgtggcctcggtcaagaacttccaccatgtccatgacccagtgatcctccatttcggcaaggtcgggagggacattttccccatggactaccggtacccgctgtgggccttccaggcctttgccatatttttgaggagtttggaccccaagctggcctgtgaatga

SEQ ID NO: 18599 - protein, 413 aa, Sorghum bicolor
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
  misc_feature: Ceres ANNOT ID no. 8703697
  misc_feature (115)..(407): Pfam ID: Tub Pfam Description: Tub family
  misc_feature (49)..(104): Pfam ID: F-box Pfam Description: F-box domain
MSFRSMVRDIRESFGNISRRNFEVRIHHRGKSLGSSSDLQDKPAEIQQSRWASLPPELLRDVMKRLEEDDSSWPDRKDVVCCASVCTTWRDMCKDIVRSPEHCAKLTFPISLKQPGPRDGVIQCFIKRDKSKLTYRLYLSLSSAVLDENGKFLLAAKRSRRMAHTEYAIFMGSRNFSRSSTGYIGKLRSNFLGTKFIIYDTQPPYNAGKLCAQERAPSRRLSSRKVSPRVPTGSYPIAQVNYKLNVLGTRGPRRMQSAMHSIPASALEPGGVVPGQSKELLPRLFDESFSSTATSFSKYSVVDSSMDLISCRFSELIGGALEESSDDFEKERPLVLRNKAPRWHEQLQCWSLNFRGGVTVASVKNFHHVHDPVILHFGKVGRDIFPMDYRYPLWAFQAFAIFLRSLDPKLACE

SEQ ID NO: 18600 - DNA, 1089 bp, Sorghum bicolor
  misc_feature: Ceres ANNOT ID no. 8703699
  misc_feature: Encodes the peptide sequence at SEQ ID NO 18601
atgggcaggtcgtcccgctgcagctgcagcagatcagtggccgccgtgcagctgctggtggccatctcagcggtctgcggcgccgccctctcgtcggccacggtgaccgtgaacgaacccgatatcgcaaacggcctctcctggaggttctacgacgcgtcctgcccgtacgtggaggacatcgtgagctggcacgtcaccgaggcactccgccgcgacatcggcatcgccgccgggctcatccgcatcttcttccacgactgcttcccgcagggctgcgacgcgtccgtgctcctgtcgggtcccaagagcgagcagattgagatacccaaccagacgctgcgtcccgcggcgctgaaactcatcgacgacatccgcgccgacgtccacgccacctgtgggccaaccgtgtcctgcgccgacatcaccacgctagctacccgggacgccgtcgtcgcgtccggcggccccttcttcgacgttcctctggggcgtcgcgacggtctggcgccggcgtcgagcgacctggtgggcaccctgccggcgcccttcttcgacgttccgacgctgatctcggcgttcgagaaccgcggcctgaacaaggcggacctggtggctctctccggcgcgcacaccgtgggccgcggccactgctcctccttcagcgaccgtctgccgccgaacgcggacgacgacaccatggacccggcgttccggcggaagctggcggccaagtgcgccagcgaccccagcgggaacgtggtcacccaggtgctggacgtgcgcacgcccgacgccttcgacaacaagtactacttcgacctcatcgccaagcaggggctgttcaagtcggaccagggcctcatcaaccacccggacaccatgcgcaccgccacacgcttcgcgctcaaccaggccgccttcttcgaacagttcgccaggtccttcgtcaagatgagccagatggacgtgctcaccggcaccgccggagagatccgcctcaactgctccgtgcccaatatcgtcgtctcatcatcagcccacaccgccgccggcgacggcgacgaggggcgagcggccgacgagtga

SEQ ID NO: 18601 - protein, 362 aa, Sorghum bicolor
  misc_feature: Useful for making plants with altered cell wall content and/or composition
  misc_feature: Functional homolog of the protein sequence given in SEQ ID NO 13759
  misc_feature: Ceres ANNOT ID no. 8703699
  misc_feature (42)..(340): SWISSPROT Homolog: EC 1.11.1.7 Peroxidase
  misc_feature (62)..(304): Pfam ID: peroxidase Pfam Description: Peroxidase
MGRSSRCSCSRSVAAVQLLVAISAVCGAALSSATVTVNEPDIANGLSWRFYDASCPYVEDIVSWHVTEALRRDIGIAAGLIRIFFHDCFPQGCDASVLLSGPKSEQIEIPNQTLRPAALKLIDDIRADVHATCGPTVSCADITTLATRDAVVASGGPFFDVPLGRRDGLAPASSDLVGTLPAPFFDVPTLISAFENRGLNKADLVALSGAHTVGRGHCSSFSDRLPPNADDDTMDPAFRRKLAAKCASDPSGNVVTQVLDVRTPDAFDNKYYFDLIAKQGLFKSDQGLINHPDTMRTATRFALNQAAFFEQFARSFVKMSQMDVLTGTAGEIRLNCSVPNIVVSSSAHTAAGDGDEGRAADE

SEQ ID NO: 18602 - DNA, 1002 bp, Sorghum bicolor
  misc_feature: Ceres ANNOT ID no. 8703721
  misc_feature: Encodes the peptide sequence at SEQ ID NO 18603
atggatcagcaggaggagtcttgtgttcccccaggcttcaggttccaccctacagaggaagagctggtgggatactaccttgccaggaaggtggcctcccagaagatcgacctcgacatcatccaggaggtcgatctctacaggatagagccatgggatctgcaagagcggtgcaggcagcacgccggcggtgggcacgacgagcagacgacggagtggtacttcttcagctacaaggaccgcaagtaccccagcgggacgaggaccaaccgcgccacggcggccggattctggaaggccaccggcagggacaagccggtgctgtcgtcgtcgtgcaccaggaccagcaggtgcggcggcggcagcagggtcgtcatcggcatgaggaagacgctggtgttttacaagggcagggcccccaacggcaggaagagcgactggatcatgcacgagtaccgactccaatccaacgagcacgcacccgcgcaggaggaaggctgggtggtgtgccgcgcattccagaagcctatccccaaccagcagaggcccttcttccccaccagctacggcgccggttactacgaccaccacctctcaacgacgacgaccactcggctgaacgtcgacggcgaccgccatatgcatttcctgggctcatcatcagcactgctacaccaccctgcaggcctgctcagcagcttcccgccttcttcgttatactctgacgacgacttggagtccaagaaacatctgttcagtatgccgccgctggagagccccactgccgccatagcctgctgttctgatggcggcggcggcggctacgctccagctactacgcagagaagcagctacgatgaacatgagctgatgatccaacaggaaggaggagaaggagagcaagctgcagccgctgccggcgccatcgactggaactttctggacagcctgctgtccgcgacgtcgcaactccatgggccctcgggatccttgttgcagtga

SEQ ID NO: 18603 - protein, 333 aa, Sorghum bicolor
  misc_feature: Useful for making plants with altered carbohydrate content
  misc_feature: Functional homolog of the protein sequence given in SEQ ID NO 13685
  misc_feature: Useful for biocontainment applications
  misc_feature: Functional homolog of the protein sequence given in SEQ ID NO 13623
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: Useful for making plants with altered cell wall content and/or composition
  misc_feature: Useful for making plants with altered lignin content
  misc_feature: Functional homolog of the protein sequence given in SEQ ID NO 14527
  misc_feature: Ceres ANNOT ID no. 8703721
  misc_feature (9)..(155): Pfam ID: NAM Pfam Description: No apical meristem (NAM) protein
MDQQEESCVPPGFRFHPTEEELVGYYLARKVASQKIDLDIIQEVDLYRIEPWDLQERCRQHAGGGHDEQTTEWYFFSYKDRKYPSGTRTNRATAAGFWKATGRDKPVLSSSCTRTSRCGGGSRVVIGMRKTLVFYKGRAPNGRKSDWIMHEYRLQSNEHAPAQEEGWVVCRAFQKPIPNQQRPFFPTSYGAGYYDHHLSTTTTTRLNVDGDRHMHFLGSSSALLHHPAGLLSSFPPSSLYSDDDLESKKHLFSMPPLESPTAAIACCSDGGGGGYAPATTQRSSYDEHELMIQQEGGEGEQAAAAAGAIDWNFLDSLLSATSQLHGPSGSLLQ

SEQ ID NO: 18604 - DNA, 1140 bp, Sorghum bicolor
  misc_feature: Ceres ANNOT ID no. 8703717
  misc_feature: Encodes the peptide sequence at SEQ ID NO 18605
atggacaagtacgagcccgttcgtgagatcggggcgggcaacttcggggtggccaagctcatgaggaacaaggaaaccagggagctcgtggccatgaagttcatagagcgaggaaacaggatcgacgagaacgttttccgcgagatcgttaaccaccgttcccttcggcaccccaacatcatccgtttcaaggaggtggttctgaccccgacgcacctggcgatcgtgatggagtacgcggccggcggtgagctgttcgagcgcatctgcgaggccggcaggttccacgaggacgaggcccgctacttcttccagcagctggtgtgcggggtgagcttctgccacgccatgaacatctgccaccgggacctcaagctcgagaacacgctgctcgacggcagccccgcgccgcgcctcaagatctgcgactttggatactccaagtcctccgtgctgcactccaggcccaagtcaacggtcggaacgccggcctacatcgcccccgaggtcctgtcgcgacgagagtacgacggcaagcacgcagatgtatggtcctgcggcgtcacgctctacgtcatgctcgtcggagcctacccgttcgaggatccaaaggatccaaagaacttcagaaagacaatctcgcgcatcatgtccgtgcagtacaagatccccgagtacgtgcacgtctcccacaactgccgccacctcctctcccgcatcttcgtccagaacccctacaagaggatcaccatgagcgagatcaagagccacccatggtacctcaaaaacctgcccagggagctcaaggaggaggcacaggcagcctactacagccgccggggagtgggagacgccgccgccggcagcagcaatgccaatggcaatggcaatgccaatgccgtggcaccagcagcctactcgtcgcagagcgtggaggagatcatgaggatcgttcaggaggcgcagacgctgcccaagcccgcgaggcccgtctccggctacggctgggacgccgcctccgacgacgacgacgaccagtacgaggaagaagcagagcccgaggaagaagacgactacgacaggacggtgcggcaggtacacgccagcggggagttcgacatgagcaggctccaaatctga

SEQ ID NO: 18605 - protein, 379 aa, Sorghum bicolor
  misc_feature: Useful for biocontainment applications
  misc_feature: Useful for making plants with modulated biomass
  misc_feature: Useful for making plants with modulated time to senescence
  misc_feature: Functional homolog of the protein sequence given in SEQ ID NO 14093
  misc_feature: Useful for making plants with modulated water use efficiency
  misc_feature: Functional homolog of the protein sequence given in SEQ ID NO 14094
  misc_feature: Ceres ANNOT ID no. 8703717
  misc_feature (1)..(379): SWISSPROT Homolog: EC 2.7.11.1 Non-specific serine/threonine protein kinase
  misc_feature (4)..(260): Pfam ID: Pkinase Pfam Description: Protein kinase domain
MDKYEPVREIGAGNFGVAKLMRNKETRELVAMKFIERGNRIDENVFREIVNHRSLRHPNIIRFKEVVLTPTHLAIVMEYAAGGELFERICEAGRFHEDEARYFFQQLVCGVSFCHAMNICHRDLKLENTLLDGSPAPRLKICDFGYSKSSVLHSRPKSTVGTPAYIAPEVLSRREYDGKHADVWSCGVTLYVMLVGAYPFEDPKDPKNFRKTISRIMSVQYKIPEYVHVSHNCRHLLSRIFVQNPYKRITMSEIKSHPWYLKNLPRELKEEAQAAYYSRRGVGDAAAGSSNANGNGNANAVAPAAYSSQSVEEIMRIVQEAQTLPKPARPVSGYGWDAASDDDDDQYEEEAEPEEEDDYDRTVRQVHASGEFDMSRLQI

SEQ ID NO: 18606 - DNA, 2046 bp, Sorghum bicolor
  misc_feature: Ceres ANNOT ID no. 8703737
  misc_feature: Encodes the peptide sequence at SEQ ID NO 18607
atggcgttcggccacacacggctcgatgtccggcgtgcgccgcagtcctcctacttctcctgctccacaaccaccgtcgccgtattcgtcgctctctgcctggttgctgtgtggatggcatcgtccatgctcgtcacccctaccgaattctctccatttcagcccaaagtccgtccattgccgcctcaagactcacctcctgacaccggaagcttaaccagtgctggtcaggatgatggcatccgtgaaatggaacgggatgtgcccgttgatccaccacctgttacacaacaattgcctcctgtaacagacagcatggatagtgaagatcagcaagaggatgcggagcttttcaatgagaccactacagagcgcggaccatggcaaacgaaggctgcacaatctaacaaggacgctaaggagcaaaccttgacgtccagtagcccagtgagctttacttgggtgctatgcaacgtcgacgctggaacagattatattccatgccttgacaacacagaagctatcaagaagctccgttccaccaagcactacgaacatcgagaaaggcattgccccgagaaacctcctacctgccttgttcctctaccagagggctacaggaatcgaataaggtggcctaagagcagagatcagatatggtacaacaatgttcctcatactaagctggttgaatacaagggacaccaaaactgggttaaggtttctggagagtacctcatcttcccgggaggtgggactcagtttaaacatggtgcgttgcactacattgattttattcaggaggcaaagaaggacgtagcatggggaaaacgaagtcgtgtagttttagatgttggctgtggagtagctagcttcggaggatatctatttgacagagatgtgattactatgtcatttgcacctaaagatgagcatgaagctcaggttcaatttgctcttgaaagaggaatacctgctatatcagctgttatgggtacaaaaaggctcccattttccagcagggtctttgatgttgttcattgtgcacgatgtagggtaccatggcatattgaaggcggtaaactcttgcttgaactggacagactgttgcgtcctggtggttactttgtgtggtctgctacacctgtataccagaagctgcccgaagatgttgagatatggcaagccatgtctgctctaaccagttcaatgtgctggaaaatggtcaacaaagtaaaggatagggtgaatagagtgggtatagcaatttacagaaagccaacagacaacagctgctacgaagcaagatctgaaacaaaccctccactctgtggagagtatgatgatcctgatgctgcctggaacatatcgttgggggcttgtatgcataagttgcctgtagatcctaccattcgtggttcacagtggcctgagttatggccactgagactggagaagccaccttattggctgagaggttctgaggctggagtatatgggaaacctgccccagaggatttccaagcagactatgaacactggaagcgagttgtgagcaattcatacatgaatggtttgggtattgattggtcttctgttagaaatgttatggatatgaaagctgtatatgcagggttcgcagcagctttgcgcaatctcaaggtgtgggtcatgaatgtggttccaattgattcacccgacacgcttccaattatatatgaacgtgggctgtttggactgtaccatgactggtgtgagtcgtttagcacctatccgaggacttacgatcttctgcatgctaaccatctgttctccaaggttaagaagaggtgcgaactattacctgttatcgtggaagtggatcgggtgttgaggccagaaggccggctaattgtcagagacaacattgaaacaataagtgaggtggagaacattgtgaaatctctccactgggaggtccacatgtcttactcccaggataaagaaggcttgctgtttgtgcaaaagacgacatggcgaccaaatgaaactgaagataagctatga

SEQ ID NO: 18607 - protein, 681 aa, Sorghum bicolor
  misc_feature: The sequence is a functional homolog of SEQ ID NO 484 in the 11/435,388 US patent application
  misc_feature: The sequence is a functional homolog of SEQ ID NO 508 in the 11/435,388 US patent application
  misc_feature: The sequence is a functional homolog of SEQ ID NO 562 in the 10/412,699 US patent application
  misc_feature: The sequence is a functional homolog of SEQ ID NO 626 in the 11/435,388 US patent application
  misc_feature: The sequence is a functional homolog of SEQ ID NO 198 in the 10/666,642 US patent application
  misc_feature: Ceres ANNOT ID no. 8703737
  misc_feature (283)..(378): Pfam ID: Methyltransf_11 Pfam Description: Methyltransferase domain
MAFGHTRLDVRRAPQSSYFSCSTTTVAVFVALCLVAVWMASSMLVTPTEFSPFQPKVRPLPPQDSPPDTGSLTSAGQDDGIREMERDVPVDPPPVTQQLPPVTDSMDSEDQQEDAELFNETTTERGPWQTKAAQSNKDAKEQTLTSSSPVSFTWVLCNVDAGTDYIPCLDNTEAIKKLRSTKHYEHRERHCPEKPPTCLVPLPEGYRNRIRWPKSRDQIWYNNVPHTKLVEYKGHQNWVKVSGEYLIFPGGGTQFKHGALHYIDFIQEAKKDVAWGKRSRVVLDVGCGVASFGGYLFDRDVITMSFAPKDEHEAQVQFALERGIPAISAVMGTKRLPFSSRVFDVVHCARCRVPWHIEGGKLLLELDRLLRPGGYFVWSATPVYQKLPEDVEIWQAMSALTSSMCWKMVNKVKDRVNRVGIAIYRKPTDNSCYEARSETNPPLCGEYDDPDAAWNISLGACMHKLPVDPTIRGSQWPELWPLRLEKPPYWLRGSEAGVYGKPAPEDFQADYEHWKRVVSNSYMNGLGIDWSSVRNVMDMKAVYAGFAAALRNLKVWVMNVVPIDSPDTLPIIYERGLFGLYHDWCESFSTYPRTYDLLHANHLFSKVKKRCELLPVIVEVDRVLRPEGRLIVRDNIETISEVENIVKSLHWEVHMSYSQDKEGLLFVQKTTWRPNETEDKL

SEQ ID NO: 18608 - DNA, 666 bp, Sorghum bicolor
  misc_feature: Ceres ANNOT ID no. 8703785
  misc_feature: Encodes the peptide sequence at SEQ ID NO 18609
atggctggaggcaagtccggcggcaacgccgcgcgcagcaggaagcgcgtcgaggccaccgtcctcaagcgctccagggacggcagcgcattcaccagatgcgaggcctgcaacaaggatgtccccgtcgtcctcatcgacatgcacagctgcagcctcgacaagcacatcaggatgatgctcgaggcgcaggtcgtcgagaagaccgtcgaggtcgccgccaagcccgccgaacgcaacaagtcctccgccaagggacacggaggcggcggcaacaaggatgccaagcgcaagcgctcgcccacagccttcttcctcttcatggacgacttcaggaaggagttcaaggccgcccatcctgacaacaagagtgtcgccaccgttgcaaaggaaggaggggagaagtggaagtccatgacagacgaggagaagaagccttacgttgaaaaggccgcggagctcaaggctcaagccgagaatggcgagggcagtggtgagaacaatgttgccaagaagaaagccaaggcagatgacaaggatggggagcaggaggtggatcagcctgcaaagaagcgcatcaggcgcaaggctcttgacgaggacgaggatgacgctggcgaccaggaagatgaggatgagcagaacgagttggatgatgacatgtag

SEQ ID NO: 18609 - protein, 221 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 12991
  misc_feature: The sequence is a functional homolog of SEQ ID NO 1446 in the 11/479,226 US patent application
  misc_feature: The sequence is a functional homolog of SEQ ID NO 682 in the 10/412,699 US patent application
  misc_feature: Ceres ANNOT ID no. 8703785
  misc_feature (98)..(161): Pfam ID: HMG_box Pfam Description: HMG (high mobility group) box
MAGGKSGGNAARSRKRVEATVLKRSRDGSAFTRCEACNKDVPVVLIDMHSCSLDKHIRMMLEAQVVEKTVEVAAKPAERNKSSAKGHGGGGNKDAKRKRSPTAFFLFMDDFRKEFKAAHPDNKSVATVAKEGGEKWKSMTDEEKKPYVEKAAELKAQAENGEGSGENNVAKKKAKADDKDGEQEVDQPAKKRIRRKALDEDEDDAGDQEDEDEQNELDDDM

SEQ ID NO: 18610 - DNA, 669 bp, Sorghum bicolor
  misc_feature: Ceres ANNOT ID no. 8703793
  misc_feature: Encodes the peptide sequence at SEQ ID NO 18611
atggcgatcgtctacgccctggtcgctcggggcacggtggttctggccgagttcgccgccgtctcaggcaacgccggcgccgtggcccgccggatcctcgagaagctgccgcccgacgccgagtccaggctgtgctttgcgcaggaccggtacatcttccacgtcctccggtctgacgccgccggcatcaccttcctctgtatggccaacgacaccttcggaagaagaatcccctttctctacctggaggacatccaaatgaggttcatgaaaaactacggcagagtcgcccactctgcgctggcttacgccatgaacgatgaattctccagggtgctccatcagcaaatggagttcttctccagcaacccaagtgctgacacactcaaccgtctccgcggagaagtcagtgagatacacaccgtcatggtcgacaacattgagaaaattcttgacagaggcgaccgcatctcgctccttgtggacaagacatccaccatgcaggacagctcctttcacttccgcaagcaatccaagaggctccgcagagctctttggatgaagaatgccaagcttctagttgtgttgacagttgtcatagtagtgctgctctacttgatcatttctgctttctgtggaggcctttccttatcatcatgcagatcatga

SEQ ID NO: 18611 - protein, 222 aa, Sorghum bicolor
  misc_feature: Useful for making plants with modulated heat sensitivity
  misc_feature: Functional homolog of the protein sequence given in SEQ ID NO 13180
  misc_feature: Ceres ANNOT ID no. 8703793
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature (125)..(213): Pfam ID: Synaptobrevin Pfam Description: Synaptobrevin
MAIVYALVARGTVVLAEFAAVSGNAGAVARRILEKLPPDAESRLCFAQDRYIFHVLRSDAAGITFLCMANDTFGRRIPFLYLEDIQMRFMKNYGRVAHSALAYAMNDEFSRVLHQQMEFFSSNPSADTLNRLRGEVSEIHTVMVDNIEKILDRGDRISLLVDKTSTMQDSSFHFRKQSKRLRRALWMKNAKLLVVLTVVIVVLLYLIISAFCGGLSLSSCRS

SEQ ID NO: 18612 - DNA, 1008 bp, Sorghum bicolor
  misc_feature: Ceres ANNOT ID no. 8703827
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 18613
atggatgatcatcatcatcagcagcagcaggcaccatgcgtgcctccaggtttcaggttccacccgacggaggaggagcttgtggggtactacctcgccaggaaggtggcctcccagaagatcgacctcgacatcatccgggaggtcgatctctacaggatcgagccatgggatctccaagagaggtgcggctactacggcggctcctacggccaggaccaggaggagccgacggagtactacttcttcagctacaaggaccgcaagtacccgagcggcacgcgcaccaaccgcgccaccgccgctggcttctggaaggccaccggcagggacaagccggtgctctcctccaccaccacctcccggtcctccgccgccgccggaggcatcagcgtcgtcatcggcatgcggaagacgctcgtcttctaccgcggccgcgcgcccaacggccgcaagacggactggatcatccacgagtaccggctgcagagcaacgagcacgcgcccgcgcaggaggaaggatgggtcgtctgccgcgccttccagaagcccatgcccaaccagcagcacatcaggcacgccgcctgctactacccttcgccgccgggcagctacctcggcgccgccatgcccgctgccacctactactacgacggacccgtccctgcgccgcggctactgatgaacagcggcggcggcgctgtggctgcggctgcacctccggcggcagcgcatgaccacggcggcggcttggcggctgagtccaagctgcaggtgcagctcctcgccgacatgccgccgctccacagcccctcctccgtcgacggcggcgtcgtgcagcatcatagctacaacgatcagatcgccgccgccgccgtcgctgcagagtcgacgacggtggattggaacctgctgagcagcctgctgccgcccgcgcagctcaatttccatcacacaccgccgccggaatctccgtcttcttgctccaagaacaacaatgatgcatga

SEQ ID NO: 18613 - protein, 335 aa, Sorghum bicolor
  misc_feature: Useful for making plants with altered carbohydrate content
  misc_feature: Functional homolog of the protein sequence given in SEQ ID NO 13685
  misc_feature: Ceres ANNOT ID no. 8703827
  misc_feature (14)..(163): Pfam ID: NAM Pfam Description: No apical meristem (NAM) protein
MDDHHHQQQQAPCVPPGFRFHPTEEELVGYYLARKVASQKIDLDIIREVDLYRIEPWDLQERCGYYGGSYGQDQEEPTEYYFFSYKDRKYPSGTRTNRATAAGFWKATGRDKPVLSSTTTSRSSAAAGGISVVIGMRKTLVFYRGRAPNGRKTDWIIHEYRLQSNEHAPAQEEGWVVCRAFQKPMPNQQHIRHAACYYPSPPGSYLGAAMPAATYYYDGPVPAPRLLMNSGGGAVAAAAPPAAAHDHGGGLAAESKLQVQLLADMPPLHSPSSVDGGVVQHHSYNDQIAAAAVAAESTTVDWNLLSSLLPPAQLNFHHTPPPESPSSCSKNNNDA

SEQ ID NO: 18614 - DNA, 2013 bp, Sorghum bicolor
  misc_feature: Ceres ANNOT ID no. 8703882
  misc_feature: Encodes the peptide sequence at SEQ ID NO 18615
atggggaactcccccggtttatttatcagcaccggccggtacgccatcgtggtcatcggcttcctgtccacgttcggcggcggccggacaccggtcctcaacttggccggacactgcgatcccggcgtggtgggcggtggctgcacacgcctgtcggtggacatcaagtcctgtcagacccaaggcgtcaaggtgctcctcagcatcggcggcggctccgggaactacagcctttcctccgcctcggacgccaagagcgtggccacctacctatgggacaacttcctcgggggcaccaactccacctcctcatctcggccgctcggcgacgccgttctcgacggcatcgacttcgacatccagattggttcagcgagtcactacgatgacctcgctaagaacctcaagtcctccagcggcagtatcctgctcgccgcggcgccgcagtgcccgttcccggacgccttcctcggcgcggcgctcgccacggagctgttcgactacgtttgggtacagttctacaacaaccccggttgccagtaccaggacaacggagacgtgagcaatctggaggttacgtggaagaactggacggagttcttgtcgaagacgccggcgtcggtgcttcttggcctgccggcgtcgcctgacgcggcggctagcggctacatagaccccaaagcctttgtgtcgcatgtgctgccggtggtcaagggctccgcaaagtacggcggcatcatgttgtggaaccgctactatgacaacaccaataattacagtgccaagcttctgagcaacaccgtcgcagcggatccaccaaacagctcgccaattccagggggctccggcaacgcattgccaccaaacaactcaccagtttcaccgaacactggccaatcacgaaagaaaaggatcagaatatatattatagcaggcacctcaggcctttctgggctgtgcgtaatcgctctcatagttgtgatgtggtataagagatgctatggcatgataccatgttacaaatggcccagaaattcaccaaggcttgaatcttttttgcaaaagcaaggaactttacaccccaaaggttacgcttattcggaagtgaaaagaatgacaaagtcctttgctcacaagcttggccaaggtggctatggagctgtttacaaaggcaacatgcctgatggtcgtgagatagctgttaagatgctgaagggcactgaaggcgatagtgaggaattcatgaacgaggtggccagcattagcagaacatctcatgtcaacattgttactctggtaggatattgcctccaaggttcaaaaagagctctgctctacgagtatatgcccaatggttctcttgagaggtacacttttggcaacagttctaccgaaggagaagacactttaagttgggataaactgttcgatattgtcataggaatcgcacgaggattggagtatctccacacaggatgcaacacccccattgtacatttcgatatcaaaccacacaacattctgctagatcaggatttctgtccaaagatatcagattttggattagctaagctgggccgacaaaaggagagtagaatctccattgccggggcaagaggcacgatagggtacatagcacctgaagtgttctcaagaaactatggaccagtgggcagcaaggctgacgtttacagttatggaatggtggtccttgagatggttggagcaaggaagaaaatcgatgtgagtacagacgacagcagcagcaagtattttccacaatggctctatgaaaacttggatcagttctgtggccacacaaatagcgagatcagcagcagcagcagcagcgacaatatggaagtgctggtgaggaagatgatcatagttggcttgtggtgcatacagtccaaaccggccgatcggccttccatgggtgaagtccttgagatgttggagagcaacgctgctgacctgcagttgccacctaaggccttctggactggttattaa

SEQ ID NO: 18615 - protein, 670 aa, Sorghum bicolor
  misc_feature: Useful for making plants with altered carbohydrate content
  misc_feature: Functional homolog of the protein sequence given in SEQ ID NO 13911
  misc_feature: Useful for making plants with altered cell wall content and/or composition
  misc_feature: Functional homolog of the protein sequence given in SEQ ID NO 13912
  misc_feature: Ceres ANNOT ID no. 8703882
  misc_feature (10)..(266): SWISSPROT Homolog: EC 3.2.1.14 Chitinase
  misc_feature (287)..(655): SWISSPROT Homolog: EC 2.7.11.1 Non-specific serine/threonine protein kinase
  misc_feature (2)..(254): Pfam ID: Glyco_hydro_18 Pfam Description: Glycosyl hydrolases family 18
  misc_feature (374)..(652): Pfam ID: Pkinase Pfam Description: Protein kinase domain
MGNSPGLFISTGRYAIVVIGFLSTFGGGRTPVLNLAGHCDPGVVGGGCTRLSVDIKSCQTQGVKVLLSIGGGSGNYSLSSASDAKSVATYLWDNFLGGTNSTSSSRPLGDAVLDGIDFDIQIGSASHYDDLAKNLKSSSGSILLAAAPQCPFPDAFLGAALATELFDYVWVQFYNNPGCQYQDNGDVSNLEVTWKNWTEFLSKTPASVLLGLPASPDAAASGYIDPKAFVSHVLPVVKGSAKYGGIMLWNRYYDNTNNYSAKLLSNTVAADPPNSSPIPGGSGNALPPNNSPVSPNTGQSRKKRIRIYIIAGTSGLSGLCVIALIVVMWYKRCYGMIPCYKWPRNSPRLESFLQKQGTLHPKGYAYSEVKRMTKSFAHKLGQGGYGAVYKGNMPDGREIAVKMLKGTEGDSEEFMNEVASISRTSHVNIVTLVGYCLQGSKRALLYEYMPNGSLERYTFGNSSTEGEDTLSWDKLFDIVIGIARGLEYLHTGCNTPIVHFDIKPHNILLDQDFCPKISDFGLAKLGRQKESRISIAGARGTIGYIAPEVFSRNYGPVGSKADVYSYGMVVLEMVGARKKIDVSTDDSSSKYFPQWLYENLDQFCGHTNSEISSSSSSDNMEVLVRKMIIVGLWCIQSKPADRPSMGEVLEMLESNAADLQLPPKAFWTGY

SEQ ID NO: 18616 - DNA, 141 bp, Sorghum bicolor
  misc_feature: Ceres ANNOT ID no. 8703880
  misc_feature: Encodes the peptide sequence at SEQ ID NO 18617
atgaaggagaagaagaggatcaatgagatcaagaggctgaagcaacatcgcgaggagctacagttcagcctgcaggaggagatcgacaccgcgatcgccaagtgggggagcaaaataggggagaacttaatgctcacttaa

SEQ ID NO: 18617 - protein, 46 aa, Sorghum bicolor
  misc_feature: Useful for making plants with modulated heat sensitivity
  misc_feature: Functional homolog of the protein sequence given in SEQ ID NO 14451
  misc_feature: Ceres ANNOT ID no. 8703880
MKEKKRINEIKRLKQHREELQFSLQEEIDTAIAKWGSKIGENLMLT

SEQ ID NO: 18618 - DNA, 1047 bp, Sorghum bicolor
  misc_feature: Ceres ANNOT ID no. 8703921
  misc_feature: Encodes the peptide sequence at SEQ ID NO 18619
atggacaacatcacgcacaactccagcagcagcagctcatgggatttggacatgagtctcggcagccaccaccaccctctcctcttcgacagccaccaccccaacccagggccgccgccgccgccgccattacccttccacctctcctcctcccatcctgcacaccaccaccctccaccgcatcctgcacaccaccaccaccaccatcccggcttggatccttcgccgtcttcctccctgttcccacaaccgcaccaccaccaccaccaccaccggctccaccacctcggccttgacctcgaccccgcctcccattcccacggccaccaccggcaccacgagttcggcgagcagcaggagcccggcggcggcggcggcggcggcggcggagaggagcatcaggaggagatgaggcagcagcagcagcacgaggcgggcggcggcgggcaggaggaccgcggcggcggcggcgccgccgaggacgtcgaggaggagctgggcgccatgaaggagatgatgtaccggatcgccgccatgcagccggtggacatcgacccggccaccatcaagaagccccggcgccgcaacgtgcgcatcagcgaggacccgcagagcgtggcggcgcggcaccggcgcgagcggatcagcgagcgcatccgcatcctgcagcgcctcgtccccggcggcaccaagatggacaccgcctccatgctcgacgaggccatccgctacatcaagttcctcaagcgccaggtgcaggagctccagcaccagccgtcgccgacgcagcagcagtacccggcgtccgccggagccggccccagcacctcagtcgtgggcgtggcggcgccagggcgacccggcggcgggccaccgttcctgccgctgggtccagggccgcttattgactgggccggtctcgtcaggcccgtcgacatacacgggccgacgtcgtcttcgtcctcgtcgtcgatgggcggcgcccatgccgccctaggcttcggcttcagcagcgctggcggccagagcagccatggaatgcactga

SEQ ID NO: 18619 - protein, 348 aa, Sorghum bicolor
  misc_feature: The sequence is a functional homolog of SEQ ID NO 1658 in the 10/374,780 US patent application
  misc_feature: The sequence is a functional homolog of SEQ ID NO 1679 in the 10/412,699 US patent application
  misc_feature: Ceres ANNOT ID no. 8703921
  misc_feature (202)..(249): Pfam ID: HLH Pfam Description: Helix-loop-helix DNA-binding domain
MDNITHNSSSSSSWDLDMSLGSHHHPLLFDSHHPNPGPPPPPPLPFHLSSSHPAHHHPPPHPAHHHHHHPGLDPSPSSSLFPQPHHHHHHHRLHHLGLDLDPASHSHGHHRHHEFGEQQEPGGGGGGGGGEEHQEEMRQQQQHEAGGGGQEDRGGGGAAEDVEEELGAMKEMMYRIAAMQPVDIDPATIKKPRRRNVRISEDPQSVAARHRRERISERIRILQRLVPGGTKMDTASMLDEAIRYIKFLKRQVQELQHQPSPTQQQYPASAGAGPSTSVVGVAAPGRPGGGPPFLPLGPGPLIDWAGLVRPVDIHGPTSSSSSSSMGGAHAALGFGFSSAGGQSSHGMH

SEQ ID NO: 18620 - DNA, 375 bp, Sorghum bicolor
  misc_feature: Ceres ANNOT ID no. 8703971
  misc_feature: Encodes the peptide sequence at SEQ ID NO 18621
atggaaagatcgtgcaatgtctttgtggaatacctggactgcaggaaggggatgtggagacggagaagaatagtgtttgatggcctacaccagatgtggccaaaactcattgctaaagcaaaggaaggtggccttgatgtgatacagacctatgtattctggaatgttcatgagcctgtccagggccagtacaacttcgagggaagatatgattttgtcaggttcatcaaggaaattcaaggtcaaggcctctacgtaaacctcaggattggtcccttcatagagtccgaatggaaatacggaggatttccgttttggctacatgatgtcccaaacattaccttccggagtgacaatgaaccctttaaggcttaa

SEQ ID NO: 18621 - protein, 124 aa, Sorghum bicolor
  misc_feature: Useful for making plants with altered cell wall content and/or composition
  misc_feature: Functional homolog of the protein sequence given in SEQ ID NO 13635
  misc_feature: Useful for making plants with altered carbohydrate content
  misc_feature: Functional homolog of the protein sequence given in SEQ ID NO 13634
  misc_feature: Ceres ANNOT ID no. 8703971
  misc_feature (22)..(123): SWISSPROT Homolog: EC 3.2.1.23 Beta-galactosidase
  misc_feature (23)..(124): Pfam ID: Glyco_hydro_35 Pfam Description: Glycosyl hydrolases family 35
MERSCNVFVEYLDCRKGMWRRRRIVFDGLHQMWPKLIAKAKEGGLDVIQTYVFWNVHEPVQGQYNFEGRYDFVRFIKEIQGQGLYVNLRIGPFIESEWKYGGFPFWLHDVPNITFRSDNEPFKA

SEQ ID NO: 18622 - DNA, 198 bp, Sorghum bicolor
  misc_feature: Ceres ANNOT ID no. 8704008
  misc_feature: Encodes the peptide sequence at SEQ ID NO 18623
atggaggggagggaggccggaggagaggagggagagattgcctcgacacaggccgagtttattagtgcgttgtcgtttcctcggtactctgatcctagatatggtccgctaaatcttgctgtcaagcttccccatggggcccataagccagatcttgggccaaacatttgcatacctatggatttccccaagagttag

SEQ ID NO: 18623 - protein, 65 aa, Sorghum bicolor
  misc_feature: The sequence is a functional homolog of SEQ ID NO 956 in the 10/666,642 US patent application
  misc_feature: The sequence is a functional homolog of SEQ ID NO 959 in the 10/666,642 US patent application
  misc_feature: The sequence is a functional homolog of SEQ ID NO 958 in the 10/666,642 US patent application
  misc_feature: The sequence is a functional homolog of SEQ ID NO 190 in the 10/666,642 US patent application
  misc_feature: The sequence is a functional homolog of SEQ ID NO 1596 in the 11/479,226 US patent application
  misc_feature: The sequence is a functional homolog of SEQ ID NO 1432 in the 10/666,642 US patent application
  misc_feature: Ceres ANNOT ID no. 8704008
MEGREAGGEEGEIASTQAEFISALSFPRYSDPRYGPLNLAVKLPHGAHKPDLGPNICIPMDFPKS

SEQ ID NO: 18624 - DNA, 201 bp, Sorghum bicolor
  misc_feature: Ceres ANNOT ID no. 8704007
  misc_feature: Encodes the peptide sequence at SEQ ID NO 18625
atgcaggtgtttcacccaattcatgaccaggctttctacttaactgacgagcataagagaaagctcaagaagcttggtgaagctgttttcattcctgctggatgtcctcaccaagtcaggaatttgaagtcatgcatgcaggttgcaatgggttttgtttcccctgaaagtgttggcgagtgtattaaactgagtaactaa

SEQ ID NO: 18625 - protein, 66 aa, Sorghum bicolor
  misc_feature: The sequence is a functional homolog of SEQ ID NO 956 in the 10/666,642 US patent application
  misc_feature: The sequence is a functional homolog of SEQ ID NO 958 in the 10/666,642 US patent application
  misc_feature: The sequence is a functional homolog of SEQ ID NO 1596 in the 11/479,226 US patent application
  misc_feature: The sequence is a functional homolog of SEQ ID NO 1432 in the 10/666,642 US patent application
  misc_feature: The sequence is a functional homolog of SEQ ID NO 190 in the 10/666,642 US patent application
  misc_feature: The sequence is a functional homolog of SEQ ID NO 959 in the 10/666,642 US patent application
  misc_feature: The sequence is a functional homolog of SEQ ID NO 424 in the 10/666,642 US patent application
  misc_feature: Ceres ANNOT ID no. 8704007
MQVFHPIHDQAFYLTDEHKRKLKKLGEAVFIPAGCPHQVRNLKSCMQVAMGFVSPESVGECIKLSN

SEQ ID NO: 18626 - DNA, 1089 bp, Sorghum bicolor
  misc_feature: Ceres ANNOT ID no. 8704019
  misc_feature: Encodes the peptide sequence at SEQ ID NO 18627
atgggaggagcatccggagaccaccaccagcagcagcagcagcacggcggcggcgacgatgggcagctgcagcaaggcggaggcggcgacatggtgatgccggggttccgattccaccccacggaggaagagctcatcgacttctacctccgccgtagggtggagggcaagcgcttcaacatcgagctcatcaacctcgtcgacctctaccgctacgacccatgggatctccctgctttggcttcaattggggacaaggagtggtacttctacgtgccgagagaccgcaagtaccgcaacggcgaccggccgaaccgagtgacgccgtccggctactggaaggccacgggagccgaccggacggtgtacgtcgaggtgaagcgtccgatcgggctcaagaagacgctggtgttctatgtggggaaggcgcccaagggactcaggagcagctggatcatgaacgagtaccgccttccttccggcgaggctgaccgctaccaaaaggaaatttctctttgcaaagtgtataaacgaccagggattgaggacaactttcacctcagcaccaccacaacaagatcatccagctcaaaggctgcagcgaccatggaaaagaagcaccaccggactgcagcgtcaccccgcctggcgccaatgttcgacggtggccactcttcagttcacatgaacaagccatacagtggagcaaacaccaccatagccatgacatcgtcagctgcagctcgagcagcaacaatggcgccacagacgtcaatgttcctgtcagccccctcactcagctccaccacatcgacggaggaggacggtacatcactctaccacatgaaaggtgctaacccaccgatgctgacttcttccacacatgccctgcttaatgcaaactctgctacaatggcaacaattccaatagatgagctgagtagggcaattggatcatataatagccaaggaaaccctaaccagcccttgccatcacaaggtccattgcttccttttcctagcatggaaaaaatttgggattggaatccactcctagaatctcccaaggtttgcacaagcttcaagtga

SEQ ID NO: 18627 - protein, 362 aa, Sorghum bicolor
  misc_feature: The sequence is a functional homolog of SEQ ID NO 745 in the 11/479,226 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 890 in the 10/374,780 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 1170 in the 10/666,642 US patent application
  misc_feature: Ceres ANNOT ID no. 8704019
  misc_feature (32)..(159): Pfam ID: NAM Pfam Description: No apical meristem (NAM) protein
MGGASGDHHQQQQQHGGGDDGQLQQGGGGDMVMPGFRFHPTEEELIDFYLRRRVEGKRFNIELINLVDLYRYDPWDLPALASIGDKEWYFYVPRDRKYRNGDRPNRVTPSGYWKATGADRTVYVEVKRPIGLKKTLVFYVGKAPKGLRSSWIMNEYRLPSGEADRYQKEISLCKVYKRPGIEDNFHLSTTTTRSSSSKAAATMEKKHHRTAASPRLAPMFDGGHSSVHMNKPYSGANTTIAMTSSAAARAATMAPQTSMFLSAPSLSSTTSTEEDGTSLYHMKGANPPMLTSSTHALLNANSATMATIPIDELSRAIGSYNSQGNPNQPLPSQGPLLPFPSMEKIWDWNPLLESPKVCTSFK

SEQ ID NO: 18628 - DNA, 1806 bp, Sorghum bicolor
  misc_feature: Ceres ANNOT ID no. 8704044
  misc_feature: Encodes the peptide sequence at SEQ ID NO 18629
atggcagccatgcaaggaccaggaagcagagcaacgcgtgtcgtcgccgtctccctcctcctcgtcgtccccgtcctcctggcaagcctcgccggcgggagcccgccgccggacccggtatcctgcacgcgcggcacgtccgactgcacggtgacgagcacgtacgggtcgttcccggaccgcacgatctgccgggcggcgaacgcgacgttcccgcggacggagcaggagctggtggcggcggtggcgtcggcggcggcggcgcggcgcaaggtgaaggtcgccaccagccactcgcacagcttcccgaagctggcgtgcccgggcgggcgcgacggcaccatcatcagcacggagcggctgaacgcgacggtgcgcgtggacgcggcgcgccggctgctgacggtggagagcggcatgctgctccgcgacctcgtcaaggtcgccgccgacaacggcctcgcgctgccgcactcgccttactggtatggcctcaccgtcggcggcatgctggccaccggcgcccacggcagctcgctgtggggaaagggcagcgccgtgcatgagtacgtggtcgggatcaggatcgtcacgcctgccccggcgagccaggggttcgccgtcgttagggagctcgctgccggtgaccctgacctcgacgccgtcaaggtctcgctcggcgtcctcggcgtcatctctcaggtcacttttgagctgcagccgcagttcaagcggtcggtgaagttcgtgacccgcgacgacgaggacatggcggagaagctggccgtgtggggtgacctccacgagttcggcgacgtggcatggctgccgcggcagggcaaggcgatctaccgggaggacgaccgcgtcgacgtctccacccccggcaacggcctgaacaactacgtcggcttccgcgcgcagccgacgctggtccttctcgccgcccgagaagccgaggagcggctggaggagaacggcaccgacatcgcgcggtgcctggcggcgcgtctcccggcggcgacgttcgagctgcaggcgtacgggttcaccaacgacggcgtcttcttcacggggtacccagtggtagggttccagcaccggatccaggcgtcagggacgtgcatcaacggcgacgacgacgacggcggcggcctcctcctctccgcctgcacgtgggactcccgcatcagaggacctttcttctaccagtccggcttcagcgtcgccatgtccaaggtaccggcgttcgtcgccgacatgcagcggctgcgcgacctcaacccgcgcgccttctgcggggtggacgccaagatgggcgtgctgatgcgctacgtgaggtcctcgtcggcgtacctcggcaaggcggaggactcgctggacttcgacgtcacgtactaccggagctacgacgagggcgtgccgcgcgcgcacgccgacgtctacgacgagctcgagcagatggcgctgcggaagtacggcgcgctgccgcactggggaaagaaccgcaacttcgccttcgacggcgccattgctaggtaccccggcgcggcgaggttcatggaggtcaaggacaggtacgacccggatggcatcttctccagcgagtggagtgatcaggtgctcggcatcaggggtagccccaacgtcgtcgggccgagatgcgccattgagggactctgcgtctgctccgacgacgagcactgcgcgccggagcaagggtacttctgccgccccgggaaggtgtacgccgacgccagggtctgcgtctttgagcgacgcacacgactcgtcgacgagctctga

SEQ ID NO: 18629 - protein, 601 aa, Sorghum bicolor
  misc_feature: Useful for making plants with modulated nitrogen use efficiency
  misc_feature: Functional homolog of the protein sequence given in SEQ ID NO 14034
  misc_feature: Ceres ANNOT ID no. 8704044
  misc_feature: Up-regulated in root tissues in response to methyl jasmonate treatment
  misc_feature (100)..(305): SWISSPROT Homolog: EC 1.1.3.8 L-gulonolactone oxidase
  misc_feature (66)..(207): Pfam ID: FAD_binding_4 Pfam Description: FAD binding domain
  misc_feature (235)..(541): Pfam ID: ALO Pfam Description: D-arabinono-1,4-lactone oxidase
MAAMQGPGSRATRVVAVSLLLVVPVLLASLAGGSPPPDPVSCTRGTSDCTVTSTYGSFPDRTICRAANATFPRTEQELVAAVASAAAARRKVKVATSHSHSFPKLACPGGRDGTIISTERLNATVRVDAARRLLTVESGMLLRDLVKVAADNGLALPHSPYWYGLTVGGMLATGAHGSSLWGKGSAVHEYVVGIRIVTPAPASQGFAVVRELAAGDPDLDAVKVSLGVLGVISQVTFELQPQFKRSVKFVTRDDEDMAEKLAVWGDLHEFGDVAWLPRQGKAIYREDDRVDVSTPGNGLNNYVGFRAQPTLVLLAAREAEERLEENGTDIARCLAARLPAATFELQAYGFTNDGVFFTGYPVVGFQHRIQASGTCINGDDDDGGGLLLSACTWDSRIRGPFFYQSGFSVAMSKVPAFVADMQRLRDLNPRAFCGVDAKMGVLMRYVRSSSAYLGKAEDSLDFDVTYYRSYDEGVPRAHADVYDELEQMALRKYGALPHWGKNRNFAFDGAIARYPGAARFMEVKDRYDPDGIFSSEWSDQVLGIRGSPNVVGPRCAIEGLCVCSDDEHCAPEQGYFCRPGKVYADARVCVFERRTRLVDEL

SEQ ID NO: 18630 - DNA, 1509 bp, Sorghum bicolor
  misc_feature: Ceres ANNOT ID no. 8704042
  misc_feature: Up-regulated in root tissues in response to methyl jasmonate treatment
  misc_feature: Encodes the peptide sequence at SEQ ID NO 18631
atggagcagccccggagcaggctgctcagcgtctgcgccgtcgtcctgctcctcctcctcctcctcgccccgggcctcgccgccgccttcaactacgccgacgcgctcgccaagtccatcatctacttcgagggccagcgctccggcaagctgccccccggcaaccgcatgccctggcgcggcgactccggcctcaccgacggcgcccagcacaacgtggatctggtgggcggctactacgacgccggcgacaacatgaagttcggcctcccaatggcgttcaccacaacaatgctcgcatggagcgtagccgacttcggcaagtacatgggcgccaacctcccgcacgcccgcgccgccgtgcgctggggcgccgactacctcctcaaggccgcgacctccaccccggggacactctacgtccaggtaggcgacccggcgcaggaccacaagtgctgggagcggccggaggacatggacacgccgcgggcggtctacgccgtcacctcctccaaccccggttccgacgtggccgccgagacggcggcggcgttagccgcctccgccgtcgcgttccgccgcgccgacccggggtacgcggcgcgtctcctcggcgccgccgtggtggcgttcgagctcgcggaccggcaccggggttcgtacagccagggcacgctcagcgccgcggtgtgtccgttctactgctcctactccgggtacgacgacgagctgctgtgggcggccgcgtggctgcaccgcgcgtccgggaacgcgacgttcatggcgtacgtgagagccaacggcgtccaggacggcgctgggaacgacgactacagcttcagctgggacgacaagcggatcggcaccaaggtcctgctggcgagaggggtgctccggcgagacaggagacggaacgtccccgggctgcagctgtacaaggcgcactccgacagctacgtctgctcgctggtgcccggcgccgccgggttccaggccgggcagtacactcccggcgggctcatctacagggaaggcggcagcaacatgcagtacgtgacgacgacgacgttcctgctgctcgcgtacgcgaaatacctccggtcagccggcggcaatgtggcgtgcggtggcggaggagaggtggcgccggcggagctggtggcgctggcgaagaggcaggtggactatatcctggggaagaaccccgcggggacgtcgttcatggtggggtttggggaaaggtacccgcgccggctgcaccaccgcggcgcgtcgttgccgtcggtgcgcgcgcacccggcgcggatcgggtgcgaccaggggttcgcgtacctgcactcggcggcgcccgacgccaacctgctggtgggcgccgtcgtgggtggccccgacgcgcgggacgggttcgtcgacgaccgcgatagctacggacagactgagcccgccacctacatcaacgcgccgctcgtcggcgttctcgcgtacttcgccggcaccgccaagctctga

SEQ ID NO: 18631 - protein, 502 aa, Sorghum bicolor
  misc_feature: Useful for making plants with altered carbohydrate content
  misc_feature: Functional homolog of the protein sequence given in SEQ ID NO 13691
  misc_feature: Useful for making plants with altered cell wall content and/or composition
  misc_feature: Functional homolog of the protein sequence given in SEQ ID NO 14653
  misc_feature: Useful for biocontainment applications
  misc_feature: Useful for making plants with modulated nitrogen use efficiency
  misc_feature: Functional homolog of the protein sequence given in SEQ ID NO 13445
  misc_feature: Ceres ANNOT ID no. 8704042
  misc_feature (38)..(501): SWISSPROT Homolog: EC 3.2.1.4 Cellulase
  misc_feature (31)..(494): Pfam ID: Glyco_hydro_9 Pfam Description: Glycosyl hydrolase family 9
MEQPRSRLLSVCAVVLLLLLLLAPGLAAAFNYADALAKSIIYFEGQRSGKLPPGNRMPWRGDSGLTDGAQHNVDLVGGYYDAGDNMKFGLPMAFTTTMLAWSVADFGKYMGANLPHARAAVRWGADYLLKAATSTPGTLYVQVGDPAQDHKCWERPEDMDTPRAVYAVTSSNPGSDVAAETAAALAASAVAFRRADPGYAARLLGAAVVAFELADRHRGSYSQGTLSAAVCPFYCSYSGYDDELLWAAAWLHRASGNATFMAYVRANGVQDGAGNDDYSFSWDDKRIGTKVLLARGVLRRDRRRNVPGLQLYKAHSDSYVCSLVPGAAGFQAGQYTPGGLIYREGGSNMQYVTTTTFLLLAYAKYLRSAGGNVACGGGGEVAPAELVALAKRQVDYILGKNPAGTSFMVGFGERYPRRLHHRGASLPSVRAHPARIGCDQGFAYLHSAAPDANLLVGAVVGGPDARDGFVDDRDSYGQTEPATYINAPLVGVLAYFAGTAKL

SEQ ID NO: 18632 - DNA, 1047 bp, Sorghum bicolor
  misc_feature: Ceres ANNOT ID no. 8704073
  misc_feature: Encodes the peptide sequence at SEQ ID NO 18633
atggccgtcgtcgaggccgccgccgccgtggaccacgccgcgccgccgcgccatgaggaggaggaggaggaggcgccgggcaccggcgctgccgccgccgacgcggccggggagcgcgagatgcgggatctggaggacctcctctccaagctcaaccccatggccgaggagttcgtcccgccctccctcacctcccccgtggccgtcgccgtcggcgccgggccgggcccggggcccctcacgcccgcgccgctctcccccgccgcctacggcttctacccggccgctaacgccggtttcgcggtcgcctcgccggcggcccaccgcggcgtcgtcggattcccggccgccgtcgccgacgccgcccacgccggacgcggcaggaagaagggcggagccggaggagggttcggcggccacggccaccccggcaggcggcggaccaacagccgcaccagcatggcgcagcgcgacgaggtcatccgccgcaccgtctacgtctccgacatcgatcatcaggttactgaagaaaacctggcagcactatttataaactgcggacaggttgtggactgtcgcatgtgtggggacccaaactcagtccttcggtttgccttcatagagttcactgatgaggagggtgcaagggctgctctgaatctgtcaggaactgttcttggatattatcctgtcagggttctgccatcaaaaactgccattgcaccagttaacccaacattcctacccaggtctgatgatgaacgtgaaatgtgtgcaaggactatttactgcacaaacattgacaagaaggtcactcaggcagacctgaaattgttctttgagtccatatgtggagaggtctttcgactgaggttgcttggtgactaccatcattctactcgcatcgcttttgtggaatttgtgatggctgaaagtgctactgctgctctcaactgcagtggtgtgatactgggatccttgccaataagggtgagcccgtcaaagactcccgtgcgtccccgcgcgcctcgccagctgatgcactag

SEQ ID NO: 18633 - protein, 348 aa, Sorghum bicolor
  misc_feature: The sequence is a functional homolog of SEQ ID NO 1301 in the 10/666,642 US patent application
  misc_feature: Ceres ANNOT ID no. 8704073
  misc_feature: Down-regulated in shoot tissues in response to salicylic acid treatment
  misc_feature (165)..(233): Pfam ID: RRM_1 Pfam Description: RNA recognition motif. (a.k.a. RRM, RBD, or RNP domain)
  misc_feature (262)..(331): Pfam ID: RRM_1 Pfam Description: RNA recognition motif. (a.k.a. RRM, RBD, or RNP domain)
  misc_feature (46)..(63): Pfam ID: PAM2 Pfam Description: Ataxin-2 C-terminal region
MAVVEAAAAVDHAAPPRHEEEEEEAPGTGAAAADAAGEREMRDLEDLLSKLNPMAEEFVPPSLTSPVAVAVGAGPGPGPLTPAPLSPAAYGFYPAANAGFAVASPAAHRGVVGFPAAVADAAHAGRGRKKGGAGGGFGGHGHPGRRRTNSRTSMAQRDEVIRRTVYVSDIDHQVTEENLAALFINCGQVVDCRMCGDPNSVLRFAFIEFTDEEGARAALNLSGTVLGYYPVRVLPSKTAIAPVNPTFLPRSDDEREMCARTIYCTNIDKKVTQADLKLFFESICGEVFRLRLLGDYHHSTRIAFVEFVMAESATAALNCSGVILGSLPIRVSPSKTPVRPRAPRQLMH

SEQ ID NO: 18634 - DNA, 1155 bp, Sorghum bicolor
  misc_feature: Ceres ANNOT ID no. 8704080
  misc_feature: Down-regulated in shoot tissues in response to salicylic acid treatment
  misc_feature: Encodes the peptide sequence at SEQ ID NO 18635
atggctgcggcggcgctgaggccgcacaaggcttcgccggcgcgcgtgcccacgcggtgtgtcgccgcgctctgcgccgcctgcttcatcctcggcgtctgcgtcgtcaacaggtactgggctgttcctgagcatcccggttgcccagacaaggcaggctctgaccgctcgagggccgcgttggaccaagtgtcacagactcgcgaagtcgtcatggcgttggataagacgatatctgacatcgagatgcgcctggctgcggctagagccgcgcaggcgatgagccagggcatgtcaccgggcgactcggagagcgaccagggaactgcgcggcataggatgtcttttgtcatgggcgttttcaccacttttgcaaaccggaagcggagagattcaataaggcagacatggatgccgcaaggtgatcagttgcgaatattggaagagaagggcgttgttatccgttttgttattggacgcagtgcaaatccaaacccggataacgaggtcgaccgtgcaattgatgcagaagataaagaatacaatgatatcttgagaattgatcatgtggaaggctatggagggcttcctatgaagattcagatgtttctttcaactgctcttaccatgtgggatgctgatttctatgtaaaagctgatgataatgtttatgtcaacattggtatcaccagatcgcttttggcgcgacacagggcgaaacctcgggtgtacattggctgcatgaagtctggacccgttattgctaaaaatgactccaagtattatgaaccagatcattggaaatttgggactgagggtaacaactactttaggcatgcaacacggcagctgtatgctgtaaccagggatttggcaacttacatatcagccaaccggcatatcctgcacaagtattcaaacgaagatgtatcatttggctcttggttgattggattggaagtcgagcatgtcgatgagagaagcctttgctgtggtactcccccagactgcgaatggaaagcacaggccgggaacccatgtgcagcgtccttcgactggaactgcactggcatctgcaatccggtggagaggatgacagaggtgcaccggcgatgttgggaaggcattggagccgaagggcacacacagttttga

SEQ ID NO: 18635 - protein, 384 aa, Sorghum bicolor
  misc_feature: Useful for making plants with altered carbohydrate content
  misc_feature: Functional homolog of the protein sequence given in SEQ ID NO 13812
  misc_feature: Ceres ANNOT ID no. 8704080
  misc_feature (99)..(327): SWISSPROT Homolog: EC 2.4.1.134 Galactosylxylosylprotein 3-beta-galactosyltransferase
  misc_feature (128)..(327): Pfam ID: Galactosyl_T Pfam Description: Galactosyltransferase
MAAAALRPHKASPARVPTRCVAALCAACFILGVCVVNRYWAVPEHPGCPDKAGSDRSRAALDQVSQTREVVMALDKTISDIEMRLAAARAAQAMSQGMSPGDSESDQGTARHRMSFVMGVFTTFANRKRRDSIRQTWMPQGDQLRILEEKGVVIRFVIGRSANPNPDNEVDRAIDAEDKEYNDILRIDHVEGYGGLPMKIQMFLSTALTMWDADFYVKADDNVYVNIGITRSLLARHRAKPRVYIGCMKSGPVIAKNDSKYYEPDHWKFGTEGNNYFRHATRQLYAVTRDLATYISANRHILHKYSNEDVSFGSWLIGLEVEHVDERSLCCGTPPDCEWKAQAGNPCAASFDWNCTGICNPVERMTEVHRRCWEGIGAEGHTQF

SEQ ID NO: 18636 - DNA, 783 bp, Sorghum bicolor
  misc_feature: Ceres ANNOT ID no. 8704104
  misc_feature: Encodes the peptide sequence at SEQ ID NO 18637
atggggaaacgtttcctccaccagctggtactcgccgtcgccgttgcgctcttcgtctctccggtgagatcgggcgactggcttccggccaccgccacgttctacggcggtgctgacggctccgacacaatgggtggcgcgtgtgggtacagcgacctgtacgagcagggctacggcatcaacaacgccgcgctgagcacggcgctcttcaacgacggcgcgtcgtgcgggcagtgctacgtcatcatctgcgacagcagcaagacccagtggtgcaagcccggcaacaactgggtcgtcgtctccgccaccaacttctgcccgcccaactgggacctccccgccgtcggagacctccccgccggcggctggtgcgccccgccacggccccacttcgacatgtcccagcccgcctgggagaacatcggcatctacagcgccggcgtcatcaacgtcctctaccagcgagtgaagtgctggaagagcggcggcgtgcgcttcaccatggccggcttcaacggcttctacatggtgctcgtcaccaacgtcgccggcagcggctccatccagagcatggcggtgaagggcaacaacacggattggatccccatgtacaggaactggggcgccaactggcactgcctctccggcgggctcgtcggacagggcctcagcttcgcgctcgtctccaccggcggccagaacctcgtcttcaaggacgtcgtgccggcgtggtggcagttcggacaaacttacaccacctaccagaatttcgactactaa

SEQ ID NO: 18637 - protein, 260 aa, Sorghum bicolor
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 14248
  misc_feature: Useful for making plants with altered lignin content
  misc_feature: Functional homolog of the protein sequence given in SEQ ID NO 12888
  misc_feature: Ceres ANNOT ID no. 8704104
  misc_feature (165)..(243): Pfam ID: Pollen_allerg_1 Pfam Description: Pollen allergen
  misc_feature (62)..(154): Pfam ID: DPBB_1 Pfam Description: Rare lipoprotein A (RlpA)-like double-psi beta-barrel
MGKRFLHQLVLAVAVALFVSPVRSGDWLPATATFYGGADGSDTMGGACGYSDLYEQGYGINNAALSTALFNDGASCGQCYVIICDSSKTQWCKPGNNWVVVSATNFCPPNWDLPAVGDLPAGGWCAPPRPHFDMSQPAWENIGIYSAGVINVLYQRVKCWKSGGVRFTMAGFNGFYMVLVTNVAGSGSIQSMAVKGNNTDWIPMYRNWGANWHCLSGGLVGQGLSFALVSTGGQNLVFKDVVPAWWQFGQTYTTYQNFDY

SEQ ID NO: 18638 - DNA, 1182 bp, Sorghum bicolor
  misc_feature: Ceres ANNOT ID no. 8704111
  misc_feature: Encodes the peptide sequence at SEQ ID NO 18639
atggaggccaagccggtggaagcgagtgccgcgcctgctcctgcgcctccgcctatggcggtagcaccggttacggcggcgccaccagaggcgacggtgagcttccagcaggcggcgccggcggcggagatgggtagctcgagcgccgtcctggtgccgcctctagctacggcggcggcggtggcgggaggaggaggcggcgccatggcgctggggccggtgctgatgaaggtgccgaagaagcgcgggaggccgcgcaagtacgggccggacgggagcctgatccgcccgctcaacgccacgccgatctcggcgtccgcgcccatgcccaccgccgtggcgcccgggcagtacacgcccgcctccgcggtgggcgccgccatgaagcgcggcaggggacggcccctcgacttcgccgccgccgccgccaagcagcagcagcagcagcaacaacaccatcaccagcaccaccacctccagcaccaccaacaccagcagccgcagcagcagttcggcttccacttcaactccataggtgacatggtggcatgttctgctggtgcaaatttcactccgcatataattaccgtcgctcctggtgaggatgtgacgatgaaggttatatcattttcgcaacaaggaccacgagctatctgtattctctcagcaaacggcgttatatcgaacgttacacttcgtcagcctgattcctctggtggcacgctaacttatgagggacgctttgagttgctgtccttgtctgggtcctttatgccaactgaaaacaacggaacacgaagtcggtcaggtgggatgagcgtgtctcttgcaagcccagacggtcgtgttgtcggtggaggagttgccggcctgctggtggcagcaagtcctgttcagattgtggttgggagtttcctgccaagctaccagatggagcagaagaacaagaagccacgggtggatgcggcacctgccaccgtcccacagacgcctcctgctgtcccaatctcgagcacggacacccacagcagcgagcaagggcagcaggcccagagagggatgacctcaacaggagcctacggcgcggaccagagctgggcatcctctgcgcagcagccgatggccgaggtgtccaggacgccgtcatccggggacctgaagatgactgcgtctggatcatga

SEQ ID NO: 18639 - protein, 393 aa, Sorghum bicolor
  misc_feature: The sequence is a functional homolog of SEQ ID NO 1507 in the 11/479,226 US patent application
  misc_feature: Ceres ANNOT ID no. 8704111
MEAKPVEASAAPAPAPPPMAVAPVTAAPPEATVSFQQAAPAAEMGSSSAVLVPPLATAAAVAGGGGGAMALGPVLMKVPKKRGRPRKYGPDGSLIRPLNATPISASAPMPTAVAPGQYTPASAVGAAMKRGRGRPLDFAAAAAKQQQQQQQHHHQHHHLQHHQHQQPQQQFGFHFNSIGDMVACSAGANFTPHIITVAPGEDVTMKVISFSQQGPRAICILSANGVISNVTLRQPDSSGGTLTYEGRFELLSLSGSFMPTENNGTRSRSGGMSVSLASPDGRVVGGGVAGLLVAASPVQIVVGSFLPSYQMEQKNKKPRVDAAPATVPQTPPAVPISSTDTHSSEQGQQAQRGMTSTGAYGADQSWASSAQQPMAEVSRTPSSGDLKMTASGS

SEQ ID NO: 18640 - DNA, 783 bp, Sorghum bicolor; identical to SEQ ID NO: 18636
  misc_feature: Ceres ANNOT ID no. 8704107
  misc_feature: Encodes the peptide sequence at SEQ ID NO 18641

SEQ ID NO: 18641 - protein, 260 aa, Sorghum bicolor; identical to SEQ ID NO: 18637
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 14248
  misc_feature: Useful for making plants with altered lignin content
  misc_feature: Functional homolog of the protein sequence given in SEQ ID NO 12888
  misc_feature: Ceres ANNOT ID no. 8704107
  misc_feature (165)..(243): Pfam ID: Pollen_allerg_1 Pfam Description: Pollen allergen
  misc_feature (62)..(154): Pfam ID: DPBB_1 Pfam Description: Rare lipoprotein A (RlpA)-like double-psi beta-barrel

SEQ ID NO: 18642 - DNA, 1554 bp, Sorghum bicolor
  misc_feature: Ceres ANNOT ID no. 8704119
  misc_feature: Encodes the peptide sequence at SEQ ID NO 18643
atggaaaggggcggcgagcaccaccaccacccgcttagcgtattcctccgggacgcgaggctcgccttcagatgggacgagctcgggcaggagatcatgaagatcgcggtgcccggcgcgctcgcgctcatggctgacccagtcgcctccctcgtcgacaccgccttcattggccacataggtcccgttgaacttggagctgtaggtgtatcaattgctgtgtttaatcaagtctcaagaattgcagtgttcccccttgttagtgtcacaacatcatttgttgctgaggaggatgctatgtccaattgcagagacaatgacaaaataaatcaagaaaacgaatgcagtgtttctgttagcgaaatggaggaactaatttctcctgaaggtgctagtgccactaccagcatatcatcttttgaaactgattcatgtgaggtcagtgttgagcaaaagaggaaaaatattccatcagtctctacagcactattacttggtggggttcttggcctacttgaaaccgtactgcttgttttctctgcaaaacctatcttaggctacatgggtgtcacaccggcttttccccataagcagttgcctattttccaacaggattctgctatgatgaagcccgcattgcagtacttggttctcagatctcttggtgctcctgctgtcctgttatctctggcaacacaaggagtctttcgcggatttaaggatacaaagacgcctctatatgcaactgtggctggagatgcaatcaatatagttttggatccaatatttatctttgtcttccaatatggtgttagtggtgccgccattgctcatgttatatcacaatatttcattgcatccatactcttatggaggttaaggctgcatgttgatttgttgccacctagctttaaacatctgcagtttggccggtttcttaaaaatggttttctgttacttgcacgagttattgccgcaacattttgtgtgacactatctgcgtcaatggctgcacgacaaggttcaactccaatggctgcattccagatctgcttgcaaacctggttggcttgctcacttcttgctgatggattggcttttgctggacaggccatacttgcaagtgcatttgctcgtaaggactatccaaaggctactgccacagcttctcgtatcttgcagctggctttggtcctgggacttatcctaagcatacttcttggtattggtctgcgcataggatctagattatttacatctgatcagggtgtactgcatcatatctacataggaataccgtttgtctgtcttactcaaccaatcaatgctttggcttttgtttttgatggtatcaattatggagcatcagattttggatatgctgcctattcaatggtccttgttgctattgtcagtatcatttgcatcctcactcttgaaagttatagtgggtttattggaatctggatagctttggtgatctacatgagcctccggatgtttgctggattttggaggctttctcatgcacctcaccacgtcactaagcgctag

SEQ ID NO: 18643 - protein, 517 aa, Sorghum bicolor
  misc_feature: The sequence is a functional homolog of SEQ ID NO 3 in US patent 7189891
  misc_feature: The sequence is a functional homolog of SEQ ID NO 6 in US patent 7189891
  misc_feature: Ceres ANNOT ID no. 8704119
  misc_feature (319)..(478): Pfam ID: MatE Pfam Description: MatE
  misc_feature (38)..(262): Pfam ID: MatE Pfam Description: MatE
MERGGEHHHHPLSVFLRDARLAFRWDELGQEIMKIAVPGALALMADPVASLVDTAFIGHIGPVELGAVGVSIAVFNQVSRIAVFPLVSVTTSFVAEEDAMSNCRDNDKINQENECSVSVSEMEELISPEGASATTSISSFETDSCEVSVEQKRKNIPSVSTALLLGGVLGLLETVLLVFSAKPILGYMGVTPAFPHKQLPIFQQDSAMMKPALQYLVLRSLGAPAVLLSLATQGVFRGFKDTKTPLYATVAGDAINIVLDPIFIFVFQYGVSGAAIAHVISQYFIASILLWRLRLHVDLLPPSFKHLQFGRFLKNGFLLLARVIAATFCVTLSASMAARQGSTPMAAFQICLQTWLACSLLADGLAFAGQAILASAFARKDYPKATATASRILQLALVLGLILSILLGIGLRIGSRLFTSDQGVLHHIYIGIPFVCLTQPINALAFVFDGINYGASDFGYAAYSMVLVAIVSIICILTLESYSGFIGIWIALVIYMSLRMFAGFWRLSHAPHHVTKR

SEQ ID NO: 18644 - DNA, 1773 bp, Sorghum bicolor
  misc_feature: Ceres ANNOT ID no. 8704145
  misc_feature: Encodes the peptide sequence at SEQ ID NO 18645
atgtcgcagcaaccggaagacgatgtcgatgactttgatcctatggaggtctacaccatggaagacttcatggaagaagacacaatcttagatgctatctttgaagaaatcttagaagaatttagaagggagctgggagaggagttgaaggccaacatcgatggcgaatcatcaactgtaaatcgccgtcacggtcgacatagtagatcaaggagggtgcagattaggcacccccaagttaatcgacgtcctagatctcagccctgcacgagcacggcgaaagcctcccttccccccaacctccccaacccaaacaaacccaggcgaatcgccgcggcccgcaagcgcaaacgcatcctcaaaccccagcgagccgagcccacgcggacgcggaaccccaacacctctcggcggccgccgcggaaaagaagaaaggcggccacgacggcggaggcggcagcttcagcgagggcgacggcgctgatggagtccctggaggcgctcgtggcgcacatccagggcctatccggcagccccgaggaggtggcgcacctccacagcctcctcaagcaggcggacggcgactccctgcgcgcccacgccgccgcgctgcttcccttcctcgcgcacctcagccccgagacccactccctcggctacctctacctcctggaggcgtgcgcgacctccggttccaatctgagcgacttcggcggcggggacttcctggtcaccatcgccggcttcctcaccgcgtgctcggcggaccagatacgcctggcgcccgacaaattcctgaatgtgtgtagggtgctcaaggatcaggtgatgcagctcaacatgcctatcagagggatcgccccgctgcgggcggcggtccgtaagatccagtcttcgcccgagcagctgactccactccacgcggactaccttctcctgtgcctgctggcgaagcagtacaaggctggactcagcgtcctggaagatgacatattcgaagtcgatcagccaaaggacctgttcctctattgctactacggagggatgatttacattgggctcaagaagtttcctaaagctttggagcttcttcacaatgctgttactgctccaatgtcaatgctgaacgcgattgctatagaagcttacaagaagtatgtcctagtttcactcattgtgaatggacaggtcccatcatttcctaagtatacatccgtatcaggtcaaaggagtatgaaaattcacgcccagatttatgttgagctatctacaagctatagcaacggtcgctacactgatttagagatatttgtccaagcaaattcggcaacatttcaatctgacaacaacctagggctggtgaagcaagtgctctcctcgatgtacaaacggaacatccaaaggctgacccagacttatttaactctttcacttgaagatattgctaggtctgttcaacttgaaacaccaagggatgctgaaatgcatgtacttcgcatgatcgaagatggagagatccatgcaaccataaaccagaaggatggaatggtcagctttcatgaagatcctgaacaatataaaagtgtcgagatggtggagcatattgactcgtctatccagagattgacggcattgtccaagaagttggcttcaattgatgagaacatgtcatgtgatcctgcatatttgatgaagacgggaagggatcgtggaagattcgatggaagattcgactacgatgactatgactctgttccgcacaagtttttttga

SEQ ID NO: 18645 - protein, 590 aa, Sorghum bicolor
  misc_feature: Useful for making plants with modulated light quality sensitivity
  misc_feature: Useful for making plants with modulated low light sensitivity
  misc_feature: Functional homolog of the protein sequence given in SEQ ID NO 13381
  misc_feature: Ceres ANNOT ID no. 8704145
  misc_feature (417)..(521): Pfam ID: PCI Pfam Description: PCI domain
MSQQPEDDVDDFDPMEVYTMEDFMEEDTILDAIFEEILEEFRRELGEELKANIDGESSTVNRRHGRHSRSRRVQIRHPQVNRRPRSQPCTSTAKASLPPNLPNPNKPRRIAAARKRKRILKPQRAEPTRTRNPNTSRRPPRKRRKAATTAEAAASARATALMESLEALVAHIQGLSGSPEEVAHLHSLLKQADGDSLRAHAAALLPFLAHLSPETHSLGYLYLLEACATSGSNLSDFGGGDFLVTIAGFLTACSADQIRLAPDKFLNVCRVLKDQVMQLNMPIRGIAPLRAAVRKIQSSPEQLTPLHADYLLLCLLAKQYKAGLSVLEDDIFEVDQPKDLFLYCYYGGMIYIGLKKFPKALELLHNAVTAPMSMLNAIAIEAYKKYVLVSLIVNGQVPSFPKYTSVSGQRSMKIHAQIYVELSTSYSNGRYTDLEIFVQANSATFQSDNNLGLVKQVLSSMYKRNIQRLTQTYLTLSLEDIARSVQLETPRDAEMHVLRMIEDGEIHATINQKDGMVSFHEDPEQYKSVEMVEHIDSSIQRLTALSKKLASIDENMSCDPAYLMKTGRDRGRFDGRFDYDDYDSVPHKFF

SEQ ID NO: 18646 - DNA, 306 bp, Sorghum bicolor
  misc_feature: Ceres ANNOT ID no. 8704122
  misc_feature: Encodes the peptide sequence at SEQ ID NO 18647
atggcgggaaagctggggcagctgatgacgaggctgcacctggcgcggagccgatcgccggcgtcggcagcggcggacgtgccacggggccacctggcggtgtacgtcggcgaggggcggaagcggctggtgatcccgacggcgtgcctgagccacccggcgttcgtgacgctgctgaagcgggtggaggacgagttcggcttcgaccaccgctgcggcggcctcaccatcccctgcgcgtcggaaggcgacttcgccgacatcatcgccgccgctgtggacgagcaccaccaccaccaccgatga

SEQ ID NO: 18647 - protein, 101 aa, Sorghum bicolor
  misc_feature: Useful for making plants with modulated cold sensitivity
  misc_feature: Functional homolog of the protein sequence given in SEQ ID NO 13454
  misc_feature: Useful for making plants with modulated salt sensitivity
  misc_feature: Functional homolog of the protein sequence given in SEQ ID NO 13813
  misc_feature: Useful for making plants with modulated nitrogen use efficiency
  misc_feature: Functional homolog of the protein sequence given in SEQ ID NO 13811
  misc_feature: Useful for making plants with altered protein content
  misc_feature: Functional homolog of the protein sequence given in SEQ ID NO 14654
  misc_feature: Useful for making plants with modulated biomass
  misc_feature: Functional homolog of the protein sequence given in SEQ ID NO 14655
  misc_feature: Ceres ANNOT ID no. 8704122
  misc_feature (1)..(93): Pfam ID: Auxin_inducible Pfam Description: Auxin responsive protein
MAGKLGQLMTRLHLARSRSPASAAADVPRGHLAVYVGEGRKRLVIPTACLSHPAFVTLLKRVEDEFGFDHRCGGLTIPCASEGDFADIIAAAVDEHHHHHR

SEQ ID NO: 18648 - DNA, 1059 bp, Sorghum bicolor
  misc_feature: Ceres ANNOT ID no. 8704155
  misc_feature: Encodes the peptide sequence at SEQ ID NO 18649
atggccgccgccgccctgctccgccgctcgtcggcggcgcgcacgctcctctctccggccctctcgtcccgcctcgtcgcgtccaagccccactcctcctcccccgcgccgcctccgcctccgccggcggcgaaggcagcggccaacacgaagacgttctcgatctaccggtgggacccggactcgccgtcgacgaagccgcacctcaaggactaccaggtggacctgtccgactgcgggccgatggtgctggacgcgctgctcaagatcaagaacgagcaggacccgtcgctcactttccgccgcagctgccgggagggcatctgcgggagctgcgccatgaacatcgacggcgacaacggcctcgcctgcctcaccaagatctcctccgcgtcatctgcgtccacggtctcgccgctgccccacatgttcgtcatcaaggacctggtggtggacatgaccaacttctacagccagtacaagagcgtcgagccgtggctcaagcgcaaggacccgccgccgcagcagggcaaggagatcccgcagaccaaggccgatcgtgccaagctcgatggcatgtacgagtgcatcctctgcgcctgctgctccacatcctgcccatcctactggtggaaccccgaggagtacctcggccctgccgcgctgctccacgccaacaggcttccgctgtgggggacgcttatcaaaccaaaacccaacatgttcatgcaccttcaagctcgaggatatcatggggtgtcagagaagagaaacctgcgggaccacaaacgtagattgcttgcagaaaaatatgagctgaggggaaagctgtataaggctgtctgtagggaccctgatcttccattggatatgcgggagaagttccgctataagttgtccaagttgccaagaaatagctccatgacacgccttagaaaccgctgcattttcacaggccggtctcgcgctgtgtacaagaaattccgcatgtcccgtattgtgttccgcacattggcaaacaagggtgaactgacgggcgtaaagaaagcatcatggtag

SEQ ID NO: 18649 - protein, 352 aa, Sorghum bicolor
  misc_feature: Useful for making plants with modulated biomass
  misc_feature: Functional homolog of the protein sequence given in SEQ ID NO 14304
  misc_feature: Ceres ANNOT ID no. 8704155
  misc_feature (51)..(227): SWISSPROT Homolog: EC 1.3.5.1 Succinate dehydrogenase (ubiquinone)
  misc_feature (297)..(351): Pfam ID: Ribosomal_S14 Pfam Description: Ribosomal protein S14p/S29e
  misc_feature (65)..(130): Pfam ID: Fer2 Pfam Description: 2Fe-2S iron-sulfur cluster binding domain
MAAAALLRRSSAARTLLSPALSSRLVASKPHSSSPAPPPPPPAAKAAANTKTFSIYRWDPDSPSTKPHLKDYQVDLSDCGPMVLDALLKIKNEQDPSLTFRRSCREGICGSCAMNIDGDNGLACLTKISSASSASTVSPLPHMFVIKDLVVDMTNFYSQYKSVEPWLKRKDPPPQQGKEIPQTKADRAKLDGMYECILCACCSTSCPSYWWNPEEYLGPAALLHANRLPLWGTLIKPKPNMFMHLQARGYHGVSEKRNLRDHKRRLLAEKYELRGKLYKAVCRDPDLPLDMREKFRYKLSKLPRNSSMTRLRNRCIFTGRSRAVYKKFRMSRIVFRTLANKGELTGVKKASW

SEQ ID NO: 18650 - DNA, 873 bp, Sorghum bicolor
  misc_feature: Ceres ANNOT ID no. 8704142
  misc_feature: Encodes the peptide sequence at SEQ ID NO 18651
atggcggcggcggcggcgcagcagaagatccggtggggggagctagaggaggacgacggaggggacctcgacttcctcctcccgccgcgggtcgtggtcgggcccgacgagaacgggctcaagaaggtgatcgagtaccgcttcgacgacgacggcaacaaggtcagggtcaccaccaccacccgcgtccgcaagctcgcgcgggcgcgcctctcccgcagcgccatcgagcgccgccagtggcccaagttcggcgacgccctcaaggaggacgccggctccaggctcaccatggtctccaccgaggagatcctcctcgagcgaccccgcgcaccagggagcaaagctgaggaaccagctgcatccggtgacccactggctatggcgagcaagggaggtgctgttctcatggtttgcagaacctgtgggaagaagggcgatcactggacctcaaagtgtccctacaaggaccttgcaccaccgactgaaactttcacggacaggcctcctacgtccgatggccctcctgcaccaggcggtcctgtgaagggagcatatgtgcccccaaccatgagaggtggtgctgataggaccggagacgtgatgcgccgcaggaacgacgagaattccgtccgtgtcaccaatctctcggaggacacccgtgagcctgacctccttgagctcttccgtgcgtttggccctgtcagccgtgtctacgtcgcggtggatcagaagactgggtcgagcagggggtttgggtttgtcaactttgttcacagagaggacgcggagaaggcgatcagcaagctcaatgggtatggttatgataaccttatcctccgagtcgagtgggcgacgccaaggcccaactag

SEQ ID NO: 18651 - protein, 290 aa, Sorghum bicolor
  misc_feature: Useful for making plants with altered alkaloid content
  misc_feature: Functional homolog of the protein sequence given in SEQ ID NO 14575
  misc_feature: Ceres ANNOT ID no. 8704142
  misc_feature (208)..(285): SWISSPROT Homolog: EC 5.2.1.8 Peptidylprolyl isomerase
  misc_feature (211)..(282): Pfam ID: RRM_1 Pfam Description: RNA recognition motif. (a.k.a. RRM, RBD, or RNP domain)
MAAAAAQQKIRWGELEEDDGGDLDFLLPPRVVVGPDENGLKKVIEYRFDDDGNKVRVTTTTRVRKLARARLSRSAIERRQWPKFGDALKEDAGSRLTMVSTEEILLERPRAPGSKAEEPAASGDPLAMASKGGAVLMVCRTCGKKGDHWTSKCPYKDLAPPTETFTDRPPTSDGPPAPGGPVKGAYVPPTMRGGADRTGDVMRRRNDENSVRVTNLSEDTREPDLLELFRAFGPVSRVYVAVDQKTGSSRGFGFVNFVHREDAEKAISKLNGYGYDNLILRVEWATPRPN

SEQ ID NO: 18652 - DNA, 837 bp, Sorghum bicolor
  misc_feature: Ceres ANNOT ID no. 8704147
  misc_feature: Encodes the peptide sequence at SEQ ID NO 18653
atggccgccgccgctgactcctctaagcccgcgcgcgccgccgtgctccccgcccgcccgctcctcctcgcgctccccttcctctccctcctcctcttgctgtacgtctactccacctcctcccgccctgtcctctccgcaacagccgtcgctgcctccaccaccaccaccaccgtcgtgccgctgaccccatccccgccgaccccacacatccggatgcggcgttcccggtacgcctcctacgacgactacctccgtcaccagctcaacaagacgctggacccgcgcctccgccgggtctgggcgacccgtgactggcaacggaaggtggacgccttcgcgcggctcttcacgggtctgcgcgacgagggcctcctctccaccacctcccgcgcgctctgcgtcggcgcgcggctaggccaggaggtcgccgcgctgcggcaggtgggcgtccgcgacgcgctcggcatcgacctcgcgcccgcgccgccgctcgtcgcgcgcggggacttccacaaccagccgttcgacaacgacaccttcgacttcgagttctccaacgtcttcgaccacgcgctgtacccggaccggttcgccgccgaggtcgagcgtaccctgcgccccgggggtgtcgcggtgctccacgtcgccgtgcaccgccgtggggataagtactctgccaatgacttgcttgatgtgcgcggcctcgttgggttgttcccaaggtgcgacgttgtgagggtgtcgaaggttgatgcgttcgggctcgacaccgaggtcatcctccgcaagaagaggccgtcgtctcgtcgtcgtcgtcgtcggcggcggctctag

SEQ ID NO: 18653 - protein, 278 aa, Sorghum bicolor
  misc_feature: Useful for making plants with modulated biomass
  misc_feature: Functional homolog of the protein sequence given in SEQ ID NO 14656
  misc_feature: Ceres ANNOT ID no. 8704147
  misc_feature (133)..(214): Pfam ID: Methyltransf_11 Pfam Description: Methyltransferase domain
MAAAADSSKPARAAVLPARPLLLALPFLSLLLLLYVYSTSSRPVLSATAVAASTTTTTVVPLTPSPPTPHIRMRRSRYASYDDYLRHQLNKTLDPRLRRVWATRDWQRKVDAFARLFTGLRDEGLLSTTSRALCVGARLGQEVAALRQVGVRDALGIDLAPAPPLVARGDFHNQPFDNDTFDFEFSNVFDHALYPDRFAAEVERTLRPGGVAVLHVAVHRRGDKYSANDLLDVRGLVGLFPRCDVVRVSKVDAFGLDTEVILRKKRPSSRRRRRRRRL

SEQ ID NO: 18654 - DNA, 1428 bp, Sorghum bicolor
  misc_feature: Ceres ANNOT ID no. 8704201
  misc_feature: Encodes the peptide sequence at SEQ ID NO 18655
atggggacgcaagcgccggagaattacccccctgaaaagtcggccgttgtggacttatggggcacattcgacatgtcattcgcctacaacttcatctttaaagaagtactggatgcaaggactgcacgggagaaggccatcgacgattggctcccaattacctcttcgaggaatgccaagtggtggtactctgctttccacaatgtcactgccatggttggtgctggcgtgctcagccttccctacgccatgtctgagctcggctggggtcctggcattgcagtgctgattgtgtcatggatcatcacgctctatacgctgtggcagatggttgagatgcacgagatggtaccaggcaagcggttcgacaggtaccacgagcttggtcagcatgcctttggcgagaagctgggcctgtggatcgtcgtgcctcagcagcttgttgtcgaggtcggcgtcaacatcgtctacatggtcaccggcggcaagtctctgaagaagttccacgacgtcctggtctgtgatgactcggggtgcgacagcaagcacaacatcaagaccacctacttcatcatgatctttgcctctgtccactttgtgctctctcagcttccaaacttcaactccatctctggtgtttcccttgccgccgccgtcatgtcacttagttactccacaatcgcttggggcgcatcagtggacaagggtaagcttccggatgtggactaccacctgcgtgcgacaacaacgccggggaaggttttcggtttctttggtgcattgggcgatgtggccttcgcgtatgcagggcacaatgtggttcttgagatccaggccactatcccatcgactccagagcagccatccaagaagcccatgtggaagggtgtcattgttgcttacattgtggttgcactatgctacttccctgttgcgctcatcggctactgggcttttggcaaagcagtcgatgacaacatcctcatcaccctcagcaaacctaagtggcttatcgccctggctaacatgatggttgtaatccatgtcattggcagctaccagatctatgccatgccagtgtttgacatgatagagactgtgctggtgaagaagctgcacttccctcctggtctgacactgcgtttgattgctcggaccgtctatgttgcgttcacaatgttcatagccatcaccttccccttcttcggtggattgcttggtttctttggtggtttcgcttttgcaccgacgacttatttcctgccctgcatcatgtggcttgcaatctacaagcccaaaaggttcagcctctcttggttgaccaactggatctgcattattcttggggtgcttctgatgattctatcgccaattggaggacttcggcaaataatattggatgcgaaaacatacaaattctaccagtaa

SEQ ID NO: 18655 - protein, 475 aa, Sorghum bicolor
  misc_feature: Useful for making plants with altered oil content
  misc_feature: Functional homolog of the protein sequence given in SEQ ID NO 13448
  misc_feature: Ceres ANNOT ID no. 8704201
  misc_feature: Up-regulated in shoot tissues in response to methyl jasmonate treatment
  misc_feature: Up-regulated in root tissues in response to aminocyclopropane carboxylic treatment
  misc_feature (57)..(462): Pfam ID: Aa_trans Pfam Description: Transmembrane amino acid transporter protein
MGTQAPENYPPEKSAVVDLWGTFDMSFAYNFIFKEVLDARTAREKAIDDWLPITSSRNAKWWYSAFHNVTAMVGAGVLSLPYAMSELGWGPGIAVLIVSWIITLYTLWQMVEMHEMVPGKRFDRYHELGQHAFGEKLGLWIVVPQQLVVEVGVNIVYMVTGGKSLKKFHDVLVCDDSGCDSKHNIKTTYFIMIFASVHFVLSQLPNFNSISGVSLAAAVMSLSYSTIAWGASVDKGKLPDVDYHLRATTTPGKVFGFFGALGDVAFAYAGHNVVLEIQATIPSTPEQPSKKPMWKGVIVAYIVVALCYFPVALIGYWAFGKAVDDNILITLSKPKWLIALANMMVVIHVIGSYQIYAMPVFDMIETVLVKKLHFPPGLTLRLIARTVYVAFTMFIAITFPFFGGLLGFFGGFAFAPTTYFLPCIMWLAIYKPKRFSLSWLTNWICIILGVLLMILSPIGGLRQIILDAKTYKFYQ

SEQ ID NO: 18656 - DNA, 1674 bp, Sorghum bicolor
  misc_feature: Ceres ANNOT ID no. 8704211
  misc_feature: Up-regulated in shoot tissues in response to methyl jasmonate treatment
  misc_feature: Up-regulated in root tissues in response to aminocyclopropane carboxylic treatment
  misc_feature: Encodes the peptide sequence at SEQ ID NO 18657
atggcgggtctcacccggaacgtccgatggggatcggacgccgggcttgactcccgatcccgggtcgtcggagcttccctttcctttcctttcaccggtgctccatataaagaagagacgagcttgtcccggacgccgcctccgctagctacctccctctccgttattgctcatgactctgctggcctcctctggctctctccctgccatggcatccaccgcaaactacaaactctgcagcttgccactgttgctgttccacccaaagggaggcgtagggcgtcagacgcgccgccggaaggggtgggccgctggagcgcgcaggagaagccgacgacggacgacgactggcttcccgtcaacgcgaggaggaacgccaagtggtggtacgccgccttccacaatgtcaccgccatggtcggcgccggcgttcttaccctcccctacgccatgtccgagctcggctggggcgtcggcgtcacggtgctgatcttgtcgtggatcatcacggtgtacacgctctggcagatggtggagatgcacgagtgcgtccccgggaagcggttcgaccggtaccacgagctggggcagcacgcgttcggcgagaagctgggcctctggatcgtggtgccgcagcagctggtggtggaggtggggctcaacatcgtgtacatgatcaccggcggccagtccctgcacaagttccacgacgtggtctgccatggccggtgcaaggacatcaagctccgctacttcatcatgatcttcgcctccgtccacttcgtgctctcccagctccccgacttccactccatctccagcgtctcgctcgccgccgccgtcatgtcggtcagctactcggcgatcgcgtggatcgcgtcggcggcgcacggagtgtcggccgacacggacgccgtcgccgactaccgcctgcgcgcgacgaccacgccggggaaggtgttcggcttcctgggtgcgctgggggacgtggcgttcacgtacgccgggcacaacgtggtgctggagatccaggcgaccatcccgtcggcgccggggaagccgtccaagaagcccatgtggaagggcgtcgtcgtcgcctacgtcatcatcgccgcgtgctacttgcccgtcgcgctcgtcggctactgggccttcggcaacgacgtcgacgagaacatcctcatcaccctcaaccggccgcgctggctcatcgccgccgccaacatgatggtcgtcgtccacgtcgtcggcagctaccaggtgtacgccatgccggtgttcgacatgatcgagaccgtgctggtgaggaagtactggttcaggccgggactcaggctccgtctcatttcccggactgtctatgttgcgctcacaatgttcgtggccatcaccttccccttcttcagtgaactgctcagtttcttcggcggattcgcatacgcaccgacaagctatttccttccctgcatcatgtggctcatcatctacaagcccagaaggttcagcctctcatggttcaccaactggatatgcattgttattggggtgctgctgatggtgctgtcaccgattggaggactcaggcagataattctgaaaatcaagacctacaaattctaccaagactaccctagtttaagccaggcgccatcatcagctaaaactagtttctga

SEQ ID NO: 18657 - protein, 557 aa, Sorghum bicolor
  misc_feature: Useful for making plants with altered oil content
  misc_feature: Functional homolog of the protein sequence given in SEQ ID NO 13448
  misc_feature: Ceres ANNOT ID no. 8704211
  misc_feature (124)..(528): Pfam ID: Aa_trans Pfam Description: Transmembrane amino acid transporter protein
MAGLTRNVRWGSDAGLDSRSRVVGASLSFPFTGAPYKEETSLSRTPPPLATSLSVIAHDSAGLLWLSPCHGIHRKLQTLQLATVAVPPKGRRRASDAPPEGVGRWSAQEKPTTDDDWLPVNARRNAKWWYAAFHNVTAMVGAGVLTLPYAMSELGWGVGVTVLILSWIITVYTLWQMVEMHECVPGKRFDRYHELGQHAFGEKLGLWIVVPQQLVVEVGLNIVYMITGGQSLHKFHDVVCHGRCKDIKLRYFIMIFASVHFVLSQLPDFHSISSVSLAAAVMSVSYSAIAWIASAAHGVSADTDAVADYRLRATTTPGKVFGFLGALGDVAFTYAGHNVVLEIQATIPSAPGKPSKKPMWKGVVVAYVIIAACYLPVALVGYWAFGNDVDENILITLNRPRWLIAAANMMVVVHVVGSYQVYAMPVFDMIETVLVRKYWFRPGLRLRLISRTVYVALTMFVAITFPFFSELLSFFGGFAYAPTSYFLPCIMWLIIYKPRRFSLSWFTNWICIVIGVLLMVLSPIGGLRQIILKIKTYKFYQDYPSLSQAPSSAKTSF

SEQ ID NO: 18658 - DNA, 393 bp, Sorghum bicolor
  misc_feature: Ceres ANNOT ID no. 8704208
  misc_feature: Encodes the peptide sequence at SEQ ID NO 18659
atgaacactcatgttagctactcgatgatcgcgtgggtggcgtcggcgcacaaggggaagtcaccggaggtggactacggcttgcgcgcgacgacgacgccgggaaaggtgttgggcttcttcggcgcactcggcgatgtggcgttcgcctacgccgggcacaacgtggtgctggagatccaccatgttagaaatattcagcatttgactaccctcaaatcctgtacccgccactgctcgctcgtcggatattgggcgtttggcaaccaagttgatgataacgtcctcatcagcctcaggaaacccaagtggctcatcgccctcgccaacatgatggtcgtcgttcatgtcgttggcagctaccaggtatatatatatatatatatcggataa

SEQ ID NO: 18659 - protein, 130 aa, Sorghum bicolor
  misc_feature: Useful for making plants with altered oil content
  misc_feature: Functional homolog of the protein sequence given in SEQ ID NO 13448
  misc_feature: Ceres ANNOT ID no. 8704208
MNTHVSYSMIAWVASAHKGKSPEVDYGLRATTTPGKVLGFFGALGDVAFAYAGHNVVLEIHHVRNIQHLTTLKSCTRHCSLVGYWAFGNQVDDNVLISLRKPKWLIALANMMVVVHVVGSYQVYIYIYIG

SEQ ID NO: 18660 - DNA, 1395 bp, Sorghum bicolor
  misc_feature: Ceres ANNOT ID no. 8704210
  misc_feature: Encodes the peptide sequence at SEQ ID NO 18661
atggagatgcagccacagctcgccgactgttctccggataagcttgccagcgtcgctctgacacccagagggcgcctggactcgcaggaaggccggtggccggcgcaggagaaggacatcgacgattggctccccatcaacgcgaggaggaacgccaagtggtggtactccgccttccacaatgtcaccgccatggtcggcgccggcgtgcttggccttccctacgccatgtccgagcttggctgggaggttggcatcacggtgctgctcctgtcatggatcatcacgctgtacacgctgtggcagatggtggagatgcacgagatggtgcccggcaagaggttcgacaggtaccacgagctcgggcagcacgcgttcggcgagaagcttggcctgtggatcgtcgtgccgcagcagctggtggtggaggtcggcctcaacatcgtctacatggtcaccggcggccagtccctgcaaaagttccacgacgtggtctgcggcgacaagcagtgcaaggacatcaagctcacctacttcatcatgatcttcgcctcctgccacttcgtcctctcccagctccccaacttccactccatctccggcgtctccctcgccgccgccgtcatgtcgctttgctactcgacgatcgcatggatcgcgtcggtgcagaaggggaagtcgccggaggtgcactacggcctgcgcgcgacgacgacgccggggaaggtgttcggcttcttcggcgcgctcggggacgtggcgttcgcctacgccgggcacaacgtggtgctggagatccaggccaccatcccgtcgacgccggagaagccgtccaagaagcccatgtggaagggcgtcgtcgtcgcctacatcgtcgtcgccgtgtgctacttccctgcctcactcgtcggctactgggccttcggcaacagcgtcaacgagaacatccttgtcacactcaacaagcccaagtggctcattgccctcgccaacatgatggttgtcgttcatctcattggcagctaccaggtatatgcgatgccagtgtttgacatgatagagacggtgctggtcaggaagtttgggttccgtccaagcttgatgctccgtctcattgcccggagtgtctatgtcgggttcacaatgttcgtagccatcaccttcccgttcttcactgcattgctcagcttctttggcggatttgccttcgcaccgacaacgtattttcttccttgcatcatgtggctcacaatatacaaacccaaaactttcagtatctcgtggtttaccaactggatctgcattgtcctaggtgttttgctgatggtactgtcaccaatcggtggacttcgggagatcatcttgaaagccaagacataccacttctaccagtaa

SEQ ID NO: 18661 - protein, 464 aa, Sorghum bicolor
  misc_feature: Useful for making plants with altered oil content
  misc_feature: Functional homolog of the protein sequence given in SEQ ID NO 13448
  misc_feature: Ceres ANNOT ID no. 8704210
  misc_feature (50)..(451): Pfam ID: Aa_trans Pfam Description: Transmembrane amino acid transporter protein
MEMQPQLADCSPDKLASVALTPRGRLDSQEGRWPAQEKDIDDWLPINARRNAKWWYSAFHNVTAMVGAGVLGLPYAMSELGWEVGITVLLLSWIITLYTLWQMVEMHEMVPGKRFDRYHELGQHAFGEKLGLWIVVPQQLVVEVGLNIVYMVTGGQSLQKFHDVVCGDKQCKDIKLTYFIMIFASCHFVLSQLPNFHSISGVSLAAAVMSLCYSTIAWIASVQKGKSPEVHYGLRATTTPGKVFGFFGALGDVAFAYAGHNVVLEIQATIPSTPEKPSKKPMWKGVVVAYIVVAVCYFPASLVGYWAFGNSVNENILVTLNKPKWLIALANMMVVVHLIGSYQVYAMPVFDMIETVLVRKFGFRPSLMLRLIARSVYVGFTMFVAITFPFFTALLSFFGGFAFAPTTYFLPCIMWLTIYKPKTFSISWFTNWICIVLGVLLMVLSPIGGLREIILKAKTYHFYQ

SEQ ID NO: 18662 - DNA, 1545 bp, Sorghum bicolor
  misc_feature: Ceres ANNOT ID no. 8704229
  misc_feature: Encodes the peptide sequence at SEQ ID NO 18663
atgacgacgagcgccgacgccgacgccgacccgaccgtcgtcttggttccaatctggggcgtcggccacttcgtcccgatgatcgaggccggcaagcgtctgctggcacgcagcacccgccggctcacgctcaccgtgctcatcatgccggcgccgtcggagaagcgcgcgtccgagatcgccgaccacatccgcgaggtggaggcggagtccgctgccctcggtctcgccatccgcttccaccacctcccggcggcagccgagcctccgccggccgtggccaccacctactactcgggccccgaggagttcatctccctcaacgtgcacccgtacgtgccccacgtgacggcggccgtcgccggcctgacgtgccccgtggccgccgtcgtggtcgacatcttctgcacgccgctgctcgacgcggcgcacggactcgccgtgcccgcctacgtgtacctcatctgcagcgcggccatgtgcgcgctcctgctccactcccctgcgctcgatgacgaggccgccgcagccggcgacgtcgagttcgaggagatggacggcggcgtagtccacgtccctggcctcccgccggtgccggcgtcatgcctcccgtcgggactggtcgacaggaacgtcccgacctaccgctggttcctgtacaacggccggcgctacacggaagccgccggcatcatcgtcaacaccgtcgccgagctcgagccacacgttctggccgccatcgccgacgggcggtgctgcacgcgcgggaaccgcgccccgacggtgtacaccatcgggccagtcctcgccgcgaccattactactactccgccgccggccgacgcggagaagcagcaggaggaggaacacgagtgcgtgcggtggctcgacacgcagccgccggcgtccgtgctgttcctctgcttcggaagcgcgcggttcttcagcgcgcggcaggcgcacgaggccgcgcacgccctggaccgcagcggccaccgcttcctgtgggtgctgcgcgggccgccggagcacgggacgaagctgtcctcggacggggacctggccgagctgctcccgccggggttcttggagaggacgaaaggcagggggctcgtgtggccgaagtgggcgccgcagaaggagatcctggcgcacgccgccgtcggaggcttcgtcacgcactgcggctggaactcggtgctcgagagcctgtggttcggcgtgcccatgctgccgtggccgtgggccgccgagcagcactacaacgccttcacgctggtggccggcatgggggtcgccgtcgccatggaggtgtgtcggaaggaggacaacttcgtggaggctgccgagctggagcgggcagtccgagctctcatgggaggcgccgaggggacggcggcgagggagaaggcgagggagatgaaggcggcttgccggagggccgtcgaggagggcgggtcgtcggatgcgtccttgaagagactctgtgatgcactccatcaaggtgcagtgctccctgcaagaaagtttcctcaggatacatga

SEQ ID NO: 18663 - protein, 514 aa, Sorghum bicolor
  misc_feature: Useful for making plants with altered carbohydrate content
  misc_feature: Functional homolog of the protein sequence given in SEQ ID NO 14352
  misc_feature: Ceres ANNOT ID no. 8704229
  misc_feature (291)..(426): SWISSPROT Homolog: EC 2.4.1.115 Anthocyanidin 3-O-glucosyltransferase
  misc_feature (12)..(503): Pfam ID: UDPGT Pfam Description: UDP-glucoronosyl and UDP-glucosyl transferase
MTTSADADADPTVVLVPIWGVGHFVPMIEAGKRLLARSTRRLTLTVLIMPAPSEKRASEIADHIREVEAESAALGLAIRFHHLPAAAEPPPAVATTYYSGPEEFISLNVHPYVPHVTAAVAGLTCPVAAVVVDIFCTPLLDAAHGLAVPAYVYLICSAAMCALLLHSPALDDEAAAAGDVEFEEMDGGVVHVPGLPPVPASCLPSGLVDRNVPTYRWFLYNGRRYTEAAGIIVNTVAELEPHVLAAIADGRCCTRGNRAPTVYTIGPVLAATITTTPPPADAEKQQEEEHECVRWLDTQPPASVLFLCFGSARFFSARQAHEAAHALDRSGHRFLWVLRGPPEHGTKLSSDGDLAELLPPGFLERTKGRGLVWPKWAPQKEILAHAAVGGFVTHCGWNSVLESLWFGVPMLPWPWAAEQHYNAFTLVAGMGVAVAMEVCRKEDNFVEAAELERAVRALMGGAEGTAAREKAREMKAACRRAVEEGGSSDASLKRLCDALHQGAVLPARKFPQDT

SEQ ID NO: 18664 - DNA, 1878 bp, Sorghum bicolor
  misc_feature: Ceres ANNOT ID no. 8704262
  misc_feature: Encodes the peptide sequence at SEQ ID NO 18665
atggttgtcgtggccaccttggtggctttaacgctcttgagcaccgccgccctgcaggctcagccgccatggccgatctgcgaaaccagcagcggtaactacaccaagaacagcacgtacaaagcaaacatagaatacctagccagcttcctcccacagtacgcgtcctcgaatcccaactacctcttcgcctccggctcctctggcatctccccggacgtcatctacgcaatcgcgctctgccgtggcgacaccaacgcctcgtcctgcgccacctgcgtcgccgcggctattcaggcagccggggaggtctgcccgctcgtcaagaccgtgacaatctacgacgacccatgcatcgtccgcttcagcgagcagggcttccccatcaggcctccctacgacacagggatgacgatcacctggaactacgagaatctcagcgccgccgtggcgccgtctttcgaagcagccaccgctcgactcgtcaacgccaccgtagagtacgcggcggcggaccagaccaccaggcgattcggcaccggggaggcgcccttcgacgacgaggaattccccaagatttactcgttggcgcagtgtacgccggacatgacggccgaccagtgccggagctgtctctggtacataattgggaggttcacaaaggaatttttcgccgggaagaaaggcggtcgagttctcggggtgcgctgcaactaccggtttgagacgtaccctttcttctatggccgcccgctactgcaactccagccgcccaacgggccgtcgcctgcaccagcgtctcaagccaccggagaatcaactactccggatgatattgaaagtattggttcactgcttcttgatctgtcaacactacgagttgctactggtgacttttctgaacacaaaaggctcggtgaaggtggcttcggtgtagtatacaagggagacctacctgatggtcaggaaatagccgtgaagagactagcacagacttccagacaagggatagaagagctaaaaactgaactacttttagtcgccaaactgaaccacaacaatcttgtccggcttattggcgtttgcttggaagaaaatgaaaagatacttgcatatgaatacatgcccaatagaagccttgatacaattctttttgtggtagatgcagagaaagctaaggagctagattgggcacaaaggtttaaaattataagtgggatcgctagaggcttacaataccttcatgaagattctcaactgaagatagttcatcgggacctcaaagcaagcaatgttctgttggattctgcttataatcctaagatttcagactttggcttagcgaagatatttggaagggatcaatcacacgttgtcactaaccgcattgctggaacgtatggatacatgtcaccagagtatgcgatgcgtggtcagtgttcaatgaagtcagacgtgtttagctttggtgttttggtcctagagatcgtcacggggagaagaaactatgtctcctacaacagtgagcaagatgttgatcttataaaccttatatgggagcattggaccagggataaagccatcaacttgattgatgcatccttgaatagcaactatccagctgacattgtgttgaagtgcatccacattgggctattgtgtgtcgagcaaaaacctacagatcggtcgttgatgtcagctgttaactacatgcttaatagcaacgcagccgcctgtctcccccctttgtccaggccaaccatttggttccgtgagactgatgatgaactaaatccaaaagcttcaatttcctggggaagaaccaaaacgaaatcatcgcggaatgaagtgtccatcacagagatcgagtcccgataa

SEQ ID NO: 18665 - protein, 625 aa, Sorghum bicolor
  misc_feature: Useful for making plants with modulated biomass
  misc_feature: Functional homolog of the protein sequence given in SEQ ID NO 14141
  misc_feature: Useful for making plants with altered carbohydrate content
  misc_feature: Functional homolog of the protein sequence given in SEQ ID NO 14586
  misc_feature: Ceres ANNOT ID no. 8704262
  misc_feature (282)..(578): SWISSPROT Homolog: EC 2.7.11.1 Non-specific serine/threonine protein kinase
  misc_feature (299)..(571): Pfam ID: Pkinase Pfam Description: Protein kinase domain
MVVVATLVALTLLSTAALQAQPPWPICETSSGNYTKNSTYKANIEYLASFLPQYASSNPNYLFASGSSGISPDVIYAIALCRGDTNASSCATCVAAAIQAAGEVCPLVKTVTIYDDPCIVRFSEQGFPIRPPYDTGMTITWNYENLSAAVAPSFEAATARLVNATVEYAAADQTTRRFGTGEAPFDDEEFPKIYSLAQCTPDMTADQCRSCLWYIIGRFTKEFFAGKKGGRVLGVRCNYRFETYPFFYGRPLLQLQPPNGPSPAPASQATGESTTPDDIESIGSLLLDLSTLRVATGDFSEHKRLGEGGFGVVYKGDLPDGQEIAVKRLAQTSRQGIEELKTELLLVAKLNHNNLVRLIGVCLEENEKILAYEYMPNRSLDTILFVVDAEKAKELDWAQRFKIISGIARGLQYLHEDSQLKIVHRDLKASNVLLDSAYNPKISDFGLAKIFGRDQSHVVTNRIAGTYGYMSPEYAMRGQCSMKSDVFSFGVLVLEIVTGRRNYVSYNSEQDVDLINLIWEHWTRDKAINLIDASLNSNYPADIVLKCIHIGLLCVEQKPTDRSLMSAVNYMLNSNAAACLPPLSRPTIWFRETDDELNPKASISWGRTKTKSSRNEVSITEIESR

SEQ ID NO: 18666 - DNA, 1932 bp, Sorghum bicolor
  misc_feature: Ceres ANNOT ID no. 8704276
  misc_feature: Encodes the peptide sequence at SEQ ID NO 18667
atggcgcggcgggtgcggccgtcgcacctgattctagcgctggcggcggcctacctcctcctcatctccctcaagttccgccgcgtgctggacctggccgccgccgacctcgccgcgggcgaccccgccgccgccgccgcctccgccttctcctcgccgtcctcctccgaccacctaccctcccccaccttcgtctcctcctccgacgacgacgccacctccccgttcccggtccgccccttctggcaccgctacgaccgcgtgtccctgcccgacctcgcgtcacgcaaccgctccgcgctcgaccgcatggccgacgacgcctgggcgctcggcctcacggcttgggaggacgcggccgccttcgcgggggacccctgggcgctgctggccgccgccacctcccgcgcctccgactccgccaagtgcccctccgctgtctcgcagcgcgcgcggggccgggtcgtcttcctcccctgcggcctcgcggcgggctcctccgtcaccgtcgtcggcaccccgcgcgccgcgcacagggagtacgtgccgcagctcgcgaggatgaggcagggggacggcaccgtcatggtgtcccagttcgtggtcgagctccagggcctgcgcgccgtcgatggcgaggacccgcccaggatactccacctcaaccccaggctcaggggggattggagccagcaccctatcctcgagcacaacacctgctacaggatgcagtggggcgccgcgcagcgctgtgatggcacaccacccggcgacaacgacgacaaagttgatggattccccaaatgtgagaaatggatacgcaatgacattgttgacaccaaggagtcgaagacaacttcatggttgaagagattcatagggcgtgcaaagaaacctgcaataacatggccattcccctttgtagaggagaggctatttgttttgactatacaagctggagttgaaggtttccacatttacgttggtggtcgacatgtgacatcttttccttatcgaccagggttcactcttgaagatgcaacgggattatttgttaagggtgatgtagatgtacattcagtttacgccactgctcttcctatgtcccatcctagtttttctcttcgacaagtccttgagatgtcagaaaagtggaggtctcggccactaccaaaaggtcctgtttcccttttcattggaatattgtctgcatcaaatcacttcgctgagcgcatggctgtgagaaaaacatggatgcagactccagaaattaagtcttctgaagcagtggctcgattctttgttgccctgaattcaaggaaagaggtcaatgtaatgctgaagaaagaagcagaatactttggagacattgtcattttgccatttatagatcgctatgagctggttgttcttaagacaattgctatctgtgagtatggggtccagaacttgactgctgcaaacatcatgaaatgcgacgatgatacatttgtgagagtagatatggttctgagacacatcaagttgaataataatggtgacaaaccattatatatggggaaccttaacctcttgcatagaccactgagaactggaaaatgggcagttacaggcgaggagtggcctgaggatatctacccaccatatgcaaatggaccaggctatgtgatttccggtgacatagcaaaattcatcgtgtcacagcatgccaatcagagtttaagactgtttaagatggaagatgtaagtatgggtctatgggttgagaaattcaatgcaacaaagcctgtccaatattcccacagctggaacttctgccagtatggttgcgtgttcaactactacacagcccactatcagtcacctaggcagatgctgtgcttgtgggataagttgatccgtggtcagccatcctgctgtaactacagatag

SEQ ID NO: 18667 - protein, 643 aa, Sorghum bicolor
  misc_feature: Useful for making plants with altered carbohydrate content
  misc_feature: Functional homolog of the protein sequence given in SEQ ID NO 13850
  misc_feature: Ceres ANNOT ID no. 8704276
  misc_feature: Up-regulated in root tissues in response to methyl jasmonate treatment
  misc_feature: Up-regulated in shoot tissues in response to methyl jasmonate treatment
  misc_feature (391)..(626): SWISSPROT Homolog: EC 2.4.1.134 Galactosylxylosylprotein 3-beta-galactosyltransferase
  misc_feature (153)..(363): Pfam ID: Gal-bind_lectin Pfam Description: Galactoside-binding lectin
  misc_feature (409)..(600): Pfam ID: Galactosyl_T Pfam Description: Galactosyltransferase
MARRVRPSHLILALAAAYLLLISLKFRRVLDLAAADLAAGDPAAAAASAFSSPSSSDHLPSPTFVSSSDDDATSPFPVRPFWHRYDRVSLPDLASRNRSALDRMADDAWALGLTAWEDAAAFAGDPWALLAAATSRASDSAKCPSAVSQRARGRVVFLPCGLAAGSSVTVVGTPRAAHREYVPQLARMRQGDGTVMVSQFVVELQGLRAVDGEDPPRILHLNPRLRGDWSQHPILEHNTCYRMQWGAAQRCDGTPPGDNDDKVDGFPKCEKWIRNDIVDTKESKTTSWLKRFIGRAKKPAITWPFPFVEERLFVLTIQAGVEGFHIYVGGRHVTSFPYRPGFTLEDATGLFVKGDVDVHSVYATALPMSHPSFSLRQVLEMSEKWRSRPLPKGPVSLFIGILSASNHFAERMAVRKTWMQTPEIKSSEAVARFFVALNSRKEVNVMLKKEAEYFGDIVILPFIDRYELVVLKTIAICEYGVQNLTAANIMKCDDDTFVRVDMVLRHIKLNNNGDKPLYMGNLNLLHRPLRTGKWAVTGEEWPEDIYPPYANGPGYVISGDIAKFIVSQHANQSLRLFKMEDVSMGLWVEKFNATKPVQYSHSWNFCQYGCVFNYYTAHYQSPRQMLCLWDKLIRGQPSCCNYR

SEQ ID NO: 18668 - DNA, 2412 bp, Sorghum bicolor
  misc_feature: Ceres ANNOT ID no. 8704294
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 18669
atgccgacagcggccgccatgatcggcggcctcgccagctacgcagcatccctcggccagaatatgatggatgggcaccaccagctcgctatgatgcagcagcagcagcatcagaaccacggccagcagcagcagcacccaccgcaagcagccacgagcgagagcgatgcacgcggcccacgccacgacgagctgatgatggagagcaaatctggcagcgacaacatggagggaggtgccgggtcaggctccggtggtgaggagctacaggaggatctcagcctgcagccagcccgcaagaagcgctaccaccgccacacccaacaccagatccaggagctcgaagcgttcttcaaggagtaccctcaccctgacgacaagcagagaaaggagctgagccgggagctgggcctggagcctctccaagtcaaattctggttccagaacaagcgtacccagatgaagacgcagcaggagcggcatgagaacatgcagctgcgcgcagagaacgagaagctgcgagctgagaacgcgcgatacaaagatgctcttgccaatgcctcatgcccaaactgcggtggcccagccacggccgtcattggtgagatgtccttcgatgaacaccaccttcgcattgagaatgcgcgcctccgggacgaggtcgatcgcatctccaccatcgctgccaagtacgttggcaagcccgcaggtagcctgctgcccaacttgtcaaatatctcctcggcctcaatggcgccgtacccaccaccgcctccactttcctcccaccacctcctgcccggtggaacagacatgtttggtggccttcaccttcatggtgccgctgctgggtttgacaaggggttggtggtcgagctcgccgtggccgcgatggaggagctggtgcggatggctcagcttggcgagccgctctggatccctgcccttgtcgtagacggtgctaccattgagactctcaatgaggaagagtatgcccgtgggttccccagcggcgttggtcccaagttgccggagctccgatcagaagcatcacgggagaccgttgtggtcatcatgaatcatgtcaacctcatcgagatgctcatggacgtgaaccagtggtcgacgctgttctcaagcattgtgtcacgggctgcaaccctcgaggtgctctccaccggcgttgccggcaactacaatggcgcgctgcagctgatgacagcagaattccagatgccgtcgccgctggtgccgacacgtgagagccagttcttgcgctactgcaagcagcacacagacggcagctgggcggtggtggacgtgtccgtcgagggcctgcgtgccagcggacaggcgggtgcgcgtggtcggcgccgcccctcaggctgtctgatccaggagatgcccaacggctactccagggtgacatgggtggagcacgtagaggcagacgacatgatggtgcacgacctataccgtcccctggtatgctctgggctggcattcggcgcacggcggtgggcagcagccctggagcggcaatgtgagcgccttgccagtgccatggccagtggcgtcccggcagggccttccagtggcggagatgctgtaggtgtggtgacatcagtggagggacgccggagcatgctccggctggcagagcggatggtcacgagcttctgcggtggcgtgactgcatcgacgacgcaccagtggactaagctgtcaggcagcggtgctgaggatgtgcgcgtgatgacgcgtaagagcgtggatgaccccggccgcccgcccggcatcatcctgaatgctgccacctcattctggcttcctgtgcccccggcgcgtgtcttcggcttcctccgggatgacgccacccgcagcgagtgggacattctctccaatggcggagacgtgcaggagatggctcatatcgccaatggacgtgaccacggcaatgcggtctcactcctccgtgtcaataacgccaactcgaaccagagcaacatgctaatcctgcaggagtgctgcacagatgcaacggggtcctacgtgatctacgcgccggtggatgtggtggccatgaacgtggtgctcaacggcggtgacccagactatgtggcacttctgccatcagggttcgccatcctccccgacgggtctggtgcaggtggtgcgccaccagggtttgccgtcctccccgacggacctggtgcaggtggtggtggcggcggcggtggtgggtcactcctcaccgtggcgttccagatcctggtggactcagtgcccaccgccaagctgtcattgggctccgtcgccactgtcaacagcctcattgcctgcaccgtcgagcgcatcaaggctgctgtcgcagccgacaacatcggcggcgggggtgccgtcccccagtga

SEQ ID NO: 18669 - protein, 803 aa, Sorghum bicolor
  misc_feature: The sequence is a functional homolog of SEQ ID NO 244 in the 10/412,699 US patent application
  misc_feature: The sequence is a functional homolog of SEQ ID NO 424 in the 11/435,388 US patent application
  misc_feature: The sequence is a functional homolog of SEQ ID NO 519 in the 11/479,226 US patent application
  misc_feature: The sequence is a functional homolog of SEQ ID NO 58 in the 10/286,264 US patent application
  misc_feature: The sequence is a functional homolog of SEQ ID NO 2670 in the 10/374,780 US patent application
  misc_feature: The sequence is a functional homolog of SEQ ID NO 334 in the 10/225,066 US patent application
  misc_feature: The sequence is a functional homolog of SEQ ID NO 666 in the 11/435,388 US patent application
  misc_feature: The sequence is a functional homolog of SEQ ID NO 130 in the 10/666,642 US patent application
  misc_feature: The sequence is a functional homolog of SEQ ID NO 92 in the 10/666,642 US patent application
  misc_feature: The sequence is a functional homolog of SEQ ID NO 2324 in the 10/374,780 US patent application
  misc_feature: The sequence is a functional homolog of SEQ ID NO 246 in the 10/412,699 US patent application
  misc_feature: The sequence is a functional homolog of SEQ ID NO 522 in the 11/479,226 US patent application
  misc_feature: The sequence is a functional homolog of SEQ ID NO 596 in the 11/435,388 US patent application
  misc_feature: The sequence is a functional homolog of SEQ ID NO 716 in the 10/225,066 US patent application
  misc_feature: The sequence is a functional homolog of SEQ ID NO 80 in the 10/286,264 US patent application
  misc_feature: Ceres ANNOT ID no. 8704294
  misc_feature (292)..(517): Pfam ID: START Pfam Description: START domain
  misc_feature (100)..(156): Pfam ID: Homeobox Pfam Description: Homeobox domain
MPTAAAMIGGLASYAASLGQNMMDGHHQLAMMQQQQHQNHGQQQQHPPQAATSESDARGPRHDELMMESKSGSDNMEGGAGSGSGGEELQEDLSLQPARKKRYHRHTQHQIQELEAFFKEYPHPDDKQRKELSRELGLEPLQVKFWFQNKRTQMKTQQERHENMQLRAENEKLRAENARYKDALANASCPNCGGPATAVIGEMSFDEHHLRIENARLRDEVDRISTIAAKYVGKPAGSLLPNLSNISSASMAPYPPPPPLSSHHLLPGGTDMFGGLHLHGAAAGFDKGLVVELAVAAMEELVRMAQLGEPLWIPALVVDGATIETLNEEEYARGFPSGVGPKLPELRSEASRETVVVIMNHVNLIEMLMDVNQWSTLFSSIVSRAATLEVLSTGVAGNYNGALQLMTAEFQMPSPLVPTRESQFLRYCKQHTDGSWAVVDVSVEGLRASGQAGARGRRRPSGCLIQEMPNGYSRVTWVEHVEADDMMVHDLYRPLVCSGLAFGARRWAAALERQCERLASAMASGVPAGPSSGGDAVGVVTSVEGRRSMLRLAERMVTSFCGGVTASTTHQWTKLSGSGAEDVRVMTRKSVDDPGRPPGIILNAATSFWLPVPPARVFGFLRDDATRSEWDILSNGGDVQEMAHIANGRDHGNAVSLLRVNNANSNQSNMLILQECCTDATGSYVIYAPVDVVAMNVVLNGGDPDYVALLPSGFAILPDGSGAGGAPPGFAVLPDGPGAGGGGGGGGGSLLTVAFQILVDSVPTAKLSLGSVATVNSLIACTVERIKAAVAADNIGGGGAVPQ

SEQ ID NO: 18670 - DNA, 1425 bp, Sorghum bicolor
  misc_feature: Ceres ANNOT ID no. 8704297
  misc_feature: Encodes the peptide sequence at SEQ ID NO 18671
atggtcaccgcctggctccgatggtcctgccgcctccaccagccgtcgacatgctcctaccacttgggcgaggtaatatcactacctccttgtcagtctgcctaccgcttttgccttgaggtgaatttctccatcctctggcaaagtgcggccccgccccagccacgccggaagaggccgccgcgtgaggtcaccgtccccgttgctgccgcctctaacccgaagcccaggccgccgccggtgcaaagcaaggagaatcaggcggaggggggagcagcagcggagggggcagcagctgaggagggggagaagtaccggccggcaccggaaatcctgccgctgccgccggccatggcgaagctggggccggggcaggggctcgggtgcgaggcggcggaggggtcgctcgtgcccagccggaagcgggagtacaagccctgcggcaagcacactgaggggaagcgcccgctctatgccatcgggttcaacttcatggacgcgcgctactacgacgtcttcgccaccgtcggcggcaaccgcgtttggggagttcttgttgatactggcaagttgacaacttaccgctgccttgagaatggtagttttgctcttctacaagcttacattgatgaggataaggatgagtcattctacactctaagctgggctcgtgaccatgttgatggctcaccactgctggtggcagcaggaagcaatgggatcattcgggtcatcaattgtgctacggagaagttagctaagagctttgttggccatggtgactcaataaatgagataagaactcaaccgttgaagccttcgctcatcatttctgcaagcaaggatgaatctgttaggctatggaatgtccatacagggatctgtatcttgatatttgctggagctggaggtcatcgcaatgaagtgttgagtgttgactttcaccctagtgatatcgagcgttttgcaagctgtggcatggacaacactgtgaaaatctggtcaatgaaagaattttggctatatgttgacaaatcatattcatggactgaccttccatcgaagtttccaacaaaatatgtccagtttccggtcttgattgctgcagtacactctaactatgttgactgtacaagatggcttggtgacttcatcctatcaaagagtgttgacaatgaaattgtgctctgggaaccaaagacaaaagaacagagtcctggggagggaagcatcgatattcttcaaaagtaccctgtcccagaatgtgacatctggttcatcaaattttcatgtgattttcacttcaatcagttggctatagagatacagaaaaagttgactgctctaataaccatccactgcaaacaggcaatcgtgaaggaaaaatatacgtgtgggaagtacagtcgagccctcctgtcctaa

SEQ ID NO: 18671 - protein, 474 aa, Sorghum bicolor
  misc_feature: Useful for biocontainment applications
  misc_feature: Useful for making plants with modulated seed size
  misc_feature: Functional homolog of the protein sequence given in SEQ ID NO 13513
  misc_feature: Ceres ANNOT ID no. 8704297
  misc_feature (249)..(412): SWISSPROT Homolog: EC 2.3.1.48 Histone acetyltransferase
  misc_feature (295)..(335): Pfam ID: WD40 Pfam Description: WD domain, G-beta repeat
  misc_feature (250)..(289): Pfam ID: WD40 Pfam Description: WD domain, G-beta repeat
MVTAWLRWSCRLHQPSTCSYHLGEVISLPPCQSAYRFCLEVNFSILWQSAAPPQPRRKRPPREVTVPVAAASNPKPRPPPVQSKENQAEGGAAAEGAAAEEGEKYRPAPEILPLPPAMAKLGPGQGLGCEAAEGSLVPSRKREYKPCGKHTEGKRPLYAIGFNFMDARYYDVFATVGGNRVWGVLVDTGKLTTYRCLENGSFALLQAYIDEDKDESFYTLSWARDHVDGSPLLVAAGSNGIIRVINCATEKLAKSFVGHGDSINEIRTQPLKPSLIISASKDESVRLWNVHTGICILIFAGAGGHRNEVLSVDFHPSDIERFASCGMDNTVKIWSMKEFWLYVDKSYSWTDLPSKFPTKYVQFPVLIAAVHSNYVDCTRWLGDFILSKSVDNEIVLWEPKTKEQSPGEGSIDILQKYPVPECDIWFIKFSCDFHFNQLAIEIQKKLTALITIHCKQAIVKEKYTCGKYSRALLS

SEQ ID NO: 18672 - DNA, 1344 bp, Sorghum bicolor
  misc_feature: Ceres ANNOT ID no. 8704299
  misc_feature: Encodes the peptide sequence at SEQ ID NO 18673
atggcgccttccaaagcacgccaaaagaggtcacttcctcagatcactaccatcgccggcactgggcccatcgcaaactcgcaacccgccagctcgacattgacgaaggaagtggatcagcaggaggagcagtgtctaaaggaaccaaagatccctccattaccgccgatcacggtgaatgtagtcccgcaacaagggttgggctgtgaagtggtggaagggctactcgtgcctagccgaaagcgagagtacaagtccaatggcaagtatactgtgggaaatcacccaatctatgccatcgggttcaacttcatggacgtgcgctactacgacgtctttgccactgccagctccaacagtgtgacagtttaccggtgccttgagaatggtagttttggtcttctacaagcttatgttgatgaggataaggatgagtcattctatactctaagctggaccatcaataaagttgatcgcaaaccactgttggtggctgcaggaaacaatcagatcattcggatcatcaattgtgcaggcgagaagttagctaagagcttagttggccatggtggttcaatacacgagataaggactcatgcgtcgaagcattcactcatcatttctgccagcaaggatgaatctgttaggctatggaacgtccatacaggggtctgcatcttgatctttgcaggagttggaggccatcgccatgacgtgttgagtgtttttgcaaatagcaacaaatgccaagtcaatttgccaaagcctttggagatgctcttagggcggcataaagaattttgggtatatgttgaaaaatcatattcatggactgacaatccatcaaagtttccaacaagacatatccagtttccggtcttgagtgctgcagtacactctgagtttgttgattgtacaagatggcttggtgacttaatcctgtcaaagagtgtcgagaatgaaattttgctttgggaaccaaaaccagataagaataagcctggggagggaagcgttgatattcttcagaagtaccctgtgccacagtgtacattatggtgtatgaaattttcatgtgactttcacttcaaccagttggcagtaggcaacagtaaaggtgagatctatgtttgggaagtacagtcctgcccgcctgtcttaattgatcggctgtctaataaggaatgcaaatcaccaataaggcagactgcagtgtccgttgatggaagtactatccttggagctggcgatgatggcaccatctggcgatgggatgaagtgagtccttcgacctccaaaactaaaccaattcaagctgctgtggccactgatgccaatgcctga

SEQ ID NO: 18673 - protein, 447 aa, Sorghum bicolor
  misc_feature: Useful for biocontainment applications
  misc_feature: Useful for making plants with modulated seed size
  misc_feature: Functional homolog of the protein sequence given in SEQ ID NO 13513
  misc_feature: Ceres ANNOT ID no. 8704299
  misc_feature (180)..(219): Pfam ID: WD40 Pfam Description: WD domain, G-beta repeat
MAPSKARQKRSLPQITTIAGTGPIANSQPASSTLTKEVDQQEEQCLKEPKIPPLPPITVNVVPQQGLGCEVVEGLLVPSRKREYKSNGKYTVGNHPIYAIGFNFMDVRYYDVFATASSNSVTVYRCLENGSFGLLQAYVDEDKDESFYTLSWTINKVDRKPLLVAAGNNQIIRIINCAGEKLAKSLVGHGGSIHEIRTHASKHSLIISASKDESVRLWNVHTGVCILIFAGVGGHRHDVLSVFANSNKCQVNLPKPLEMLLGRHKEFWVYVEKSYSWTDNPSKFPTRHIQFPVLSAAVHSEFVDCTRWLGDLILSKSVENEILLWEPKPDKNKPGEGSVDILQKYPVPQCTLWCMKFSCDFHFNQLAVGNSKGEIYVWEVQSCPPVLIDRLSNKECKSPIRQTAVSVDGSTILGAGDDGTIWRWDEVSPSTSKTKPIQAAVATDANA

SEQ ID NO: 18674 - DNA, 1143 bp, Sorghum bicolor
  misc_feature: Ceres ANNOT ID no. 8704359
  misc_feature: Encodes the peptide sequence at SEQ ID NO 18675
atggcgtcgaggttacacgtctcgacgccgtggcttctgacgtggcagagacctcgacgccgtagatcatggcgtcgagctcgacgccatagatcacggcgtcgagctctctccaacctggaccagaacattgccgtcattgtgcagaccgtgtactgcttcagggcggctgacgacggcggcgccggcagaagcagcgcctgcgacgtgctgagggagtcgctggcgaaggtgctcgtccactactacccgctcgctgggcggctggcgaactcagacgatgggaagctggtcgtggactgcacgggcgacggcgccgtgttcgtggaggccgaggcggactgcgccatggcggacatcggcgacgtcaccgaccccgacccctccgtcctcggcaggctcgtgtacagcgtccccggcgccaagaacatactcgagatgccgctgcttgcagcccaggtgaccaagttcaagtgtggcggcttcgtgctggggctggccatcaaccactgcatgttcgacggcgtcggcgccatgcagttcgtcaactcgtggggcgagacggcgcgcggcctcccgctgtcgctcccgccggccctcgaccgcgccgtcctccgtgcgcgcaacccgccgcaggtcgacttcccgcaccacgagttcacgcagatcaccgacgacgacgccgacgacggggaggacgaggaggactcggagtccccgctcctgcaccgctcgttccggttcacgccggcgtccatcgcgcgcctcaaggcggcggtgggggcgctggaggagggccgccgcgcgtgcaccacgttcgaggcgctggccgggttcgtgtggagcgcgcgcacgcgggcgctggggatgcgcccgtcgcgccggagcaagctgctgttcgcggtggacgggcggccgaggttctcgccgccgctccccgcggggtacttcggcaacgccatcgtgctgaccagcgcagcgtgccccgcgggggagctggcgtcgtcgctgccgcgcgccgtgcggctggtgcgcggcgccgcggcggccgtgacggacgtctacatgcggtccgcggtggactacttcgaggcgacgcgcgcggccgtcgctggcgtcgacactgctcatcacggcatgtag

SEQ ID NO: 18675 - protein, 380 aa, Sorghum bicolor
  misc_feature: Useful for biocontainment applications
  misc_feature: Functional homolog of the protein sequence given in SEQ ID NO 14111
  misc_feature: Ceres ANNOT ID no. 8704359
  misc_feature (70)..(335): SWISSPROT Homolog: EC 2.3.1.162 Taxadien-5-alpha-ol O-acetyltransferase
  misc_feature (17)..(380): Pfam ID: Transferase Pfam Description: Transferase family
MASRLHVSTPWLLTWQRPRRRRSWRRARRHRSRRRALSNLDQNIAVIVQTVYCFRAADDGGAGRSSACDVLRESLAKVLVHYYPLAGRLANSDDGKLVVDCTGDGAVFVEAEADCAMADIGDVTDPDPSVLGRLVYSVPGAKNILEMPLLAAQVTKFKCGGFVLGLAINHCMFDGVGAMQFVNSWGETARGLPLSLPPALDRAVLRARNPPQVDFPHHEFTQITDDDADDGEDEEDSESPLLHRSFRFTPASIARLKAAVGALEEGRRACTTFEALAGFVWSARTRALGMRPSRRSKLLFAVDGRPRFSPPLPAGYFGNAIVLTSAACPAGELASSLPRAVRLVRGAAAAVTDVYMRSAVDYFEATRAAVAGVDTAHHGM

SEQ ID NO: 18676 - DNA, 381 bp, Sorghum bicolor
  misc_feature: Ceres ANNOT ID no. 8704380
  misc_feature: Encodes the peptide sequence at SEQ ID NO 18677
atggggacggcagcctgttgctttatggactttgagctaaaagctcaccagagatttaaagaagtcctcaatgggcttgctgatgctagatggtctgtgattgaaagtgatggagtggatgattttctttgtttttacatgaattcttctactacttgttatgatgtttctccgctagcactcctgtgctttatgtgggaacaacagtcacagtggaccagtagtaatttagatgcattctttgcttctacaatgaaaccaaatttcttcaatttgcctatgtctcgccttggaggatttagtggtcaggttatgttgccctgtattttgcacaaggtgaaacagtgctcagtttgcttaatttttaatatgttcaattaa

SEQ ID NO: 18677 - protein, 126 aa, Sorghum bicolor
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: Ceres ANNOT ID no. 8704380
MGTAACCFMDFELKAHQRFKEVLNGLADARWSVIESDGVDDFLCFYMNSSTTCYDVSPLALLCFMWEQQSQWTSSNLDAFFASTMKPNFFNLPMSRLGGFSGQVMLPCILHKVKQCSVCLIFNMFN

SEQ ID NO: 18678 - DNA, 231 bp, Sorghum bicolor
  misc_feature: Ceres ANNOT ID no. 8704381
  misc_feature: Encodes the peptide sequence at SEQ ID NO 18679
atgaattcttctactacttgttatgatgtttctccgctagcactcctgcgctttatgtgggaacaacagtcacagtggactagtagtaatttagatgcattctttgcttctacaatgaaaccaaatttcttcaatttgcctatgtctcgccttgaaggatttagtggtcaggttatgttgccctggatttttgcacaaggtgaaacagtgctcagtttgcttaatttttaa

SEQ ID NO: 18679 - protein, 76 aa, Sorghum bicolor
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: Ceres ANNOT ID no. 8704381
MNSSTTCYDVSPLALLRFMWEQQSQWTSSNLDAFFASTMKPNFFNLPMSRLEGFSGQVMLPWIFAQGETVLSLLNF

SEQ ID NO: 18680 - DNA, 1464 bp, Sorghum bicolor
  misc_feature: Ceres ANNOT ID no. 8704386
  misc_feature: Encodes the peptide sequence at SEQ ID NO 18681
atgaggaagaattgggggctcagctccgggcacgcgcggccgttcggtgaccgccggtggctgctccccttcctcgccagtctgctcgtgacggccacgctcctactcgccgccgcgtgcggcctcttctcgccgccctacccgagcggcgccggcgacgcggccctgttcgacgtcgtctccctcgccgactgggacgacggcggcggctcgtcgtcgggccgcgacggcgcgccctccgtcgaggcgggaatcaagaaccggctgctggaaggtaacgccgccagcgacagcgacgacgacgacgacgacgagaaccccgatgatgctgcagtcaactctgacgactccgacgccgagccgccgcggatcgcgtacctcctcgagggcaccaagggcgacggcctgcggatgcggcggacgttgcaggccatctaccacccgcgcaaccagtacatcctgcacctcgacctggaggcgccgccgcgggagcggatcgatctggctatgtatgtcaagggcgaccccatgttcagccaggtcggaaatgtgcgggtcatcgccaagggaaaccttgtcacctacaaggggccgaccatggtcgcctgcacgcttcacgctgtagccattcttctcaaggaggggctccagtgggactggttcatcaatctcagcgcgtcggattatccgctcatgacacaagatgatatacttcatgtcttctcttctttgccaagaaatcttaattttatagagcactttcggttatctgggtggaaagttaatataagggcgaaaccaattgttctggacccagggctttatctgtcaaagaaatttgatcttactatgactactgagcggagagaattgccaacatctttcaaattatatactgtatctgtctttgataatgcgcacgaatcctacgctcagcactgtatatggggatgggacaatctcccacgaaacctgctgatgtacgaagtcaacttcatctcctcaccacaacgctatttccaaactgctatctgcaactctaatgattttccgggcacggcagttggccctgaccttcactacatcgcttgggactaccctccaaagcagcatccattgatcctctccatgaaggacttcaacaagatggtcaagagcggcgcgccatttgcacggaagtttcccaaggatgacaaggtcctggacaagatagaccgcgagcttttgcaccgctcagagggccggttcaccccgggagcatggtgtgatgggagctctgaaggaggggctgatccatgtttgtctaggggtgaagactctgttttcgagcctggtcctggtgctgaaaggctgcgaggcctgatgaagaaggtgctctcatgggattaccgcaatggtagctgttcctcacttgcttatgatcagacaaagagggattggtatgttcctaaaagtaaaggatag

SEQ ID NO: 18681 - protein, 487 aa, Sorghum bicolor
  misc_feature: Useful for making plants with altered carbohydrate content
  misc_feature: Functional homolog of the protein sequence given in SEQ ID NO 13727
  misc_feature: Ceres ANNOT ID no. 8704386
  misc_feature (121)..(419): SWISSPROT Homolog: EC 2.4.2.26 Protein xylosyltransferase
  misc_feature (124)..(349): Pfam ID: Branch Pfam Description: Core-2/I-Branching enzyme
MRKNWGLSSGHARPFGDRRWLLPFLASLLVTATLLLAAACGLFSPPYPSGAGDAALFDVVSLADWDDGGGSSSGRDGAPSVEAGIKNRLLEGNAASDSDDDDDDENPDDAAVNSDDSDAEPPRIAYLLEGTKGDGLRMRRTLQAIYHPRNQYILHLDLEAPPRERIDLAMYVKGDPMFSQVGNVRVIAKGNLVTYKGPTMVACTLHAVAILLKEGLQWDWFINLSASDYPLMTQDDILHVFSSLPRNLNFIEHFRLSGWKVNIRAKPIVLDPGLYLSKKFDLTMTTERRELPTSFKLYTVSVFDNAHESYAQHCIWGWDNLPRNLLMYEVNFISSPQRYFQTAICNSNDFPGTAVGPDLHYIAWDYPPKQHPLILSMKDFNKMVKSGAPFARKFPKDDKVLDKIDRELLHRSEGRFTPGAWCDGSSEGGADPCLSRGEDSVFEPGPGAERLRGLMKKVLSWDYRNGSCSSLAYDQTKRDWYVPKSKG

SEQ ID NO: 18682 - DNA, 2082 bp, Sorghum bicolor
  misc_feature: Ceres ANNOT ID no. 8704526
  misc_feature: Encodes the peptide sequence at SEQ ID NO 18683
atgtggaaactcaaagtctcagaggaggcctctgacgacccatggttgagctccgcttacaactttctcggcagggctgtttgggagtttgatcctgatctaggcacaacggaggaatgcgccgaggtggagagggtgcgcaaggagttcactgaccaccgcttccagaagagagagtctcaggacctcctcatgcgaatgcagtatgcaaaacaaaaaaaagttgagatcgatgttcccgccatcaagcttgcaaaaacggatgacgaagttaccaaagagattatagaaacatcactgcaccgagccctcactcaacatgcaagtctccaggcacctgatgggcattggccagctgaatacagcggagttctattcgttatgcctatcatggtatttgctctacatgtcactgggtcgctcgattctgtcttgtctacagaacatcgacatgagatatgtcgctatctttataaccatcagaatgaagatggcggctggggcacacaaattttgggaccaagcaccatgtttggctcatgcttaaactatgttaccttaagactccttggtcaggcatgtgaaaatgatgcattgactaaaggacgtgcatggattttatcacatggaggtgcatctgctatacctcagtggggaaagatatggctttcggtgatcggtctgtatgattggtctggcaacaatgccatgatccctgaattatggattatcccgtattttctaccaatgcatccaggtcgattttggtgcttttgtcgcttggtttatatgccaatggcttacctatatggtaagaaatttgttgggacacttactccaacaatactggcactaagaaaggagctctatagtgaaccatactgcaatgttgattggattaaagctcgtcgtacttgtgctaagattagggatacagcattagatgaactgatgaagcatatccactatgaagatgaaactactaaatacattggcgcctgtccagtaaacaaggcactaaatatgatctgttgctggatagaaaatcctgattcagatgctttcaagaagcatgttccaaggatctatgattatttatggcttgcggaagatggcatgaaagcaaaggcatatgatggtgttcaatgctgggaagctgcccttattgtacgggcttattgctccacagaacttgcaaaagaatttggtccaacactttcaaaagttcataattttcttaaaaattcacagattcgtgaagaccatcctgattacagaacttattaccgccataggtctaaaggatcatggacagtttccacatcagataatggatggtctgtatcggactgtactgcagaggcacttcaggcactgctattgctatcaaagctaccaccagaactagttggggaaccaatacaaggacaacggttgtatgatgcagtggattgcttgctatcttttatgaacaatgatgggacattttctacatatgagtgtaaaagaacgtcatcattgttggagcttctcaacccttgctaccgcaaggatgagatagaaaattgtgttaaaaatgcaacaaagtttattgaaaataaacagcaaccggatggctcatggttcggtacttggggtatctgtttcatctatgggacactgtttgcagtgaaaggactagtggcagctggaaaaacatacaaaaatagttactcaatccgaaaagcatgcaattttcttttatcgaagcagttaagtagtggtggatggggagaaacatatctttcaagtgaaactgggatttatgcagaggcaagcagtcctcatgctgtcagcactgcttgggcaatgttggctttactttatgctgggcaggttgaaagagatccaacaccattatatcatgctgcaaaagaattaatcaatatgcaactagactctggcgactttccacaacaagaacatgttggagtgtctaaccgttacatgtatttcaattatggtaactaccgaaacctgttccctatttgggctctcggagagcttcgccgccaatatgttttaaggaagatatgtaactaa

SEQ ID NO: 18683 - protein, 693 aa, Sorghum bicolor
  misc_feature: The sequence is a functional homolog of SEQ ID NO 15 in US patent 7186884
  misc_feature: Ceres ANNOT ID no. 8704526
  misc_feature (1)..(308): SWISSPROT Homolog: EC 5.4.99.8 Cycloartenol synthase
  misc_feature (504)..(684): SWISSPROT Homolog: EC 5.4.99.17 Squalene--hopene cyclase
  misc_feature (148)..(191): Pfam ID: Prenyltrans Pfam Description: Prenyltransferase and squalene oxidase repeat
  misc_feature (522)..(564): Pfam ID: Prenyltrans Pfam Description: Prenyltransferase and squalene oxidase repeat
  misc_feature (571)..(624): Pfam ID: Prenyltrans Pfam Description: Prenyltransferase and squalene oxidase repeat
MWKLKVSEEASDDPWLSSAYNFLGRAVWEFDPDLGTTEECAEVERVRKEFTDHRFQKRESQDLLMRMQYAKQKKVEIDVPAIKLAKTDDEVTKEIIETSLHRALTQHASLQAPDGHWPAEYSGVLFVMPIMVFALHVTGSLDSVLSTEHRHEICRYLYNHQNEDGGWGTQILGPSTMFGSCLNYVTLRLLGQACENDALTKGRAWILSHGGASAIPQWGKIWLSVIGLYDWSGNNAMIPELWIIPYFLPMHPGRFWCFCRLVYMPMAYLYGKKFVGTLTPTILALRKELYSEPYCNVDWIKARRTCAKIRDTALDELMKHIHYEDETTKYIGACPVNKALNMICCWIENPDSDAFKKHVPRIYDYLWLAEDGMKAKAYDGVQCWEAALIVRAYCSTELAKEFGPTLSKVHNFLKNSQIREDHPDYRTYYRHRSKGSWTVSTSDNGWSVSDCTAEALQALLLLSKLPPELVGEPIQGQRLYDAVDCLLSFMNNDGTFSTYECKRTSSLLELLNPCYRKDEIENCVKNATKFIENKQQPDGSWFGTWGICFIYGTLFAVKGLVAAGKTYKNSYSIRKACNFLLSKQLSSGGWGETYLSSETGIYAEASSPHAVSTAWAMLALLYAGQVERDPTPLYHAAKELINMQLDSGDFPQQEHVGVSNRYMYFNYGNYRNLFPIWALGELRRQYVLRKICN

SEQ ID NO: 18684 - DNA, 921 bp, Sorghum bicolor
  misc_feature: Ceres ANNOT ID no. 8704529
  misc_feature: Encodes the peptide sequence at SEQ ID NO 18685
atgtcgcctcgcctcgccgcggccgcggccgcttccgcccttcctctccctcttcctccgccggcggtcgccgcgccttcccgcgccctccgagctctggtcctgtccccgggcgccgccgccgccgtatcctccagcctgcgccgccgcggcgcgccagcatgcctcgtacgccgcctgtgctcctcccaccactcctccgctgcggcggcgacggcggcgacggcggcgacggcggtggaggaggcgcggcgcgggcggaagcagctcgggatgacgccgccactctacgactacctcctcgccaacgtccgcgagcaccccattctacgggagcttcgcgaggagaccgcggctatgagagggagccagatgcaggtttctcccgctcaggctcagctgttggcaatgcttgtgcaaattcttggggcgaagcgttgcattgaagttggtgtgttcactgggtattcatcattagctgttgcactagccctacctgaatgtggtcacttggttgcttgtgagagggatgaaagatgcctagaagttgccaagaagtactaccaacgtgctggtgttgcacagaagattaatgtgaaacatgctttagctgcggattctctaagatcactacttgattgtggcgaagcttccagctatgacttcgcatttgttgatgcagacaagaaaatgtatgaggaatattttgagcttctactaaagctggtaagagttggtggtttaattgtaatggacaatgtcctttggtatggaagggttgctgatccactggttgatgacccaaagacaatcagtataaggaacttcaataagaaagttttggaggacaagcgtgttgatatcagcatggtgcctattggagatgggatgacaatttgccggaagctagtagatacttga

SEQ ID NO: 18685 - protein, 306 aa, Sorghum bicolor
  misc_feature: Useful for making plants with altered cell wall content and/or composition
  misc_feature: Functional homolog of the protein sequence given in SEQ ID NO 14657
  misc_feature: Ceres ANNOT ID no. 8704529
  misc_feature (106)..(303): SWISSPROT Homolog: EC 2.1.1.104 Caffeoyl-CoA O-methyltransferase
  misc_feature (100)..(303): Pfam ID: Methyltransf_3 Pfam Description: O-methyltransferase
MSPRLAAAAAASALPLPLPPPAVAAPSRALRALVLSPGAAAAVSSSLRRRGAPACLVRRLCSSHHSSAAAATAATAATAVEEARRGRKQLGMTPPLYDYLLANVREHPILRELREETAAMRGSQMQVSPAQAQLLAMLVQILGAKRCIEVGVFTGYSSLAVALALPECGHLVACERDERCLEVAKKYYQRAGVAQKINVKHALAADSLRSLLDCGEASSYDFAFVDADKKMYEEYFELLLKLVRVGGLIVMDNVLWYGRVADPLVDDPKTISIRNFNKKVLEDKRVDISMVPIGDGMTICRKLVDT

SEQ ID NO: 18686 - DNA, 360 bp, Sorghum bicolor
  misc_feature: Ceres ANNOT ID no. 8704570
  misc_feature: Encodes the peptide sequence at SEQ ID NO 18687
atggtgcagcggctcacctaccggaagcggcatagctacgccaccaaatccaaccagacccgcgtcgtcaagacccctggcgggaggcttgtgtaccagtacaccaagaagcgcgcgagcggaccgaagtgccccgtcaccgggaagaagatccaaggaattccacacctgagacctgctgagtacaagaggtccaggttgtcaaggaaccgcaggactgtgaaccgtccatatggtggtgttctgtctggtactgcagttagagagaggatcatccgtgcctttttggtcgaggagcagaagatcgtgaagaaggtgttgaagatccaaaagaccaaggacaaggcctccaagagctag

SEQ ID NO: 18687 - protein, 119 aa, Sorghum bicolor
  misc_feature: Useful for making plants with modulated nitrogen use efficiency
  misc_feature: Functional homolog of the protein sequence given in SEQ ID NO 14309
  misc_feature: Ceres ANNOT ID no. 8704570
  misc_feature (5)..(103): Pfam ID: Ribosomal_L34e Pfam Description: Ribosomal protein L34e
MVQRLTYRKRHSYATKSNQTRVVKTPGGRLVYQYTKKRASGPKCPVTGKKIQGIPHLRPAEYKRSRLSRNRRTVNRPYGGVLSGTAVRERIIRAFLVEEQKIVKKVLKIQKTKDKASKS

SEQ ID NO: 18688 - DNA, 1569 bp, Sorghum bicolor
  misc_feature: Ceres ANNOT ID no. 8704558
  misc_feature: Encodes the peptide sequence at SEQ ID NO 18689
atggaggtaccactaccagtaccaccatgggcatcgtcctccttcgcgacgacgatcctgctggccaccgcgctcttcctcgtgacgacgaccaccgtcctccgccacgggcaactacaagcgcgcaagcgcaacctcctcccgccgccgccgggccctcggccgtggccggtgatcggcaacctgaacctcctaggcacactgccacaccgctccatccacgcgctgtcggcgcggtacggcccgctcatgtccctccgcttcggcgccttccccgccgtcgtcgcctcctccgtcgaggtggccgaggtccttctcaagacccaggacctggcgtacctcgaccgcccacgcatggcctgcggcaagtacaccgtctacaactactccggcatgctgtggtctcactacggcccctactggcggcagctccgcaagctgtgggtcacggagctcctcagcgcccggcagctccggctgacggagcacgtccgcgccgacgagctcgagcacgagcacgtgctgatggtgacgctcaacgtgatctcgcgcatggtgctgggcaagaagtacgtcggcgaggacgacgacgcgtcgtcggcggcggccgcgacgccggaggagttcaggtggatgatcgaggagatcttcttcctcaacggcgcgctccacgtcggggacatggtgccgtggctcagctggctggacccgcacgggtacatcggcaggatgaagcgggtggccaagatgttcgaccggttcatcgagcacgtcctgcgcgagcacggcgagcgccggcggcgggagggcgacgcgttcgtgcccaaggacatggtcgacctgctgctgcaactcgccgacgaccccggcggcctcgacgtccccctcgaccgcgacggcgtcaaggcgtccgttctggagctcatcacgggcggcacggacaccacgtcggtgacggtggagtgggccatgtcggagctcctgaggaagcccgacgtgctgggcaaggtgaccgacgaggtggaccgcgtggtgggccgggaccgcctcgtcgtcggcgagggggacatcccggggctgccgtacctggccgccgtcgtgaaagaggcgacgcggctgcacccggtggtgccgctcctggtcccgcgggtgtcgcgggagcgaacgacggtggccggctacgacgtcccggcggggacgcgcgtgctcgtcaacgtctgggccatcggcagggacgccgccgtgtggggcgacgacgccggggagttccggccggagcggttcctcgccgggagcaagatgagcaaggtggacgtcaagggccaggacatggagctgctgccgttcggcgccggccgccggatgtgccccgccaacggccttgggctcaggatggttcagctcgtgctggcgaacatggtgcacggctacgcgtggcggctccccggcggcatggcgccggaggagctgggcatggaggagaagtttgggatctccgtgtctcgcatgcaccagctcaaggctatccctgagcccaggcttccggatcacgtctacttcgggccgtga

SEQ ID NO: 18689 - protein, 522 aa, Sorghum bicolor
  misc_feature: Useful for making plants with altered carbohydrate content
  misc_feature: Functional homolog of the protein sequence given in SEQ ID NO 14183
  misc_feature: Ceres ANNOT ID no. 8704558
  misc_feature (58)..(519): SWISSPROT Homolog: EC 1.14.13.21 Flavonoid 3'-monooxygenase
  misc_feature (50)..(508): Pfam ID: p450 Pfam Description: Cytochrome P450
MEVPLPVPPWASSSFATTILLATALFLVTTTTVLRHGQLQARKRNLLPPPPGPRPWPVIGNLNLLGTLPHRSIHALSARYGPLMSLRFGAFPAVVASSVEVAEVLLKTQDLAYLDRPRMACGKYTVYNYSGMLWSHYGPYWRQLRKLWVTELLSARQLRLTEHVRADELEHEHVLMVTLNVISRMVLGKKYVGEDDDASSAAAATPEEFRWMIEEIFFLNGALHVGDMVPWLSWLDPHGYIGRMKRVAKMFDRFIEHVLREHGERRRREGDAFVPKDMVDLLLQLADDPGGLDVPLDRDGVKASVLELITGGTDTTSVTVEWAMSELLRKPDVLGKVTDEVDRVVGRDRLVVGEGDIPGLPYLAAVVKEATRLHPVVPLLVPRVSRERTTVAGYDVPAGTRVLVNVWAIGRDAAVWGDDAGEFRPERFLAGSKMSKVDVKGQDMELLPFGAGRRMCPANGLGLRMVQLVLANMVHGYAWRLPGGMAPEELGMEEKFGISVSRMHQLKAIPEPRLPDHVYFGP

SEQ ID NO: 18690 - DNA, 756 bp, Sorghum bicolor
  misc_feature: Ceres ANNOT ID no. 8704595
  misc_feature: Encodes the peptide sequence at SEQ ID NO 18691
atggacctgagcttgggcacactggtacaagacactcaagaagttcaagaagaagaccaagaagacaatttggaccagcaacgagctataggtcaagatctccaccagcaaggtggcggcggcggcggcgagccaagccatggggtggagcgggagcacatgttcgacaaggtgctgacgccgagcgatgttggcaagctcaaccgtctggtggtgccgaagcagcacgcggagcggttcttcccggctgccggcgccgggacgcagctgtgcttccaggactgcggcggcgctctgtggcagttccggtactcctactgggggagcagccagagctacgtgatgaccaaggggtggagccgcttcgtccgcgccgcgcgacttgccgcgggggacaccgtcaccttctcccgcggcgctggcggcggcggccgatacttcatcgagcaccgccactgccagcgccgccgccgccgcgatgtcgatatcagcttcggcgacgctgccaccaccatgccgccgtggccaatagctgtcggagtgcaagccatgaatgggggtgcaacgatggccgtcgagacggcgtccgctgccatcgccggtaccggtcatgacagcgaggtgggaccctcggcggcgaggagcttcaggctcttcggcttcaatgttgagtgcagcggcgacgatgcaccggcggcaccggcttccgccgaagtggagtatgtcgacgtcgacggcgacgacgactacagctag

SEQ ID NO: 18691 - protein, 251 aa, Sorghum bicolor
  misc_feature: The sequence is a functional homolog of SEQ ID NO 1185 in the 10/374,780 US patent application
  misc_feature: The sequence is a functional homolog of SEQ ID NO 40 in the 10/838,616 US patent application
  misc_feature: The sequence is a functional homolog of SEQ ID NO 742 in the 11/435,388 US patent application
  misc_feature: The sequence is a functional homolog of SEQ ID NO 48 in the 10/838,616 US patent application
  misc_feature: Ceres ANNOT ID no. 8704595
  misc_feature (54)..(153): Pfam ID: B3 Pfam Description: B3 DNA binding domain
MDLSLGTLVQDTQEVQEEDQEDNLDQQRAIGQDLHQQGGGGGGEPSHGVEREHMFDKVLTPSDVGKLNRLVVPKQHAERFFPAAGAGTQLCFQDCGGALWQFRYSYWGSSQSYVMTKGWSRFVRAARLAAGDTVTFSRGAGGGGRYFIEHRHCQRRRRRDVDISFGDAATTMPPWPIAVGVQAMNGGATMAVETASAAIAGTGHDSEVGPSAARSFRLFGFNVECSGDDAPAAPASAEVEYVDVDGDDDYS

SEQ ID NO: 18692 - DNA, 1848 bp, Sorghum bicolor
  misc_feature: Ceres ANNOT ID no. 8704599
  misc_feature: Encodes the peptide sequence at SEQ ID NO 18693
atggcgaagacggcggtgatggagctcaggacgctgccgctcggcttccgcttccaccccaccgacgaggagctcgtcacccactacctcaagggcaagatcaccggccagatcaactccgaggccgaggtcatccccgagatcgacgtctgcaagtgcgagccgtgggacctcccagataagtcaattatccagtccgacgatcccgagtggttcttcttcgcgcccaaggaccgcaagtaccccaatggtagcaggtcgaacagggccaccgaggctgggtactggaaggctactggcaaggataggatcatcaagtccaagggtgacaagcgcaagcagcataccattggtatgaagaagacccttgtcttccaccgcggacgtgcccccaagggcgagcgcacagggtggattatgcatgagtaccgcaccaccgagcctcagttcgattctggcgagcagggcggttatgttctttatcgcctcttccggaagcaagaggagaaaaccgagcgccccagcccagaggaaatggatagaagtggctactcacctactccttctcgttcttcacctgacaacctagaggtgaatgaggaagctaatacaccattaaataaggaatctccagaatctgctctgcatgatccgattgagctgccaaattctgttgaaacccatgttgggtcagtgacaaggtggctcgcggacagaaatgataacctggtggctactgcaccggatgtttcccgtataccttcccacggacatgctgctgttgtacctaaggttgatccttcagctggtgcttcagcccacttagttaatccccagaatggaaatgatgattataacaattttgtgtccggtttcccccccattctaccacttgaaaatgcattcttctctgatatacagcaaggagcttttggttttgatggcatcatgaatcctcctgatgccctggatgctttcttgaatcaaacacttgttgatcctgatgaacattcatcaagaacatcaaaagttcagtatgattctgacattccaacagagtttgagaaacagtggaatatgcaggttgagcctcaagatgatctctggtgggcaaacataggtttcgagccagatgagccaaaccctctgcttccttatggcaccactgaccaagatgtactttcggtcgactctgctgctgattccttcaatgagctgttcaatagcatggaagatccaaatgtggggatgactggaattactcttaggcctcaacagttggactccactgtgcaaccaagtcatgtgtttgctaaccatggtgatgcattaaggaggatgcggctacaggttgagtgtagggaggtcataactaaatatgatagtgaagatgaagtatcatgtgttgtaactccagactgtttgaacgaatctgttgagtccactgcagtgaaggatgtggtttctgatggggatgaggctgagtcaacagggattgttattagaagccgtcaccctgctccaagttcaagcctagagagttcattcactcaacagggaactgctatgcgaaggctgcggctacagtcaggcctcaacaaaggcccgtgtcctagtagtgatgattcatcaagctgcatcatagacgaatcagaaagtcagcacaaaacagagaaagcagagattgaagaggatgcaagtacaaacctcactggaagtgttgatgatctacctggcaatagctatgatgatgagcaaaagaacatctctgaacatggctgcggaagacttctgaggaaagcaacaaggatgtcaagcagcaggagggttgtcttgagccacacgtga

SEQ ID NO: 18693 - protein, 615 aa, Sorghum bicolor
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with altered lignin content
  misc_feature: Functional homolog of the protein sequence given in SEQ ID NO 13250
  misc_feature: Useful for biocontainment applications
  misc_feature: Functional homolog of the protein sequence given in SEQ ID NO 13623
  misc_feature: Useful for making plants with modulated oxidative stress sensitivity
  misc_feature: Functional homolog of the protein sequence given in SEQ ID NO 13621
  misc_feature: Ceres ANNOT ID no. 8704599
  misc_feature (12)..(146): Pfam ID: NAM Pfam Description: No apical meristem (NAM) protein
MAKTAVMELRTLPLGFRFHPTDEELVTHYLKGKITGQINSEAEVIPEIDVCKCEPWDLPDKSIIQSDDPEWFFFAPKDRKYPNGSRSNRATEAGYWKATGKDRIIKSKGDKRKQHTIGMKKTLVFHRGRAPKGERTGWIMHEYRTTEPQFDSGEQGGYVLYRLFRKQEEKTERPSPEEMDRSGYSPTPSRSSPDNLEVNEEANTPLNKESPESALHDPIELPNSVETHVGSVTRWLADRNDNLVATAPDVSRIPSHGHAAVVPKVDPSAGASAHLVNPQNGNDDYNNFVSGFPPILPLENAFFSDIQQGAFGFDGIMNPPDALDAFLNQTLVDPDEHSSRTSKVQYDSDIPTEFEKQWNMQVEPQDDLWWANIGFEPDEPNPLLPYGTTDQDVLSVDSAADSFNELFNSMEDPNVGMTGITLRPQQLDSTVQPSHVFANHGDALRRMRLQVECREVITKYDSEDEVSCVVTPDCLNESVESTAVKDVVSDGDEAESTGIVIRSRHPAPSSSLESSFTQQGTAMRRLRLQSGLNKGPCPSSDDSSSCIIDESESQHKTEKAEIEEDASTNLTGSVDDLPGNSYDDEQKNISEHGCGRLLRKATRMSSSRRVVLSHT

SEQ ID NO: 18694 - DNA, 1089 bp, Sorghum bicolor
  misc_feature: Ceres ANNOT ID no. 8704591
  misc_feature: Encodes the peptide sequence at SEQ ID NO 18695
atggggtcgacggcggaggacgtggcggcggtggcggacgaggaggcgtgcatgtacgcgatgcagctggcgtcgtcgtcgatcctccccatgacgctgaagaacgcgctggagctgggcctgctggaggtgcttcagaaggacgccggcaaggcgctggcggcggaggaggtggtggcgcggctgcccgtggcgccgacgaaccccgccgcggcggacatggtggaccgcatgctccgcctcctcgcctcctacgacgtcgtgaagtgccagatggaggacaaggacggcaagtacgagcgtcggtactccgccgcccccgtcggcaagtggctcacccctaacgaggacggcgtctccatggccgccctcgcgctcatgaaccaggacaaggtcctcatggagagctggtactacctgaaggacgcggtgcttgacggcggcatcccgttcaacaaggcgtacgggatgacggcgttcgagtaccacggcacggacccgcgcttcaaccgcgtgttcaacgagggcatgaagaaccacagcgtgatcatcaccaagaagctcctcgagttctacacgggcttcgacgagtccgtctcgacgctcgtcgacgtgggcggcggcatcggcgccaccttacacgccatcacctcccaccactcccacatcaggggcgtcaacttcgacctcccccacgtgatctccgaggcgccgccgttccccggcgtgcagcacgtcggcggggacatgttcaagtcggtgccggccggcgacgccatcctcatgaagtggatcctccacgactggagcgacgcgcactgcgccacgctgctcaagaactgctacgacgcgctgccggagaagggcggcaaggtgatcgtcgtcgagtgcgtgctgccggtgaccaccgacgccgtccccaaggcgcagggcgtgttccatgtcgacatgatcatgctcgcgcataaccccggcggcagggagcggtacgagcgggagttccgtgacctcgccaaggccgctggcttctctgggttcaaggccacctacatctacgccaacgcctgggccatcgagttcatcaagtaa

SEQ ID NO: 18695 - protein, 362 aa, Sorghum bicolor
  misc_feature: Useful for making plants with altered carbohydrate content
  misc_feature: Functional homolog of the protein sequence given in SEQ ID NO 14658
  misc_feature: Useful for making plants with altered cell wall content and/or composition
  misc_feature: Functional homolog of the protein sequence given in SEQ ID NO 14659
  misc_feature: Ceres ANNOT ID no. 8704591
  misc_feature (1)..(362): SWISSPROT Homolog: EC 2.1.1.68 Caffeate O-methyltransferase
  misc_feature (92)..(339): Pfam ID: Methyltransf_2 Pfam Description: O-methyltransferase
  misc_feature (31)..(83): Pfam ID: Dimerisation Pfam Description: Dimerisation domain
MGSTAEDVAAVADEEACMYAMQLASSSILPMTLKNALELGLLEVLQKDAGKALAAEEVVARLPVAPTNPAAADMVDRMLRLLASYDVVKCQMEDKDGKYERRYSAAPVGKWLTPNEDGVSMAALALMNQDKVLMESWYYLKDAVLDGGIPFNKAYGMTAFEYHGTDPRFNRVFNEGMKNHSVIITKKLLEFYTGFDESVSTLVDVGGGIGATLHAITSHHSHIRGVNFDLPHVISEAPPFPGVQHVGGDMFKSVPAGDAILMKWILHDWSDAHCATLLKNCYDALPEKGGKVIVVECVLPVTTDAVPKAQGVFHVDMIMLAHNPGGRERYEREFRDLAKAAGFSGFKATYIYANAWAIEFIK

SEQ ID NO: 18696 - DNA, 642 bp, Sorghum bicolor
  misc_feature: Ceres ANNOT ID no. 8704619
  misc_feature: Encodes the peptide sequence at SEQ ID NO 18697
atgccgattgaggtggagccatccgacacgatcgacgatgttagagaaaagattcatgggcatcagaggctcgtctttgctggcaagcatcttgaggatggaggaacacttaaaggttacaacatccataatggctctaccctgcaccttgattttggcatgcgtatttttgtgaagaccatctctggtaagacaatcactgtggaggtggagccatctgatacgattagtgatgtccaggaaagatatggaagcctaaacgatgagggcaagcttgctgattgcaacattcacaaggagtcaactctgcaccttgacctcagccatcagggtggcatgcaggtttttgtgaaggccctccctagcaagaccgtcacgctgtctgtgaagccatctgacatgatcggcgatgtgaaggcaatgattcaggacaagcagaggctcttctttgatggcaagcagcttgccggatggatttttgtgaaggctttcactggccagaccatcactctcgaggtggaaccatctgacacaatcgacgatactaaggaccagcagattcttgtctttgatggcgaaaagcttgaggatgagcatacacttgcagattacaatatccagaacgagtccacacctgcataa

SEQ ID NO: 18697 - protein, 213 aa, Sorghum bicolor
  misc_feature: Useful for making plants with modulated cold sensitivity
  misc_feature: Functional homolog of the protein sequence given in SEQ ID NO 13521
  misc_feature: Ceres ANNOT ID no. 8704619
  misc_feature (162)..(212): Pfam ID: ubiquitin Pfam Description: Ubiquitin family
  misc_feature (1)..(55): Pfam ID: ubiquitin Pfam Description: Ubiquitin family
  misc_feature (59)..(110): Pfam ID: ubiquitin Pfam Description: Ubiquitin family
MPIEVEPSDTIDDVREKIHGHQRLVFAGKHLEDGGTLKGYNIHNGSTLHLDFGMRIFVKTISGKTITVEVEPSDTISDVQERYGSLNDEGKLADCNIHKESTLHLDLSHQGGMQVFVKALPSKTVTLSVKPSDMIGDVKAMIQDKQRLFFDGKQLAGWIFVKAFTGQTITLEVEPSDTIDDTKDQQILVFDGEKLEDEHTLADYNIQNESTPA

SEQ ID NO: 18698 - DNA, 957 bp, Sorghum bicolor
  misc_feature: Ceres ANNOT ID no. 8704647
  misc_feature: Encodes the peptide sequence at SEQ ID NO 18699
atggagttcatcgacccctgggactcccagacccgcgcccgcgtcgtccattccggcgccaactccacttccttctcctccaccaccaccgccaaagcacccctctccctcccgcacgccgcatcgtgcgccgccgcggccgtcgcgctcctcgccgccgcgtactacctccccgcggcctaccagatcctctcctctctcctcatatggatcgcttcctccctgctcctcgcccccttcgcgccctcctgggccactggcggcgacatctccgtcggccgaggccgcgtcgtccccgctccagaaccggccccagaacccgtctcggaacccacgcccgccccccgtcgcggccgtcgccagaacccggccccgactcccacaaagccctcagatccggtcactcctcccgtccagtcggctgcatcgctgcatccgctgcagaaggcgacggctgcgggtggagccgtcgtggacggcggcgagagggaggaggacgccggcgagtggaccgaccaagacctggagctcctccggcggcagatggtgaagcacccggccggtgagccccagcgctgggagaagatcgccgcggtgttcggcggccgccgcacgcccgagagtgtcatccgggcggcgaagtcgggcgcccccgcggcgggaggaagctcgtttgaccagttcctacgcaagcggaagccgctcgatccgagggccgaggctgctgacattggggacaatgccggaggcgccgagagtgcggacgccgcttggaccgccggggatgacagggccttgctgaacgcgctcaaggagttccccaaggacactgcaatgaggtgggagaaggtggcggcctctgtacccgggaagactaaggccgcgtgcatgaagagggtcactgagctcaagcgagacttcaggagcaccaagacggcatcggagacagcatcttaa

SEQ ID NO: 18699 - protein, 318 aa, Sorghum bicolor
  misc_feature: Useful for making plants with altered alkaloid content
  misc_feature: Functional homolog of the protein sequence given in SEQ ID NO 14660
  misc_feature: Ceres ANNOT ID no. 8704647
MEFIDPWDSQTRARVVHSGANSTSFSSTTTAKAPLSLPHAASCAAAAVALLAAAYYLPAAYQILSSLLIWIASSLLLAPFAPSWATGGDISVGRGRVVPAPEPAPEPVSEPTPAPRRGRRQNPAPTPTKPSDPVTPPVQSAASLHPLQKATAAGGAVVDGGEREEDAGEWTDQDLELLRRQMVKHPAGEPQRWEKIAAVFGGRRTPESVIRAAKSGAPAAGGSSFDQFLRKRKPLDPRAEAADIGDNAGGAESADAAWTAGDDRALLNALKEFPKDTAMRWEKVAASVPGKTKAACMKRVTELKRDFRSTKTASETAS

SEQ ID NO: 18700 - DNA, 426 bp, Sorghum bicolor
  misc_feature: Ceres ANNOT ID no. 8704649
  misc_feature: Encodes the peptide sequence at SEQ ID NO 18701
atgccggttccccttgccccgtatccgactcctccggtgccattcacgccgcctaatggggcccaaagccagcttgtctgcaccgggtgccggaatctcctcatgtatccagctggtgcgacgtctgtctgctgtgccgtttgcagcaccgtcactgccgtgccggctccaggaactgagatggcacagttagtttgtggaggatgccacactctcctgatgtacatacgtggtgcgactagtgtacaatgttcttgctgccacaccgttaacctggctatggaagcaaatcaagttgcgcatgtaaactgcgggaactgccgtatgctgctcatgtaccagtatggagctaggtctgtgaaatgcgcagtctgcaattttgtgacatcagttggggtaagtattcatccatcaaactgcacttaa

SEQ ID NO: 18701 - protein, 141 aa, Sorghum bicolor
  misc_feature: Useful for making plants with modulated oxidative stress sensitivity
  misc_feature: Functional homolog of the protein sequence given in SEQ ID NO 14661
  misc_feature: Ceres ANNOT ID no. 8704649
  misc_feature (104)..(128): Pfam ID: zf-LSD1 Pfam Description: LSD1 zinc finger
  misc_feature (66)..(90): Pfam ID: zf-LSD1 Pfam Description: LSD1 zinc finger
  misc_feature (27)..(51): Pfam ID: zf-LSD1 Pfam Description: LSD1 zinc finger
MPVPLAPYPTPPVPFTPPNGAQSQLVCTGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGVSIHPSNCT

SEQ ID NO: 18702 - DNA, 897 bp, Sorghum bicolor
  misc_feature: Ceres ANNOT ID no. 8704652
  misc_feature: Encodes the peptide sequence at SEQ ID NO 18703
atggcaggcctggatttgggcacaagctcctaccttcaccagcagcaccagcaccaccaccaggtgcccctccacctccaccacgacgacggcgtcggcgcggggggcggcggctctgacgatggccaggactcgctgtcgccgggatcaggcggcggcggtgggggtacgcccagctccgccggaggcgccggaatcggcggcggggagatcgtcgctcgccgcccgcgcggccgcccgccgggctccaagaacaagcccaagccgcccgtgatcatcacccgggagagcgccaacgcgctgcgggcgcacatccttgaggtcgccgccggctgcgacgtcttcgaggcgctcaccgcgtacgcgcgccgcaggcagcgcggcgtctgcgtgctctcggcggctggcaccgtcgcaaacgtcacgctgcgccagccgcagtcgtcccagacgggaccgacctcgccggccgtcgcgacgctccacggcaggttcgagatactctccctcgctggctccttcctcccgcctccggccccgccgggggccaccagcctcgcggccttcctggctgggggccaggggcaggtcgtcggtggtagcgtggctggcgcgctcatcgccgcggggccggtcgtcgtcgtggccgcgtcgttcagcaacgtcgcctacgagaggctgccgctcgaggacggcgacgaggtggcccctccaccgcctgcggggggcgaccagcagcaacccggtgtgccgtttgatcccgcggccgccgccgccgctggcgggcttcccttcttcaacctgccgatggggatgccgccaatgccgatggacggccacgccggctggccggctggcgcccctggcggcggtgtcgggaggccgcccttctcttga

SEQ ID NO: 18703 - protein, 298 aa, Sorghum bicolor
  misc_feature: The sequence is a functional homolog of SEQ ID NO 12 in the 10/669,824 US patent application
  misc_feature: The sequence is a functional homolog of SEQ ID NO 12 in the 10/870,198 US patent application
  misc_feature: The sequence is a functional homolog of SEQ ID NO 1405 in the 10/374,780 US patent application
  misc_feature: The sequence is a functional homolog of SEQ ID NO 34 in the 10/669,824 US patent application
  misc_feature: The sequence is a functional homolog of SEQ ID NO 34 in the 10/870,198 US patent application
  misc_feature: The sequence is a functional homolog of SEQ ID NO 354 in the 11/435,388 US patent application
  misc_feature: The sequence is a functional homolog of SEQ ID NO 356 in the 10/714,887 US patent application
  misc_feature: The sequence is a functional homolog of SEQ ID NO 1406 in the 10/374,780 US patent application
  misc_feature: The sequence is a functional homolog of SEQ ID NO 26 in the 10/669,824 US patent application
  misc_feature: The sequence is a functional homolog of SEQ ID NO 26 in the 10/870,198 US patent application
  misc_feature: The sequence is a functional homolog of SEQ ID NO 352 in the 11/435,388 US patent application
  misc_feature: The sequence is a functional homolog of SEQ ID NO 354 in the 10/714,887 US patent application
  misc_feature: The sequence is a functional homolog of SEQ ID NO 1840 in the 10/412,699 US patent application
  misc_feature: The sequence is a functional homolog of SEQ ID NO 2080 in the 10/374,780 US patent application
  misc_feature: The sequence is a functional homolog of SEQ ID NO 258 in the 10/225,066 US patent application
  misc_feature: The sequence is a functional homolog of SEQ ID NO 304 in the 11/435,388 US patent application
  misc_feature: The sequence is a functional homolog of SEQ ID NO 306 in the 10/714,887 US patent application
  misc_feature: The sequence is a functional homolog of SEQ ID NO 54 in the 10/669,824 US patent application
  misc_feature: The sequence is a functional homolog of SEQ ID NO 54 in the 10/870,198 US patent application
  misc_feature: The sequence is a functional homolog of SEQ ID NO 728 in the 10/412,699 US patent application
  misc_feature: The sequence is a functional homolog of SEQ ID NO 1416 in the 10/374,780 US patent application
  misc_feature: The sequence is a functional homolog of SEQ ID NO 16 in the 10/669,824 US patent application
  misc_feature: The sequence is a functional homolog of SEQ ID NO 16 in the 10/870,198 US patent application
  misc_feature: The sequence is a functional homolog of SEQ ID NO 388 in the 11/435,388 US patent application
  misc_feature: The sequence is a functional homolog of SEQ ID NO 390 in the 10/714,887 US patent application
  misc_feature: The sequence is a functional homolog of SEQ ID NO 1515 in the 11/479,226 US patent application
  misc_feature: The sequence is a functional homolog of SEQ ID NO 226 in the 10/374,780 US patent application
  misc_feature: The sequence is a functional homolog of SEQ ID NO 302 in the 11/435,388 US patent application
  misc_feature: The sequence is a functional homolog of SEQ ID NO 304 in the 10/714,887 US patent application
  misc_feature: The sequence is a functional homolog of SEQ ID NO 52 in the 10/669,824 US patent application
  misc_feature: The sequence is a functional homolog of SEQ ID NO 52 in the 10/870,198 US patent application
  misc_feature: The sequence is a functional homolog of SEQ ID NO 56 in the 10/225,066 US patent application
  misc_feature: The sequence is a functional homolog of SEQ ID NO 726 in the 10/412,699 US patent application
  misc_feature: The sequence is a functional homolog of SEQ ID NO 1417 in the 10/374,780 US patent application
  misc_feature: The sequence is a functional homolog of SEQ ID NO 18 in the 10/669,824 US patent application
  misc_feature: The sequence is a functional homolog of SEQ ID NO 18 in the 10/870,198 US patent application
  misc_feature: The sequence is a functional homolog of SEQ ID NO 390 in the 11/435,388 US patent application
  misc_feature: The sequence is a functional homolog of SEQ ID NO 392 in the 10/714,887 US patent application
  misc_feature: The sequence is a functional homolog of SEQ ID NO 1415 in the 10/374,780 US patent application
  misc_feature: The sequence is a functional homolog of SEQ ID NO 24 in the 10/669,824 US patent application
  misc_feature: The sequence is a functional homolog of SEQ ID NO 24 in the 10/870,198 US patent application
  misc_feature: The sequence is a functional homolog of SEQ ID NO 386 in the 11/435,388 US patent application
  misc_feature: The sequence is a functional homolog of SEQ ID NO 388 in the 10/714,887 US patent application
  misc_feature: The sequence is a functional homolog of SEQ ID NO 1408 in the 10/374,780 US patent application
  misc_feature: The sequence is a functional homolog of SEQ ID NO 28 in the 10/669,824 US patent application
  misc_feature: The sequence is a functional homolog of SEQ ID NO 28 in the 10/870,198 US patent application
  misc_feature: The sequence is a functional homolog of SEQ ID NO 350 in the 11/435,388 US patent application
  misc_feature: The sequence is a functional homolog of SEQ ID NO 352 in the 10/714,887 US patent application
  misc_feature: The sequence is a functional homolog of SEQ ID NO 1412 in the 10/374,780 US patent application
  misc_feature: The sequence is a functional homolog of SEQ ID NO 2038 in the 10/374,780 US patent application
  misc_feature: The sequence is a functional homolog of SEQ ID NO 2370 in the 10/374,780 US patent application
  misc_feature: The sequence is a functional homolog of SEQ ID NO 264 in the 10/714,887 US patent application
  misc_feature: The sequence is a functional homolog of SEQ ID NO 264 in the 11/435,388 US patent application
  misc_feature: The sequence is a functional homolog of SEQ ID NO 536 in the 10/225,066 US patent application
  misc_feature: The sequence is a functional homolog of SEQ ID NO 1395 in the 10/374,780 US patent application
  misc_feature: The sequence is a functional homolog of SEQ ID NO 1507 in the 10/412,699 US patent application
  misc_feature: The sequence is a functional homolog of SEQ ID NO 22 in the 10/669,824 US patent application
  misc_feature: The sequence is a functional homolog of SEQ ID NO 22 in the 10/870,198 US patent application
  misc_feature: The sequence is a functional homolog of SEQ ID NO 346 in the 11/435,388 US patent application
  misc_feature: The sequence is a functional homolog of SEQ ID NO 348 in the 10/714,887 US patent application
  misc_feature: The sequence is a functional homolog of SEQ ID NO 2528 in the 10/374,780 US patent application
  misc_feature: The sequence is a functional homolog of SEQ ID NO 256 in the 10/225,066 US patent application
  misc_feature: The sequence is a functional homolog of SEQ ID NO 298 in the 11/435,388 US patent application
  misc_feature: The sequence is a functional homolog of SEQ ID NO 300 in the 10/714,887 US patent application
  misc_feature: The sequence is a functional homolog of SEQ ID NO 48 in the 10/669,824 US patent application
  misc_feature: The sequence is a functional homolog of SEQ ID NO 48 in the 10/870,198 US patent application
  misc_feature: The sequence is a functional homolog of SEQ ID NO 1403 in the 10/374,780 US patent application
  misc_feature: The sequence is a functional homolog of SEQ ID NO 1404 in the 10/374,780 US patent application
  misc_feature: The sequence is a functional homolog of SEQ ID NO 32 in the 10/669,824 US patent application
  misc_feature: The sequence is a functional homolog of SEQ ID NO 32 in the 10/870,198 US patent application
  misc_feature: The sequence is a functional homolog of SEQ ID NO 348 in the 11/435,388 US patent application
  misc_feature: The sequence is a functional homolog of SEQ ID NO 350 in the 10/714,887 US patent application
  misc_feature: Useful for making plants with modulated biomass
  misc_feature: Useful for making plants with modulated flowering time
  misc_feature: Functional homolog of the protein sequence given in SEQ ID NO 14219
  misc_feature: The sequence is a functional homolog of SEQ ID NO 1400 in the 10/374,780 US patent application
  misc_feature: The sequence is a functional homolog of SEQ ID NO 1510 in the 10/412,699 US patent application
  misc_feature: The sequence is a functional homolog of SEQ ID NO 10 in the 10/669,824 US patent application
  misc_feature: The sequence is a functional homolog of SEQ ID NO 10 in the 10/870,198 US patent application
  misc_feature: The sequence is a functional homolog of SEQ ID NO 1399 in the 10/374,780 US patent application
  misc_feature: The sequence is a functional homolog of SEQ ID NO 1509 in the 10/412,699 US patent application
  misc_feature: The sequence is a functional homolog of SEQ ID NO 340 in the 11/435,388 US patent application
  misc_feature: The sequence is a functional homolog of SEQ ID NO 342 in the 10/714,887 US patent application
  misc_feature: The sequence is a functional homolog of SEQ ID NO 66 in the 10/669,824 US patent application
  misc_feature: The sequence is a functional homolog of SEQ ID NO 66 in the 10/870,198 US patent application
  misc_feature: The sequence is a functional homolog of SEQ ID NO 322 in the 11/435,388 US patent application
  misc_feature: The sequence is a functional homolog of SEQ ID NO 324 in the 10/714,887 US patent application
  misc_feature: The sequence is a functional homolog of SEQ ID NO 50 in the 10/669,824 US patent application
  misc_feature: The sequence is a functional homolog of SEQ ID NO 50 in the 10/870,198 US patent application
  misc_feature: The sequence is a functional homolog of SEQ ID NO 1409 in the 10/374,780 US patent application
  misc_feature: The sequence is a functional homolog of SEQ ID NO 40 in the 10/669,824 US patent application
  misc_feature: The sequence is a functional homolog of SEQ ID NO 40 in the 10/870,198 US patent application
  misc_feature: The sequence is a functional homolog of SEQ ID NO 412 in the 11/435,388 US patent application
  misc_feature: The sequence is a functional homolog of SEQ ID NO 414 in the 10/714,887 US patent application
  misc_feature: The sequence is a functional homolog of SEQ ID NO 14 in the 10/669,824 US patent application
  misc_feature: The sequence is a functional homolog of SEQ ID NO 14 in the 10/870,198 US patent application
  misc_feature: The sequence is a functional homolog of SEQ ID NO 384 in the 11/435,388 US patent application
  misc_feature: The sequence is a functional homolog of SEQ ID NO 386 in the 10/714,887 US patent application
  misc_feature: The sequence is a functional homolog of SEQ ID NO 1413 in the 10/374,780 US patent application
  misc_feature: The sequence is a functional homolog of SEQ ID NO 1402 in the 10/374,780 US patent application
  misc_feature: The sequence is a functional homolog of SEQ ID NO 1410 in the 10/374,780 US patent application
  misc_feature: The sequence is a functional homolog of SEQ ID NO 344 in the 11/435,388 US patent application
  misc_feature: The sequence is a functional homolog of SEQ ID NO 346 in the 10/714,887 US patent application
  misc_feature: The sequence is a functional homolog of SEQ ID NO 38 in the 10/669,824 US patent application
  misc_feature: The sequence is a functional homolog of SEQ ID NO 38 in the 10/870,198 US patent application
  misc_feature: The sequence is a functional homolog of SEQ ID NO 1908 in the 10/412,699 US patent application
  misc_feature: The sequence is a functional homolog of SEQ ID NO 2166 in the 10/374,780 US patent application
  misc_feature: The sequence is a functional homolog of SEQ ID NO 318 in the 11/435,388 US patent application
  misc_feature: The sequence is a functional homolog of SEQ ID NO 320 in the 10/714,887 US patent application
  misc_feature: The sequence is a functional homolog of SEQ ID NO 8 in the 10/669,824 US patent application
  misc_feature: The sequence is a functional homolog of SEQ ID NO 8 in the 10/870,198 US patent application
  misc_feature: The sequence is a functional homolog of SEQ ID NO 94 in the 10/225,066 US patent application
  misc_feature: The sequence is a functional homolog of SEQ ID NO 64 in the 10/669,824 US patent application
  misc_feature: The sequence is a functional homolog of SEQ ID NO 64 in the 10/870,198 US patent application
  misc_feature: The sequence is a functional homolog of SEQ ID NO 1495 in the 11/479,226 US patent application
  misc_feature: The sequence is a functional homolog of SEQ ID NO 1838 in the 10/412,699 US patent application
  misc_feature: The sequence is a functional homolog of SEQ ID NO 2078 in the 10/374,780 US patent application
  misc_feature: The sequence is a functional homolog of SEQ ID NO 296 in the 11/435,388 US patent application
  misc_feature: The sequence is a functional homolog of SEQ ID NO 298 in the 10/714,887 US patent application
  misc_feature: The sequence is a functional homolog of SEQ ID NO 4 in the 10/669,824 US patent application
  misc_feature: The sequence is a functional homolog of SEQ ID NO 4 in the 10/870,198 US patent application
  misc_feature: The sequence is a functional homolog of SEQ ID NO 54 in the 10/225,066 US patent application
  misc_feature: The sequence is a functional homolog of SEQ ID NO 718 in the 10/412,699 US patent application
  misc_feature: The sequence is a functional homolog of SEQ ID NO 1401 in the 10/374,780 US patent application
  misc_feature: The sequence is a functional homolog of SEQ ID NO 30 in the 10/669,824 US patent application
  misc_feature: The sequence is a functional homolog of SEQ ID NO 30 in the 10/870,198 US patent application
  misc_feature: The sequence is a functional homolog of SEQ ID NO 342 in the 11/435,388 US patent application
  misc_feature: The sequence is a functional homolog of SEQ ID NO 344 in the 10/714,887 US patent application
  misc_feature: The sequence is a functional homolog of SEQ ID NO 1928 in the 11/479,226 US patent application
  misc_feature: The sequence is a functional homolog of SEQ ID NO 86 in the 10/870,198 US patent application
  misc_feature: The sequence is a functional homolog of SEQ ID NO 248 in the 10/714,887 US patent application
  misc_feature: The sequence is a functional homolog of SEQ ID NO 248 in the 11/435,388 US patent application
  misc_feature: The sequence is a functional homolog of SEQ ID NO 456 in the 10/374,780 US patent application
  misc_feature: The sequence is a functional homolog of SEQ ID NO 498 in the 10/225,066 US patent application
  misc_feature: The sequence is a functional homolog of SEQ ID NO 84 in the 10/870,198 US patent application
  misc_feature: The sequence is a functional homolog of SEQ ID NO 92 in the 10/225,068 US patent application
  misc_feature: The sequence is a functional homolog of SEQ ID NO 150 in the 10/225,066 US patent application
  misc_feature: The sequence is a functional homolog of SEQ ID NO 1511 in the 11/479,226 US patent application
  misc_feature: The sequence is a functional homolog of SEQ ID NO 2 in the 10/669,824 US patent application
  misc_feature: The sequence is a functional homolog of SEQ ID NO 2 in the 10/870,198 US patent application
  misc_feature: The sequence is a functional homolog of SEQ ID NO 224 in the 10/374,780 US patent application
  misc_feature: The sequence is a functional homolog of SEQ ID NO 300 in the 11/435,388 US patent application
  misc_feature: The sequence is a functional homolog of SEQ ID NO 302 in the 10/714,887 US patent application
  misc_feature: The sequence is a functional homolog of SEQ ID NO 724 in the 10/412,699 US patent application
  misc_feature: The sequence is a functional homolog of SEQ ID NO 1411 in the 10/374,780 US patent application
  misc_feature: The sequence is a functional homolog of SEQ ID NO 36 in the 10/669,824 US patent application
  misc_feature: The sequence is a functional homolog of SEQ ID NO 36 in the 10/870,198 US patent application
  misc_feature: The sequence is a functional homolog of SEQ ID NO 392 in the 11/435,388 US patent application
  misc_feature: The sequence is a functional homolog of SEQ ID NO 394 in the 10/714,887 US patent application
  misc_feature: The sequence is a functional homolog of SEQ ID NO 1418 in the 10/374,780 US patent application
  misc_feature: The sequence is a functional homolog of SEQ ID NO 88 in the 10/669,824 US patent application
  misc_feature: The sequence is a functional homolog of SEQ ID NO 90 in the 10/669,824 US patent application
  misc_feature: The sequence is a functional homolog of SEQ ID NO 92 in the 10/669,824 US patent application
  misc_feature: The sequence is a functional homolog of SEQ ID NO 89 in the 10/669,824 US patent application
  misc_feature: The sequence is a functional homolog of SEQ ID NO 87 in the 10/669,824 US patent application
  misc_feature: Ceres ANNOT ID no. 8704652
MAGLDLGTSSYLHQQHQHHHQVPLHLHHDDGVGAGGGGSDDGQDSLSPGSGGGGGGTPSSAGGAGIGGGEIVARRPRGRPPGSKNKPKPPVIITRESANALRAHILEVAAGCDVFEALTAYARRRQRGVCVLSAAGTVANVTLRQPQSSQTGPTSPAVATLHGRFEILSLAGSFLPPPAPPGATSLAAFLAGGQGQVVGGSVAGALIAAGPVVVVAASFSNVAYERLPLEDGDEVAPPPPAGGDQQQPGVPFDPAAAAAAGGLPFFNLPMGMPPMPMDGHAGWPAGAPGGGVGRPPFS

SEQ ID NO: 18704 - DNA, 2985 bp, Sorghum bicolor
  misc_feature: Ceres ANNOT ID no. 8704665
  misc_feature: Encodes the peptide sequence at SEQ ID NO 18705
atggcgccgggcggcggagacggccggcgcaacggcgagggacagcagcaggcgaacggcaacaacaacaacaacaacagcaacgctaaggctaagcacgggtgcgtgtgcgggttccccgtgtgcgcgtgcgccggcgcggccgcggtggcgtccgcggcctcctccgccgacatggaccgcgtggccgccgcgcagaccgagggccagatcggcgccgtcaacgacgagagctggatcgccgtcgacctgagcgacgacctctccggcgacggcggcggcgccgaccccggcgtcgcgatcgaggaccgccccgtcttccgcaccgagaagatcaagggcatcctcctccacccctacagatttgcctgcatagaaggagtagctagggggaggggcgacactaggcgtggcttgcatgtgagtccaagcaagccatcattgaaagcctccaaattccgggtgctcatcttcgtgcgcctgatcgcgttcacgctgttcgtcatctggcgtatctcgcaccgcaacccggacgcgatgtggctgtgggtgacgtcgatcgcgggcgagttctggttcggcttctcctggctgctggaccagctccccaagctgaacccgatcaaccgcgtcccggacctcgcggtgctccggcagcggttcgaccgcgccgacggcacgtcccgcctcccgggcctggacatcttcgtcaccacggcggacccgttcaaggagcccatcctgagcacggccaactccatcctctccatccttgccgccgactaccccgtggagcgcaacacgtgctacctctccgacgactccgggatgctgctcacctacgaggccatggcggaggccgccaagttcgccaccgtctgggtgcccttctgccggaagcacggcatcgagcctcgtggccccgagagctacttcgagctcaagtcgcacccctacatggggaggtcgcaggaggacttcgtcaacgaccgccgccgtgtccgcaaggagtacgacgagttcaaggcccggatcaatggcctcgagcatgatatcaagcagaggtccgacgcgtttaacgccgctagggggcttaaggacggcgagcccagagctacgtggatggccgacgggaaccagtgggagggcacatgggttgagccatcggagaaccaccgcaagggtgaccacgccggcatcgtctatgtgcttctgaaccacccgagccacagccgtcagctcggcccgccggcgagcgcggacaacccgctggacttcagcatggtggacgttcgcctccccatgctggtgtacgtctcccgtgagaagcggcccgggttcaaccacgagaagaaggccggcgccatgaacgcgctgacccgctgctccgccgtgatctccaactcgcccttcatcctcaacctggactgcgaccactacatcaacaactcgcaggcgcttcgcgccggcatctgcttcatgctcggccgggacagcgacacggtggcgttcgtgcagttcccgcagcggttcgagggcgtggaccccacggacctgtacgccaaccacaaccgcatcttcttcgacggcacgctccgggcgctggacggcatgcagggccccatctacgtcggcaccggctgcatgttccgccgcatcacgctctacggcttcgacccgccgaggatcaacgtcggcgggccgtgcttcccgtcgctcggcggcatgttcgccaagaccaagtacgagaagcccgggctggagctcaccaccaaggccgccgtcgccaagggcaagcacggcttcctcccgttgcccaagaagtcgtacggcaagtcggacgcgttcgtcgacaccatcccgagggcgtctcacccgtcgccgttcctgagcgccgacgaggccgccgccatcgtcgccgacgaggccatgatcaccgaggccgtggaggtgtgcacggcggcgtacgagaagaagaccggctggggcagcgacatcggctgggtgtacggcaccgtcaccgaggacgtggtgacggggtaccggatgcacatcaaggggtggcggtctcgctactgctccatctacccgcacgccttcatcggcaccgccccgatcaacctgacggagcggctgtaccaggtgctccgctggtccacggggtcgctggagatcttcttctcccggaacaacccgctgttcggcagcacgttcctgcacccgctgcagcgcgtggcgtacatcaacatcaccacctacccgttcacggcgctgttcctcatcttctacaccaccgtgccggcgctgtcgttcgtgacggggcacttcatcgtgcagcggccgaccaccatgttctacgtgtacctggccatcgtgctggggacgctgctcatcctggccgtcctggaggtgaaatgggcgggcgtcaccgtcttcgagtggttcaggaacgggcagttctggatgacggccagctgctccgcgtacctggccgccgtgtgccaggtgctggtgaaagtggtgttccggcgagacatctccttcaagctcacatccaagcagcccgccggcgacgagaagaaggacccctacgccgacctgtacgtggtgcgctggacctggctcatggtgacccccatcatcatcatcctcgtcaacatcatcggatccgccgtggcgttcgccaaggtgctggacggcgagtggacgcactggctcaaggtggccggcggcgtcttcttcaacttctgggtgctgttccacctctacccgttcgccaagggcctcctcgggaggcacggcaagacccccgtggtggtgctcgtctggtgggcattcaccttcgtcatcaccgccgtgctctacatcaacatcccccacatccatggccccggcggcaagcacggcggcgcgatcggaaagcacggcgccgcccaccacggcaagaagttcgacctcgacaacctctcctacaactggccgtga

SEQ ID NO: 18705 - protein, 994 aa, Sorghum bicolor
  misc_feature: Useful for making plants with altered cell wall content and/or composition
  misc_feature: Functional homolog of the protein sequence given in SEQ ID NO 13647
  misc_feature: Useful for making plants with modulated plant growth and development
  misc_feature: Functional homolog of the protein sequence given in SEQ ID NO 13629
  misc_feature: Ceres ANNOT ID no. 8704665
  misc_feature (644)..(956): SWISSPROT Homolog: EC 2.4.1.12 Cellulose synthase (UDP-forming)
  misc_feature (138)..(971): Pfam ID: Cellulose_synt Pfam Description: Cellulose synthase
MAPGGGDGRRNGEGQQQANGNNNNNNSNAKAKHGCVCGFPVCACAGAAAVASAASSADMDRVAAAQTEGQIGAVNDESWIAVDLSDDLSGDGGGADPGVAIEDRPVFRTEKIKGILLHPYRFACIEGVARGRGDTRRGLHVSPSKPSLKASKFRVLIFVRLIAFTLFVIWRISHRNPDAMWLWVTSIAGEFWFGFSWLLDQLPKLNPINRVPDLAVLRQRFDRADGTSRLPGLDIFVTTADPFKEPILSTANSILSILAADYPVERNTCYLSDDSGMLLTYEAMAEAAKFATVWVPFCRKHGIEPRGPESYFELKSHPYMGRSQEDFVNDRRRVRKEYDEFKARINGLEHDIKQRSDAFNAARGLKDGEPRATWMADGNQWEGTWVEPSENHRKGDHAGIVYVLLNHPSHSRQLGPPASADNPLDFSMVDVRLPMLVYVSREKRPGFNHEKKAGAMNALTRCSAVISNSPFILNLDCDHYINNSQALRAGICFMLGRDSDTVAFVQFPQRFEGVDPTDLYANHNRIFFDGTLRALDGMQGPIYVGTGCMFRRITLYGFDPPRINVGGPCFPSLGGMFAKTKYEKPGLELTTKAAVAKGKHGFLPLPKKSYGKSDAFVDTIPRASHPSPFLSADEAAAIVADEAMITEAVEVCTAAYEKKTGWGSDIGWVYGTVTEDVVTGYRMHIKGWRSRYCSIYPHAFIGTAPINLTERLYQVLRWSTGSLEIFFSRNNPLFGSTFLHPLQRVAYINITTYPFTALFLIFYTTVPALSFVTGHFIVQRPTTMFYVYLAIVLGTLLILAVLEVKWAGVTVFEWFRNGQFWMTASCSAYLAAVCQVLVKVVFRRDISFKLTSKQPAGDEKKDPYADLYVVRWTWLMVTPIIIILVNIIGSAVAFAKVLDGEWTHWLKVAGGVFFNFWVLFHLYPFAKGLLGRHGKTPVVVLVWWAFTFVITAVLYINIPHIHGPGGKHGGAIGKHGAAHHGKKFDLDNLSYNWP

SEQ ID NO: 18706 - DNA, 1056 bp, Sorghum bicolor
  misc_feature: Ceres ANNOT ID no. 8704675
  misc_feature: Encodes the peptide sequence at SEQ ID NO 18707
atggggacggactactacaatgtgctcaaggtgaaccggaacgccacggaggaggacctcaagaagtcgtaccgccggctggccatgaagtggcaccctgacaagaaccctggcgacgtcaagaaggaagccgaggccaaattcaagaagatctccgaggcctacgaggttttgagtgatccccagaagagggcgatatatgatcagtatggtgaggaaggtctgaaggctgcagatggtggtggttccacatccatgaacggggctgccaagcaacgtttcaatcctcgcaatgctgaagacgtgtttgctgagttctttggcagcagcaagcctttcgagaacatggggcgagcgaagtcaatgaggttccagacggaaggtgctggcactttcggtgggttcggtgggaatgagaacaagtttagatcatacaatgattcgtcggttggcaccagttcaagtcaggctcgaaagccaccgcctgtggaaaccaaactgccctgctcacttgaagagttatacgcaggttcaacacgcaagatgaagatatccaggaacgttgtcaagcccaatgggcaactagggaccgaatcggagattttaacaatcgatataaagcctggctggaagaagggaacgaagatcacattccctgacaagggcaacgagcagccaaaccagctccctgccgatctcgtctttgttatcgatgagaagccccatgatctgtacacaagggaaagcaacgatctcctggtccaccggaagattgatttggtggatgcattggcaggaactacggtcaatctgaagacactcgacgggcgtgacctggtgattaagctcactgatgtggtgacacctggttatgagcttgtgattgcaaaggaggggatgcctattgtcaaggagaacgggagaagaggcaacctgaggatcaagttcgatgtcaattttcctaagaggttgtcgtcagagcagcggcacagcattaggaaggttcttggagctcaacctcagcagcacccaaaaccccaggtgcattattattag

SEQ ID NO: 18707 - protein, 351 aa, Sorghum bicolor
  misc_feature: Useful for making plants with modulated heat sensitivity
  misc_feature: Functional homolog of the protein sequence given in SEQ ID NO 13683
  misc_feature: Ceres ANNOT ID no. 8704675
  misc_feature (4)..(68): Pfam ID: DnaJ Pfam Description: DnaJ domain
  misc_feature (214)..(336): Pfam ID: DnaJ_C Pfam Description: DnaJ C terminal region
MGTDYYNVLKVNRNATEEDLKKSYRRLAMKWHPDKNPGDVKKEAEAKFKKISEAYEVLSDPQKRAIYDQYGEEGLKAADGGGSTSMNGAAKQRFNPRNAEDVFAEFFGSSKPFENMGRAKSMRFQTEGAGTFGGFGGNENKFRSYNDSSVGTSSSQARKPPPVETKLPCSLEELYAGSTRKMKISRNVVKPNGQLGTESEILTIDIKPGWKKGTKITFPDKGNEQPNQLPADLVFVIDEKPHDLYTRESNDLLVHRKIDLVDALAGTTVNLKTLDGRDLVIKLTDVVTPGYELVIAKEGMPIVKENGRRGNLRIKFDVNFPKRLSSEQRHSIRKVLGAQPQQHPKPQVHYY

SEQ ID NO: 18708 - DNA, 714 bp, Sorghum bicolor
  misc_feature: Ceres ANNOT ID no. 8704658
  misc_feature: Encodes the peptide sequence at SEQ ID NO 18709
atggactacaccaacgccatccacatcatcccggacgcggcgggtcccgacgcctggaccaacgcggcgccgtccacgggcggggatgccgccatctgggccaccgaggacgactaccgccagtggaacgcagacccgggctacggcgaccggaacccgtcctcgcgggcggggagcgagcagccgccgccaggcaagaaggctcgcggcggggccggggccgggggcgggggtgggggcgggggcggcagcgatggcgggagcgggagcagcactagtaaatcgcgcgccatcgggaagatgttcttcaagaccaagctctgctgcaagttccgcgccgggacctgcccctacgtcaccaactgcaactttgcgcacggcatggaggagctccgcaagccaccgcccaactggcaggagatcgtggccgcccatgaggaggccacggagcagcgggaggagcaccagatccccatcatgacctcgggaagtgtcgtcgctggagacggcggcggcggcggcagctcgcaagggggcagggcgtacaagggtcgacactgcaagaagttctacactgaagagggctgcccctatggtgacgcgtgcaccttcctgcacgatgagcagtccaaggcgcgggagagcgtggccatcagtctctcgcccacggttgggctgggggatacaatgctgctgcctctgccaatggagtga

SEQ ID NO: 18709 - protein, 237 aa, Sorghum bicolor
  misc_feature: The sequence is a functional homolog of SEQ ID NO 644 in the 10/666,642 US patent application
  misc_feature: Ceres ANNOT ID no. 8704658
  misc_feature (103)..(128): Pfam ID: zf-CCCH Pfam Description: Zinc finger C-x8-C-x5-C-x3-H type (and similar)
  misc_feature (182)..(208): Pfam ID: zf-CCCH Pfam Description: Zinc finger C-x8-C-x5-C-x3-H type (and similar)
MDYTNAIHIIPDAAGPDAWTNAAPSTGGDAAIWATEDDYRQWNADPGYGDRNPSSRAGSEQPPPGKKARGGAGAGGGGGGGGGSDGGSGSSTSKSRAIGKMFFKTKLCCKFRAGTCPYVTNCNFAHGMEELRKPPPNWQEIVAAHEEATEQREEHQIPIMTSGSVVAGDGGGGGSSQGGRAYKGRHCKKFYTEEGCPYGDACTFLHDEQSKARESVAISLSPTVGLGDTMLLPLPME

SEQ ID NO: 18710 - DNA, 498 bp, Sorghum bicolor
  misc_feature: Ceres ANNOT ID no. 8704672
  misc_feature: Encodes the peptide sequence at SEQ ID NO 18711
atggatcctaagaagaaggagaaagagctactggcatgggagcaggacctgaaacggcgggaacaggatattaaacggagggaggatgcaatgaacagagctggtgtcactgtggaagtgagaaattggccgcagttctatcccatcatacatcatgatatagccggcgaaataccaatccatgctcaaaagttgcaatacacagcatttgctagctggcttgatatcgttattttcctcctcgctgtaatctatgcaatatccgggtgtcctctttcatacatactttggtacagacctctgtaccgtgtgcatgttggattttgtgtcattgctgcaatcgctcctccaataatatttagggggaaaactctcacgggtattcttgttgcaatagaagcgctttatcttttcggttttgcactgtttaccttcgaatctcttataagcatctgggtgcttgagagagtgtacatgtatttcagagggcataggtga

SEQ ID NO: 18711 - protein, 165 aa, Sorghum bicolor
  misc_feature: Useful for biocontainment applications
  misc_feature: Functional homolog of the protein sequence given in SEQ ID NO 13043
  misc_feature: Ceres ANNOT ID no. 8704672
  misc_feature (39)..(165): Pfam ID: SCAMP Pfam Description: SCAMP family
MDPKKKEKELLAWEQDLKRREQDIKRREDAMNRAGVTVEVRNWPQFYPIIHHDIAGEIPIHAQKLQYTAFASWLDIVIFLLAVIYAISGCPLSYILWYRPLYRVHVGFCVIAAIAPPIIFRGKTLTGILVAIEALYLFGFALFTFESLISIWVLERVYMYFRGHR

SEQ ID NO: 18712 - DNA, 165 bp, Sorghum bicolor
  misc_feature: Ceres ANNOT ID no. 8704698
  misc_feature: Encodes the peptide sequence at SEQ ID NO 18713
atgtcagcgagtagcacgtccatagacgcgtcaggagaaccggtcccaaaatcttcagtgttaatggcggcatcgaagtacatagcggcctggtgctgtctagagaacgtcgccttcctcaactgctacaagaaggacgacagattcgtccccctgctagaatga

SEQ ID NO: 18713 - protein, 54 aa, Sorghum bicolor
  misc_feature: Useful for making plants with modulated nitrogen use efficiency
  misc_feature: Useful for making plants with modulated oxidative stress sensitivity
  misc_feature: Functional homolog of the protein sequence given in SEQ ID NO 14206
  misc_feature: Ceres ANNOT ID no. 8704698
MSASSTSIDASGEPVPKSSVLMAASKYIAAWCCLENVAFLNCYKKDDRFVPLLE

SEQ ID NO: 18714 - DNA, 1497 bp, Sorghum bicolor
  misc_feature: Ceres ANNOT ID no. 8704772
  misc_feature: Encodes the peptide sequence at SEQ ID NO 18715
atgccgcagccgcacgtcgtggtggtgccctacccgggctccggcaacatcaacccggcgctgcagctggccctgcttctgcgccaccacggcgtcttcgtcaccttcgtcgtcaccgagcacaacctccgccgcgcccaggccgccgccaccgaggagggcgccgtgagcggttgcgacgacgacgcgttccggatcgagaccatcccggacgggctggtggacgccgaccgcgaccagcaggactacgacctcggcctgtccaaggccaccacccaccggtgcgcggcgccgctgagggagctcgtcgcgcggctccgcggcggcggcggcggcgcgacgcccgacgtgcctcccgtcacgtgtgtgctgcccacggcgctcatgagcttcgccctggaggtggcccgagagctcggcgtccccagcatggtgctctggaccagcagcgcggcggcgctcatgggccacatgaggctccgggagctcagggaaagaggctacctaccactcaaagatgacagctgcttaacgaacggctacctagagacgacgatgatcgactggatccccggcatgccgccgatcagcctcggcgacatctccagcttcgtccgcaccaccgatcccgacgatttcggcctgtggttcaacgacaccgaggccaacaactgcaccaaggccggcgcgctcgtcgtcaacacgttcgacgcccttgagccggacgtcctcgccgccctccgtgccgagtacccgcgcgtctacaccgtcgggccgctgggctcccttctccgcctccggcaccacgacgacgatgaggccgccgccgccgccggcggcggctcgcttgacctgagcctgtggaagcacgacaccgagtgcctggcgtggctggacgcgcaggcgccgggctccgtcgtgtacgccaacttcggcagcctgacggtggtcaccgcggcgcagctggcggagttcgcgtggggcctcgcggcgacgggccgcccgttcctgtgggtcatcagggaggacctcgtcgccgtcgccggcggcgggccggcggcggcgctgctgccgccggcgttcgcggcggagacggcggagcggggccgcgtggccgcgtggtgcccgcaggagcgggtgctgcggcaccgcgccgtggggtgcttcctgacgcacaacgggtggaactccacgtgcgagtgcctcgccgccggcgtgccgatggtgtgctggccggtgttcgcggaccagttcaccgtctgcaagtacgtgtgcgaggtgtggggcgtggggcgccggctggacgcggaggtgaggagggagcaggtcgctgcgcgtgtcggcgaggtgatggagagcgaggaggtccggagcagcgcggcgaggtggaaggcggtggccgaggaagctgccggcgccggcgggtcgtcgcacgagaacctgctgggcgcggtggcagcgctcggggtcagctcgctcaactccgccgaggcatga

SEQ ID NO: 18715 - protein, 498 aa, Sorghum bicolor
  misc_feature: Useful for making plants with altered carbohydrate content
  misc_feature: Functional homolog of the protein sequence given in SEQ ID NO 14529
  misc_feature: Ceres ANNOT ID no. 8704772
  misc_feature (121)..(458): SWISSPROT Homolog: EC 2.4.1.121 Indole-3-acetate beta-glucosyltransferase
  misc_feature (4)..(492): Pfam ID: UDPGT Pfam Description: UDP-glucoronosyl and UDP-glucosyl transferase
MPQPHVVVVPYPGSGNINPALQLALLLRHHGVFVTFVVTEHNLRRAQAAATEEGAVSGCDDDAFRIETIPDGLVDADRDQQDYDLGLSKATTHRCAAPLRELVARLRGGGGGATPDVPPVTCVLPTALMSFALEVARELGVPSMVLWTSSAAALMGHMRLRELRERGYLPLKDDSCLTNGYLETTMIDWIPGMPPISLGDISSFVRTTDPDDFGLWFNDTEANNCTKAGALVVNTFDALEPDVLAALRAEYPRVYTVGPLGSLLRLRHHDDDEAAAAAGGGSLDLSLWKHDTECLAWLDAQAPGSVVYANFGSLTVVTAAQLAEFAWGLAATGRPFLWVIREDLVAVAGGGPAAALLPPAFAAETAERGRVAAWCPQERVLRHRAVGCFLTHNGWNSTCECLAAGVPMVCWPVFADQFTVCKYVCEVWGVGRRLDAEVRREQVAARVGEVMESEEVRSSAARWKAVAEEAAGAGGSSHENLLGAVAALGVSSLNSAEA

SEQ ID NO: 18716 - DNA, 2217 bp, Sorghum bicolor
  misc_feature: Ceres ANNOT ID no. 8704777
  misc_feature: Encodes the peptide sequence at SEQ ID NO 18717
atgaacggcggcggcggcggccagaagaagcggggcacgaggatcgagcccttccggcaccgcgtcgagaccgaccccaagttcttcgacaagtcgtggcggaagctccatgacgccatccgcgagatctacaaccacaacgccagcggcctctccttcgaggagctctacaggactgcttataacatggtcctgaacaagtttgctcctcagctctatgagaaactcacagaaaacatgaaagaacatcttgaagatatgcgcacatgtatagatgctgctcaaggtggtttgttcctggaagagttgcagcgaaaatggaatgaccacaacaaggcattgacaatgattagagacatcctgatgtatatggacaggacttatattcctactaacaaaaagacacctgtctttgatcatggattagagctttggagggataccatagtccggtctcccacaattcagaggaggttgtctgacacgcttcttgaactcatacatagtgaaaggacaggcgatgtgattaatagaggcttgatgaggactacaacaaaaatgttgatggatctagggttgtctgtttatcaggatgattttgaaaggccatttcttgaggtttctgctagtttctatagtggtgagtcacaacaattcattgagtgctgtgcttgtggtgagtatctgaagcaggctgagaggcgcctctctgaagaatcagagcgtgtgtcccaatacttggatgtcaaaacccatgagaaaattactgctgttgtggtgaatgagatgctcgcaaatcacatgcagaggttgattcttatggagaactcggggcttgtgaatatgcttgttgaagacaggtatgaagacctgaccaggatgtacactttgtttaatcatgttcctgatgggctcacaacaatcagatctgttatggcatctcatattaaggatactggcaaaagtttggtaacagatcctgagagattaaaggacccagttgattttgttcagcggcttcttaacatgaaggataagtatgacaatatcatcaatgtgtcatttagcaatgacaagagtttcctgaatgctcttaattcctcatttgagcacttcataaacttaaacaacagatcccctgagttcatatcactgtttgttgatgacaaattgcggaagggggtgaaagaggctaatgaggaagatcttgaaactgtcctggacaaggtgatgatgctgtttagatatttgcaagaaaaagatctatttgagaaatattacaagcaacacttggcaaagcgtcttctttctgggaagaatgcttctgatgattctgagagaagcatgcttgtgaagctgaagacagaatgtggctaccagtttacttcgaagttggagggcatgttcaatgatttgaagacttctgaggatactacacaagggttttatgcatctacttcctcggagcttctggcagatgcccccacaatatctgtccagatactcaccactgggtcatggccaacacaaacctgcaatacctgcaaccttccccctgaaattgtccctatctcagagaagtttcgggcttattaccttggcacacataatggcaggaggctaacatggcaaacaaacatggggcatgctgacataaaagcaacatttggaaatggcagcaagcatgaactgaacgtctcaacataccagatgtgtgttctgatgctgtttaactcatccgatgtcttgacttaccgtgaaattgagcagtctacagcaataccagctactgacctgaagcgatgcctccagtcgctagctcttgtgaaaggtaagcaagtcctgcgaaaagagcccatgagccgggacattgccgatgatgacagcttcttcgtgaacgacaagttcaccagcaagctcttcaaggtgaagattggcactgtggcggcgcagaaggagaccgaccctgagaagctagagacacggcagcgggtcgaggaggataggaagccgcagatcgaggcggccattgtgcggatcatgaagtcgaggagggttctagaccacaacagcataatgatggaggtgacgaagcagttgcagccccgtttcatgccaaaccccgtggtgatcaagaagcggattgagtcgctcatcgagcgcgagttcctggagcgggacaagacggacaggaagatgtaccgttatctcgcctaa

SEQ ID NO: 18717 - protein, 738 aa, Sorghum bicolor
  misc_feature: Useful for making plants with modulated biomass
  misc_feature: Functional homolog of the protein sequence given in SEQ ID NO 14662
  misc_feature: Ceres ANNOT ID no. 8704777
  misc_feature (33)..(637): Pfam ID: Cullin Pfam Description: Cullin family
MNGGGGGQKKRGTRIEPFRHRVETDPKFFDKSWRKLHDAIREIYNHNASGLSFEELYRTAYNMVLNKFAPQLYEKLTENMKEHLEDMRTCIDAAQGGLFLEELQRKWNDHNKALTMIRDILMYMDRTYIPTNKKTPVFDHGLELWRDTIVRSPTIQRRLSDTLLELIHSERTGDVINRGLMRTTTKMLMDLGLSVYQDDFERPFLEVSASFYSGESQQFIECCACGEYLKQAERRLSEESERVSQYLDVKTHEKITAVVVNEMLANHMQRLILMENSGLVNMLVEDRYEDLTRMYTLFNHVPDGLTTIRSVMASHIKDTGKSLVTDPERLKDPVDFVQRLLNMKDKYDNIINVSFSNDKSFLNALNSSFEHFINLNNRSPEFISLFVDDKLRKGVKEANEEDLETVLDKVMMLFRYLQEKDLFEKYYKQHLAKRLLSGKNASDDSERSMLVKLKTECGYQFTSKLEGMFNDLKTSEDTTQGFYASTSSELLADAPTISVQILTTGSWPTQTCNTCNLPPEIVPISEKFRAYYLGTHNGRRLTWQTNMGHADIKATFGNGSKHELNVSTYQMCVLMLFNSSDVLTYREIEQSTAIPATDLKRCLQSLALVKGKQVLRKEPMSRDIADDDSFFVNDKFTSKLFKVKIGTVAAQKETDPEKLETRQRVEEDRKPQIEAAIVRIMKSRRVLDHNSIMMEVTKQLQPRFMPNPVVIKKRIESLIEREFLERDKTDRKMYRYLA

SEQ ID NO: 18718 - DNA, 1032 bp, Sorghum bicolor
  misc_feature: Ceres ANNOT ID no. 8704821
  misc_feature: Encodes the peptide sequence at SEQ ID NO 18719
atggccagctatactagtagtcacgccgtagggaaagcagggaaccaagatgatgagacgtgcatgcatgctatgaagctccttggcggattggccgtaccttttaccatcaaggcggtcatcaagctcggcatcatggaccgtctcctgaccgcggaacgcgccatgagcgcacaggagctcacggcagggttgccatgtcgtgctcctgctcctgctgctgctatggtagaccgcatgctccggttcctagcttcgcacggcgtggtcaggtgcgccgccaccgagtcggagttgggctccgatgatggcaagagctgccggcgctacgcagcggcaccggtgtgcaagtggtacaacataaaagatggagtgttagagggagaaacaccatttgacaaagcatacggcatgccattttttgagttccttggtgcaaacgggacaaagaacacgttgttcaatgaggcaatggcgagccattcgatgatcacaacaaagaggctactcgaggtcttccgtggctttgaaaattacaatgtgcttgtcgatgtcggcggcggcaaaggcaccacgatgcaaatgattagaagtcagtatgagaatattagtggcatcaactacgaccttcctcatgtaattgcacaggcatctccaattgaaggtgtggagcatgttggtggcaatatgtttgataagattccacgcggagatgcaataatcctaaagtggattctccacgattggggcgacaaagactgcgtcaagatcctaaagaattgctatgcagctctcccggtgaacgggacgatgatcattctggagtacatcctcccggagacaccagaagaaacactagcagcgcaaatagcgtacgacctcgatctcgggatggtgctcatgttcggcgccagcggtaaggagagaacagagaaagagttgtcggagctcgccagagaggccggcttctctggagactgcacggctacatacatcttcgccaatgtctgggcccttgaattcacaaagtaa

SEQ ID NO: 18719 - protein, 343 aa, Sorghum bicolor
  misc_feature: Useful for making plants with altered carbohydrate content
  misc_feature: Functional homolog of the protein sequence given in SEQ ID NO 14235
  misc_feature: Useful for making plants with altered cell wall content and/or composition
  misc_feature: Functional homolog of the protein sequence given in SEQ ID NO 14659
  misc_feature: Ceres ANNOT ID no. 8704821
  misc_feature (118)..(343): SWISSPROT Homolog: EC 2.1.1.68 Caffeate O-methyltransferase
  misc_feature (98)..(319): Pfam ID: Methyltransf_2 Pfam Description: O-methyltransferase
  misc_feature (35)..(85): Pfam ID: Dimerisation Pfam Description: Dimerisation domain
MASYTSSHAVGKAGNQDDETCMHAMKLLGGLAVPFTIKAVIKLGIMDRLLTAERAMSAQELTAGLPCRAPAPAAAMVDRMLRFLASHGVVRCAATESELGSDDGKSCRRYAAAPVCKWYNIKDGVLEGETPFDKAYGMPFFEFLGANGTKNTLFNEAMASHSMITTKRLLEVFRGFENYNVLVDVGGGKGTTMQMIRSQYENISGINYDLPHVIAQASPIEGVEHVGGNMFDKIPRGDAIILKWILHDWGDKDCVKILKNCYAALPVNGTMIILEYILPETPEETLAAQIAYDLDLGMVLMFGASGKERTEKELSELAREAGFSGDCTATYIFANVWALEFTK

SEQ ID NO: 18720 - DNA, 945 bp, Sorghum bicolor
  misc_feature: Ceres ANNOT ID no. 8704780
  misc_feature: Encodes the peptide sequence at SEQ ID NO 18721
atggccaccgtccaccccccatcgccggcgggccccaccgcccctcttccgccgcaggaggaggaggaggaggaggtggagcgacacgtgggggacgccgtcccggacccgcccgccgtcgtctccggcgaacccgacgcggccggagcggaggcgagcggcgggggcggcgagatcgccgcgctcgacaagcagctcgccgtcgtcgtcggcggtggcggcggcagcggcgatgagaggaggctggccggtgccggggccgtggccggggccgtggctgctagcgcagccgcagcaggcgggggagggaagctggtggcggaggccatgcgcaagtacgccgcgccgcggtcgtcaaagttccacggcgtcaccaggctcaagtggagtggcaagtacgaggcgcacctatgggacaacaccagccaggtcaagggccgcaagcgcaagggcaagcacggcagctatgttaatgaagagcaggctgcaaaggcacatgatttggctgcccttaaatattggggcacaggaccaaacaccaaattgaacttcaatatttctgattatgagaaagaaattgaggttatgaagaccatgtctcaagatgaatttgtggcctacataaggaggcaaagcagttgtttctcaagaggtacttcatcataccgtggtgtaaccagacgcaaggatggtaaatggcaagcaagaattggtaggattggtgagagtagagacaccaaagacatttatcttgggacctttgaaactgaagaagaggcggcagaagcttatgacctagcagcaatcgagctccgtggtgttcatgctgttaccaattttgacattagtaactactgtgaagttggtttgagaaaactagaaggtccgtcagaggtggtgaatctggaaggtccatcggaggttatgaagcacgctgggcaatag

SEQ ID NO: 18721 - protein, 314 aa, Sorghum bicolor
  misc_feature: Useful for making plants with modulated flowering time
  misc_feature: Functional homolog of the protein sequence given in SEQ ID NO 14663
  misc_feature: Useful for biocontainment applications
  misc_feature: Functional homolog of the protein sequence given in SEQ ID NO 13575
  misc_feature: Useful for making plants with modulated asexual embryo production
  misc_feature: Functional homolog of the protein sequence given in SEQ ID NO 13420
  misc_feature: The sequence is a functional homolog of SEQ ID NO 1014 in the 10/225,066 US patent application
  misc_feature: The sequence is a functional homolog of SEQ ID NO 2496 in the 10/374,780 US patent application
  misc_feature: Useful for making plants with altered lignin content
  misc_feature: Useful for making plants with modulated biomass
  misc_feature: Functional homolog of the protein sequence given in SEQ ID NO 13511
  misc_feature: The sequence is a functional homolog of SEQ ID NO 1311 in the 10/374,780 US patent application
  misc_feature: The sequence is a functional homolog of SEQ ID NO 1456 in the 10/412,699 US patent application
  misc_feature: Ceres ANNOT ID no. 8704780
  misc_feature (220)..(274): Pfam ID: AP2 Pfam Description: AP2 domain
  misc_feature (119)..(176): Pfam ID: AP2 Pfam Description: AP2 domain
MATVHPPSPAGPTAPLPPQEEEEEEVERHVGDAVPDPPAVVSGEPDAAGAEASGGGGEIAALDKQLAVVVGGGGGSGDERRLAGAGAVAGAVAASAAAAGGGGKLVAEAMRKYAAPRSSKFHGVTRLKWSGKYEAHLWDNTSQVKGRKRKGKHGSYVNEEQAAKAHDLAALKYWGTGPNTKLNFNISDYEKEIEVMKTMSQDEFVAYIRRQSSCFSRGTSSYRGVTRRKDGKWQARIGRIGESRDTKDIYLGTFETEEEAAEAYDLAAIELRGVHAVTNFDISNYCEVGLRKLEGPSEVVNLEGPSEVMKHAGQ

SEQ ID NO: 18722 - DNA, 519 bp, Sorghum bicolor
  misc_feature: Ceres ANNOT ID no. 8704813
  misc_feature: Encodes the peptide sequence at SEQ ID NO 18723
atggcggacgcgccagtggcggcagcaataatgggcgtgcaggatcagcagcggaggcggcgtacgcgggcgtcgagcgagtacctgggcgtgcggcggcggccgtggggccggtacgcggcggagatccgcaacccggtcaccaaggagcgccactggctgggaaccttcgacaccgccgaggaggccgccgtcgcctacgacctctctgccatctccatctcgggccccgccgccgcgcgcaccaacttctactacccgcgggacgccaccgcactgcagcggcaggcggagctgctgccttatgatgatgctccggtgccatcgccagcgccgccgccctcgccgttgtccggcggtagcggcggcggaacagtggatgatgatgattatgaatgtcagctcacggtggaggaggctgatgctgatgatgagtccatgacgatcgccgccattctgcagagcttccagcatctgaataatgctccatcggcatcctctgctgattcgctgtattag

SEQ ID NO: 18723 - protein, 172 aa, Sorghum bicolor
  misc_feature: Useful for making plants with altered lignin content
  misc_feature: Functional homolog of the protein sequence given in SEQ ID NO 13219
  misc_feature: Useful for biocontainment applications
  misc_feature: Functional homolog of the protein sequence given in SEQ ID NO 13707
  misc_feature: Useful for making plants with altered sterol content
  misc_feature: Useful for making plants with altered terpenoid content
  misc_feature: Functional homolog of the protein sequence given in SEQ ID NO 13518
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: Useful for making plants with altered lutein content
  misc_feature: Useful for making plants with modulated biomass
  misc_feature: Useful for making plants with modulated flowering time
  misc_feature: Functional homolog of the protein sequence given in SEQ ID NO 13470
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: Ceres ANNOT ID no. 8704813
  misc_feature (26)..(77): Pfam ID: AP2 Pfam Description: AP2 domain
MADAPVAAAIMGVQDQQRRRRTRASSEYLGVRRRPWGRYAAEIRNPVTKERHWLGTFDTAEEAAVAYDLSAISISGPAAARTNFYYPRDATALQRQAELLPYDDAPVPSPAPPPSPLSGGSGGGTVDDDDYECQLTVEEADADDESMTIAAILQSFQHLNNAPSASSADSLY

SEQ ID NO: 18724 - DNA, 1062 bp, Sorghum bicolor
  misc_feature: Ceres ANNOT ID no. 8704809
  misc_feature: Encodes the peptide sequence at SEQ ID NO 18725
atggtgcgcttcttccgcagcggcaacctcgcttccagggtcttcgaccggcagctcctctccccgcgccccggcgccgcggttaacactattagacagttctacgagaatttggtcccaagctacactatatatgacatagattgcccagattattcatttcgcaagttcactgatgatgggcaatatcttgtggcttttagccgaaatcaccaagatttgattgtataccgtcccatctggttgacatattcatgtaatgaagactgtgattctcatgatcttccagcaaagtcaaagaagtttgatagtttctttaagcagctctactcaattccacttgcatccagcaatgagtacatttgcaaggactttttcctgtacatagaatgcaatcaatttggcttatttgcaacatcaactgcacaaagtaacgattcaactgccactgagggtgcaatacacggggttccatcaattgagaaaataactttttatcttgtgaggctagaagatggcgtgatactggatgaaaaggctttctgcaatgattttatcaatctggcacatagtattggcgcttacttgtatgaggatctgctttgtattgtttctctgcggtaccaaacagtacatatcctacagatccgagattcaggcaaccttgttgaggtacgcagaattggtgcgttctgccgggaagatgatgaactatttcttcattcacatgcccagactggttatgggggttcttttcttcctggcatcaagcaacggttgctgtcatatatatttcgcaagacttggaatgaggttccagatcagactttgagggtccagcatctgaagaagaagttctattttcacttccaagactatgttgatcttattatatggaaggtacagtttttggatcgccatcacctatttatcaagtttggcagtgtcgatggaggggtaagtcatttttttccggcaaaatattcagggcaaaccacatcttcggtgcaatccatgaaaacccaattaaaatcatacttagaagttttcaaaaaattttaa

SEQ ID NO: 18725 - protein, 353 aa, Sorghum bicolor
  misc_feature: Useful for making plants with modulated light quality sensitivity
  misc_feature: Useful for making plants with modulated low light sensitivity
  misc_feature: Functional homolog of the protein sequence given in SEQ ID NO 14664
  misc_feature: Ceres ANNOT ID no. 8704809
MVRFFRSGNLASRVFDRQLLSPRPGAAVNTIRQFYENLVPSYTIYDIDCPDYSFRKFTDDGQYLVAFSRNHQDLIVYRPIWLTYSCNEDCDSHDLPAKSKKFDSFFKQLYSIPLASSNEYICKDFFLYIECNQFGLFATSTAQSNDSTATEGAIHGVPSIEKITFYLVRLEDGVILDEKAFCNDFINLAHSIGAYLYEDLLCIVSLRYQTVHILQIRDSGNLVEVRRIGAFCREDDELFLHSHAQTGYGGSFLPGIKQRLLSYIFRKTWNEVPDQTLRVQHLKKKFYFHFQDYVDLIIWKVQFLDRHHLFIKFGSVDGGVSHFFPAKYSGQTTSSVQSMKTQLKSYLEVFKKF

SEQ ID NO: 18726 - DNA, 1089 bp, Sorghum bicolor
  misc_feature: Ceres ANNOT ID no. 8704824
  misc_feature: Encodes the peptide sequence at SEQ ID NO 18727
atgggcagctatactaccagagtccacgccgtagagaaagcagctaacaaccaagatgatgagacgtgcatgcatgctttgatgctccttggcggattggccgtaccttgtaccatcaaggcggtcatcgagctcggcatcatggaccttctcctcgccgcggaccgcgccatgaccgcggaggagctcacggcaaggttgccatgtcctgctgctgctactgctgctgctatggtcgaccgcatgctccgcttcctagcttcgcacggcgtggtcaggtgcgccgccgccaccaaggagtcgtcggagctgggctccgatggtggcaagagctgccggcgctacgcggcggcgccggtgtgcaggtggtttacaaggagcggcggcgtggagtcggtggttccaatggggtacaacataaaagaagcagtgttagagggagaaacaccatttgacagagcatacggccagccattttttgaataccttggtgaaaacgggacagtgaacacgttgttcgatgaggcaatggcgaaccattcgacaatcataacgaagaggctggtcgaggtcttccgtggctttgagaattacagtgtgctcgtcgatgtcggtggcaacaaaggcaccacgttgcaaatgattagaagtcagtatgagaatattagtggcatcaactacgaccttcctcgtgtaattgcgcaggcacctccaattgaaggtgtggagcatgttggtggcaacatgtttgataatgttccacgtggagatgcaattatcctaaagtggattcttcacgattggggcgacaaggactgcgtcaagatcctaaagaattgctatgcagctctcccggtgaacgggacgatgatcattctggagtacatcctcccagagacaccagaagaaacactaacatcgcaactagcgttcaacttcgatttcgggatgatgctcatgtacggcgccaaaggtaaggagagaacagagaaagagttgtcggagctcgccagagaggccggcttctctggagactgcacggctacatacatcttcgccagcatctgggcccttgaattcacaaagtaa

SEQ ID NO: 18727 - protein, 362 aa, Sorghum bicolor
  misc_feature: Useful for making plants with altered carbohydrate content
  misc_feature: Functional homolog of the protein sequence given in SEQ ID NO 14235
  misc_feature: Ceres ANNOT ID no. 8704824
  misc_feature (10)..(362): SWISSPROT Homolog: EC 2.1.1.76 Quercetin 3-O-methyltransferase
  misc_feature (103)..(338): Pfam ID: Methyltransf_2 Pfam Description: O-methyltransferase
  misc_feature (37)..(87): Pfam ID: Dimerisation Pfam Description: Dimerisation domain
MGSYTTRVHAVEKAANNQDDETCMHALMLLGGLAVPCTIKAVIELGIMDLLLAADRAMTAEELTARLPCPAAATAAAMVDRMLRFLASHGVVRCAAATKESSELGSDGGKSCRRYAAAPVCRWFTRSGGVESVVPMGYNIKEAVLEGETPFDRAYGQPFFEYLGENGTVNTLFDEAMANHSTIITKRLVEVFRGFENYSVLVDVGGNKGTTLQMIRSQYENISGINYDLPRVIAQAPPIEGVEHVGGNMFDNVPRGDAIILKWILHDWGDKDCVKILKNCYAALPVNGTMIILEYILPETPEETLTSQLAFNFDFGMMLMYGAKGKERTEKELSELAREAGFSGDCTATYIFASIWALEFTK

SEQ ID NO: 18728 - DNA, 1053 bp, Sorghum bicolor
  misc_feature: Ceres ANNOT ID no. 8704816
  misc_feature: Encodes the peptide sequence at SEQ ID NO 18729
atggccagctatactagtactagtggccagttcgccgtagggaaagtagctgcagcgaaccaagatgatgagacgtgcatgcatgctctgaagctccttggcggattagccgtaccttttaccatcaaggcggtcatcgagctcggcatcatggaccttctcctggccgcggaccgcgccatgaccgcggaggcgctcacggcagcgttgctatgtcctgctcctgctccggctgctgctgctgctatggtagaccgcatgctccggttcctagcttcgcacggcgtggtcaggtgcgccaccgagtcggaggagttgggctccgatgatggcaagagctgccggcgctacgcggcggcgccggtgtgcaagtggcacaacataaaagatggagtgttagcgggagaaacaccgtttgacaaagcatacggcatgccagtgtttgagtaccttggtgcaaacgggacaatgaacacgttgttcaatgaggcaatggcgagccattcgatgatcataacgaagaggctactcgaggtcttccgtggctttgaaaattacagtgtgcttgtcgatgtcggcggcggcaacggcaccacgatgcaaatgattagaagtcagtatgagaatattagtggcatcaactacgaccttcctcatgtaattgcgcaggcatctccaattgaaggtgtggagcatgttgctggcaatatgtttgataatattccacgtggagatgcaattatcctaaagtggattctccacaattggggcgacaaggagtgcgtcaagatcctaaagaattgctacacagctctcccggtgaacgggacggttatcattctggagtacatcctcccggagacaccagaagaaacactagcatcgcaactagcgttcgacttcgatctcggcatgatgctgtttttcggcgccagcggtaaggagagaacagagaaggagttgttggagctcgccagagaggccggcttctctggagactacacggctacatacatcttcgccaacgtctgggcccatgaattcacaaagtga

SEQ ID NO: 18729 - protein, 350 aa, Sorghum bicolor
  misc_feature: Useful for making plants with altered carbohydrate content
  misc_feature: Functional homolog of the protein sequence given in SEQ ID NO 14235
  misc_feature: Useful for making plants with altered cell wall content and/or composition
  misc_feature: Functional homolog of the protein sequence given in SEQ ID NO 14659
  misc_feature: Ceres ANNOT ID no. 8704816
  misc_feature (125)..(350): SWISSPROT Homolog: EC 2.1.1.68 Caffeate O-methyltransferase
  misc_feature (105)..(326): Pfam ID: Methyltransf_2 Pfam Description: O-methyltransferase
  misc_feature (40)..(92): Pfam ID: Dimerisation Pfam Description: Dimerisation domain
MASYTSTSGQFAVGKVAAANQDDETCMHALKLLGGLAVPFTIKAVIELGIMDLLLAADRAMTAEALTAALLCPAPAPAAAAAMVDRMLRFLASHGVVRCATESEELGSDDGKSCRRYAAAPVCKWHNIKDGVLAGETPFDKAYGMPVFEYLGANGTMNTLFNEAMASHSMIITKRLLEVFRGFENYSVLVDVGGGNGTTMQMIRSQYENISGINYDLPHVIAQASPIEGVEHVAGNMFDNIPRGDAIILKWILHNWGDKECVKILKNCYTALPVNGTVIILEYILPETPEETLASQLAFDFDLGMMLFFGASGKERTEKELLELAREAGFSGDYTATYIFANVWAHEFTK

SEQ ID NO: 18730 - DNA, 828 bp, Sorghum bicolor
  misc_feature: Ceres ANNOT ID no. 8704839
  misc_feature: Encodes the peptide sequence at SEQ ID NO 18731
atgaagagcaggaaggggtacgggcaccagggccacctgctgagcccggtgggcagcccgccgtcggacaacgagtccggtgccgtggcagcggcggccacggccggcggcggcggcgggtgcgggagcagcgtgggttactgcggcggtggcggcggcgagtcgccggccaaggagcaggaccggttcctccccatcgccaacgtgtcgcgcatcatgaagcgctccctccccgcgaacgccaagatctccaaggaggccaaggagacggtgcaggagtgcgtgtccgagttcatcagcttcgtcaccggcgaggcctccgacaagtgccagcgcgagaagcgcaagaccatcaacggcgacgacctgctctgggccatgaccacgctcggcttcgaggcctacgtctccccgctcaagtcctacctcaaccgctaccgcgaggccgagggcgagaaggccgccgtgctcggcggcgcccgccacggcgacggcgcggtggacgacggcccgctcgccgcgggcggcgccgttccgccgtccggggccgccggtggtgaccgcgcgggccacgacggcgccgccgacgctgacgcgcacgtcgggctcatgatgggaggggccagcagcgtcgtcgggttcggcgccggcggcggtgcggcagcgtcgtactacacggccacggcagcacggaaggcgtacggcgcgggggaagggtcgacgaaggtgatggagttcgaaggcatcgccggcgaggaggagaacggcggcgtgcagagggggagagggtttgccaacaaccatctccacggcgccgtgcaatggtga

SEQ ID NO: 18731 - protein, 275 aa, Sorghum bicolor
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 66 in the 10/675,852 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: Useful for making plants with modulated biomass
  misc_feature: Functional homolog of the protein sequence given in SEQ ID NO 13228
  misc_feature: The sequence is a functional homolog of SEQ ID NO 12 in the 10/675,852 US patent application
  misc_feature: The sequence is a functional homolog of SEQ ID NO 64 in the 10/675,852 US patent application
  misc_feature: The sequence is a functional homolog of SEQ ID NO 14 in the 10/675,852 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: The sequence is a functional homolog of SEQ ID NO 60 in the 10/675,852 US patent application
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 38 in the 10/675,852 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 44 in the 10/675,852 US patent application
  misc_feature: Useful for making plants with altered alkaloid content
  misc_feature: Useful for making plants with altered terpenoid content
  misc_feature: Functional homolog of the protein sequence given in SEQ ID NO 13247
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 42 in the 10/675,852 US patent application
  misc_feature: The sequence is a functional homolog of SEQ ID NO 803 in the 10/374,780 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 793 in the 10/374,780 US patent application
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
  misc_feature: The sequence is a functional homolog of SEQ ID NO 294 in the 11/435,388 US patent application
  misc_feature: The sequence is a functional homolog of SEQ ID NO 296 in the 10/714,887 US patent application
  misc_feature: The sequence is a functional homolog of SEQ ID NO 308 in the 10/412,699 US patent application
  misc_feature: The sequence is a functional homolog of SEQ ID NO 723 in the 11/479,226 US patent application
  misc_feature: The sequence is a functional homolog of SEQ ID NO 788 in the 10/374,780 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
  misc_feature: Ceres ANNOT ID no. 8704839
  misc_feature (58)..(155): SWISSPROT Homolog: EC 2.7.7.7 DNA-directed DNA polymerase
  misc_feature (62)..(127): Pfam ID: CBFD_NFYB_HMF Pfam Description: Histone-like transcription factor (CBF/NF-Y) and archaeal histone
MKSRKGYGHQGHLLSPVGSPPSDNESGAVAAAATAGGGGGCGSSVGYCGGGGGESPAKEQDRFLPIANVSRIMKRSLPANAKISKEAKETVQECVSEFISFVTGEASDKCQREKRKTINGDDLLWAMTTLGFEAYVSPLKSYLNRYREAEGEKAAVLGGARHGDGAVDDGPLAAGGAVPPSGAAGGDRAGHDGAADADAHVGLMMGGASSVVGFGAGGGAAASYYTATAARKAYGAGEGSTKVMEFEGIAGEEENGGVQRGRGFANNHLHGAVQW

SEQ ID NO: 18732 - DNA, 1260 bp, Sorghum bicolor
  misc_feature: Ceres ANNOT ID no. 8704871
  misc_feature: Encodes the peptide sequence at SEQ ID NO 18733
atggctagctctcgtagtcgtaggcatcgcctggcgacgagcggcgccgcaccgggccgctacgtgacctcgggacccgccgtcggcggcggggccacggccatggggatctacgagcggcagcgccacctggtggcggccggcgtgtccgtgtggggggagccgttccggcccgacgccgacgccctgcccctgtccgcggtcgtccccacggtcaccctggcgacgccgccggcgccgccgcttgacgtcgtcgaagcagaggaagtcaagttcggcaaacaccagctggtggaagaagaagcgccgccgccgtcgtcggatagcttcggccacgaccacgacgacgacgccgcccggccaagagacaagattcagagacgcctcgcgcagaacagagaggcagctcggaagagccggctccggaagaaggcgtacatccagaatctcgagacgagccggatgaagctggcgcagctggagcaggagctcaccatggccaggcgccagcagcagcagcagcagcacggcgcgtacggcgttggaggaggaggaggaggagtcgcggcggcggcgggcgcggacccgcgggtggccgcgttcgagctggagtacgcgcgctgggtggaggagcaggggaggcaggcgacggagctgcgggcggcgctgcagtcgcacgcgccggaggtgcagctgcgggtgctcgtcgacgccgggctggcgcactacggcgcgctgttccaggccaaggcgcaggcggcgcggtccgacgccttcttcgtgctgtcgggggtgtggcgggcccccgcggagcggttcttcctctggatcggcgggttccgcccctccgagctgctcaaggtgctggcgccgcggctgaacccgctcatggaccaccaggcggccgaggtgcgcaagctgcagaacacggcgaggcagctggaggacgcgctgtcgcagggcatgagcaagctgcagcagacgctcgtcgacgccctcatgaccgtcgacgtcgcctcgccgctcggcgccggcggcgggtacgcggcgcagcagatggccagcgccgtcggcaagctcgccgacctcgtcgacttcgtggacaaggcggaccatctccggcagcagacgctgcggaacatgcacaagatcctgacgccgcggcaggcggcgcggggcctgctcgcgctcgcggactacggccagcggctgcgcgcgctcagctcgctctgggcggcgcgcccgcgggagccggcgtaa

SEQ ID NO: 18733 - protein, 419 aa, Sorghum bicolor
  misc_feature: The sequence is a functional homolog of SEQ ID NO 1497 in the 10/374,780 US patent application
  misc_feature: The sequence is a functional homolog of SEQ ID NO 1567 in the 10/412,699 US patent application
  misc_feature: The sequence is a functional homolog of SEQ ID NO 1493 in the 10/374,780 US patent application
  misc_feature: The sequence is a functional homolog of SEQ ID NO 1563 in the 10/412,699 US patent application
  misc_feature: The sequence is a functional homolog of SEQ ID NO 1786 in the 10/412,699 US patent application
  misc_feature: The sequence is a functional homolog of SEQ ID NO 2024 in the 10/374,780 US patent application
  misc_feature: The sequence is a functional homolog of SEQ ID NO 352 in the 10/412,699 US patent application
  misc_feature: The sequence is a functional homolog of SEQ ID NO 819 in the 11/479,226 US patent application
  misc_feature: The sequence is a functional homolog of SEQ ID NO 928 in the 11/435,388 US patent application
  misc_feature: Useful for making plants with altered lignin content
  misc_feature: Functional homolog of the protein sequence given in SEQ ID NO 13093
  misc_feature: Useful for making plants with modulated biomass
  misc_feature: Useful for making plants with modulated flowering time
  misc_feature: Functional homolog of the protein sequence given in SEQ ID NO 13559
  misc_feature: The sequence is a functional homolog of SEQ ID NO 1798 in the 10/412,699 US patent application
  misc_feature: The sequence is a functional homolog of SEQ ID NO 2044 in the 10/374,780 US patent application
  misc_feature: The sequence is a functional homolog of SEQ ID NO 408 in the 10/412,699 US patent application
  misc_feature: The sequence is a functional homolog of SEQ ID NO 48 in the 10/286,264 US patent application
  misc_feature: The sequence is a functional homolog of SEQ ID NO 938 in the 11/435,388 US patent application
  misc_feature: The sequence is a functional homolog of SEQ ID NO 957 in the 11/479,226 US patent application
  misc_feature: The sequence is a functional homolog of SEQ ID NO 1495 in the 10/374,780 US patent application
  misc_feature: The sequence is a functional homolog of SEQ ID NO 1565 in the 10/412,699 US patent application
  misc_feature: Ceres ANNOT ID no. 8704871
  misc_feature (120)..(176): Pfam ID: bZIP_1 Pfam Description: bZIP transcription factor
MASSRSRRHRLATSGAAPGRYVTSGPAVGGGATAMGIYERQRHLVAAGVSVWGEPFRPDADALPLSAVVPTVTLATPPAPPLDVVEAEEVKFGKHQLVEEEAPPPSSDSFGHDHDDDAARPRDKIQRRLAQNREAARKSRLRKKAYIQNLETSRMKLAQLEQELTMARRQQQQQQHGAYGVGGGGGGVAAAAGADPRVAAFELEYARWVEEQGRQATELRAALQSHAPEVQLRVLVDAGLAHYGALFQAKAQAARSDAFFVLSGVWRAPAERFFLWIGGFRPSELLKVLAPRLNPLMDHQAAEVRKLQNTARQLEDALSQGMSKLQQTLVDALMTVDVASPLGAGGGYAAQQMASAVGKLADLVDFVDKADHLRQQTLRNMHKILTPRQAARGLLALADYGQRLRALSSLWAARPREPA

SEQ ID NO: 18734 - DNA, 684 bp, Sorghum bicolor
  misc_feature: Ceres ANNOT ID no. 8704959
  misc_feature: Encodes the peptide sequence at SEQ ID NO 18735
atggcctcttccacgaccttccttgttctcaccactcttcttgcactgctcacatgccaagtcattgcttctgatccaagccctctgcaggatttctgtgtagctgacatggattctcatgtgcgtgtcaatggctttgtttgcaaagacacaaaggatgtcaaggcagacgacttcttcctagcagcaaacctcgacaagccaagggacacgacagttagcaaagttgggtctaatgtcacattgatcaatgtcatgcggattcctggcctcaacacccttgggatctccttggcaaggattgactatgctccacaaggagagaaccctcctcacacgcatccccatgctactgagatcctaactgtgttggagggcacactgtatgtcggattcgtgacatcgaaccaaaacaacgttaacaagttattcaccaagactctcaataagggcgatgtgttcgtattcccagagggactcatccacttccagttcaaccctcaccctgacaagcctgcagttgcacttgctgcacttagcagccagaacccaggtgctattaccattgccaatgctgttttcggatcgaagccaccgatatctgatgatgtcctagccaaggcatttcaagtggagaagaagactgtggactggctccaggctcagttctggggtgacaactga

SEQ ID NO: 18735 - protein, 227 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8704959
  misc_feature (23)..(223): SWISSPROT Homolog: EC 1.15.1.1 Superoxide dismutase
  misc_feature (63)..(217): Pfam ID: Cupin_1 Pfam Description: Cupin
MASSTTFLVLTTLLALLTCQVIASDPSPLQDFCVADMDSHVRVNGFVCKDTKDVKADDFFLAANLDKPRDTTVSKVGSNVTLINVMRIPGLNTLGISLARIDYAPQGENPPHTHPHATEILTVLEGTLYVGFVTSNQNNVNKLFTKTLNKGDVFVFPEGLIHFQFNPHPDKPAVALAALSSQNPGAITIANAVFGSKPPISDDVLAKAFQVEKKTVDWLQAQFWGDN

SEQ ID NO: 18736 - DNA, 2619 bp, Sorghum bicolor
  misc_feature: Ceres ANNOT ID no. 8704950
  misc_feature: Encodes the peptide sequence at SEQ ID NO 18737
atgacgccggcgaggcgcatgccggcgatgatcggtcggaatggcatggcgtttgggtcctcgtcggcgctgtctttaagccaggctgacctcctagacagccatcacctgcagcaagcgttccaacagcaactctttgatcagatcccagccaccgcagtggatagcagcgacaacatcatccatggtcgctccgacacgctggtagatgaatttgagagcaagtcctgcagtgagaatcctgatggcacctctggcgatgatggccaggaagaccccaaccagcggccaaacaagaagaagcggtatcaccgccacacccagcaccagatccaagagatggaggcgttcttcaaggagtgcccacacccggatgacaagcagagaaaggagctcagccgggagctcggcctcgagccactgcaggtcaagttttggttccagaacaagcgcacacagatgaagaaccagcatgagcggcaggagaacgcgcagctgcgcgcagagaatgacaagctgcgagctgagaatatgcggtacaaggaagcactcggcacagcctcctgccccagctgtggcggccctgccgccctcggtgagatgtcctttgacgagcaccacctccgtctcgagaacgctcgcctccgtgatgagattgaccggatttcgggcatcgctgccaagcacgtcggcaagcccatggtctccttcccggtgctctccagcccacttgctgctgctgccgcccgatccccacttgaccttgctggtgcctacggcgtccagcctggtggcctcggtgccgaccacctattcggtgttggagctggtgccggtgatctgctgagaagcgtgtcaaccggccagctcgacgctgacaagcccatgattgtagagctggccgttgctgccatggatgagctcctccgaatggcgcggcttgatgcgccgctgtggggtgggggcgtggcaggcgtgcagctggacgaggaggagtatggccggatgttcccgggtgggctcgggccgaggcagtacgggcttcgtccggaggcatctcgagacaatgccgtcgtgatcatgacacgcgatagccttgttgagatactcatggacgcgaaccgattcgctgcagtgttctcaagcattgtgtcgagggcttctacacacgaggtgttgtcaactggtgtggcagggagctataatggtgcattacaagtgatgtcaatggagttccaggtgccatcaccactggtgccgacgagggagagctactttgtgaggtactgcaagaacaatcccgatggaacgtgggctgttgttgatgtctcgctcgacagcctccgtcctagccctgttatgaagtgccggcgcaggccatcaggatgccttatccaagaaatgcccaatggctactcaaaggtgacctgggtggagcacgttgaggttgatgacagatcagtgcacaatctctacaggcctttggtcaattcaggcctcgcatttggtgcaaaaaggtgggttggcacactggaccgacaatgcgagcgccttgccagtgccatggccagcaacatccccaacggcgacctcggtgtgatcacaagcatagaggggaggaagagcatgctgaagctagctgagaggatggtggcgagcttctgcggcggcgtgacagcatctgccgcacatcagtggacaacattgtcagggagtggtgcagaggacgtccgtgttatgaccaggaagagcgtggacgacccgggcaggccgccgggcatcgtcctcaatgccgccacctccttctggctacccgtcccacccaagagggtctttgatttcctccgcgatgagacctctcgcagcgagtgggacatcctatccaacggtggtgctgtccaagaaatggctcatattgccaacggccgggaccatggcaactgtgtctcccttcttcgtgtcaatagtgcaaactcgaaccagagcaacatgctgatcctccaggagagctgcaccgacgcatctggctcgtatgtggtgtacgcaccagtggacgtggtggcaatgaacgtggtgctcaatggcggggacccagactacgtggccctactgccatcgggcttcgctatcctccccgatggaccacccggcatggctccccatggagagggtgccgccttggagactggcggtggttccctcttgacggtggcgttccagatcctggtggactccgtgcctactgcaaagctctccctgggctctgtagcaactgtgaacagcctcatcgcctgcaccgtggagcgcatcaaggctgccgtctgcgtggaaggaggggggcagcaaggttttggggaaatattagtggggagtcaagaacgcacctcagactctccttgccatgtggaaaaagaaggcgtcaccactatgcaaggggggatggttcgggtattgacttccccgttgatcaagtctactacagaaaggatgctgcggagaagatgctgtttctggatctctttcaatatttttagggtttccatttgctgctgtgtacttcgtcatgttcgtggtgtcgccgttgttcaggctaaggtgcctgtgcctgctcgtagctag

SEQ ID NO: 18737 - protein, 872 aa, Sorghum bicolor
  misc_feature: The sequence is a functional homolog of SEQ ID NO 2324 in the 10/374,780 US patent application
  misc_feature: The sequence is a functional homolog of SEQ ID NO 246 in the 10/412,699 US patent application
  misc_feature: The sequence is a functional homolog of SEQ ID NO 522 in the 11/479,226 US patent application
  misc_feature: The sequence is a functional homolog of SEQ ID NO 596 in the 11/435,388 US patent application
  misc_feature: The sequence is a functional homolog of SEQ ID NO 716 in the 10/225,066 US patent application
  misc_feature: The sequence is a functional homolog of SEQ ID NO 80 in the 10/286,264 US patent application
  misc_feature: The sequence is a functional homolog of SEQ ID NO 2670 in the 10/374,780 US patent application
  misc_feature: The sequence is a functional homolog of SEQ ID NO 334 in the 10/225,066 US patent application
  misc_feature: The sequence is a functional homolog of SEQ ID NO 666 in the 11/435,388 US patent application
  misc_feature: The sequence is a functional homolog of SEQ ID NO 244 in the 10/412,699 US patent application
  misc_feature: The sequence is a functional homolog of SEQ ID NO 424 in the 11/435,388 US patent application
  misc_feature: The sequence is a functional homolog of SEQ ID NO 519 in the 11/479,226 US patent application
  misc_feature: The sequence is a functional homolog of SEQ ID NO 58 in the 10/286,264 US patent application
  misc_feature: The sequence is a functional homolog of SEQ ID NO 92 in the 10/666,642 US patent application
  misc_feature: The sequence is a functional homolog of SEQ ID NO 2656 in the 10/374,780 US patent application
  misc_feature: The sequence is a functional homolog of SEQ ID NO 326 in the 10/225,066 US patent application
  misc_feature: The sequence is a functional homolog of SEQ ID NO 70 in the 10/286,264 US patent application
  misc_feature: The sequence is a functional homolog of SEQ ID NO 130 in the 10/666,642 US patent application
  misc_feature: Ceres ANNOT ID no. 8704950
  misc_feature (299)..(517): Pfam ID: START Pfam Description: START domain
  misc_feature (100)..(156): Pfam ID: Homeobox Pfam Description: Homeobox domain
MTPARRMPAMIGRNGMAFGSSSALSLSQADLLDSHHLQQAFQQQLFDQIPATAVDSSDNIIHGRSDTLVDEFESKSCSENPDGTSGDDGQEDPNQRPNKKKRYHRHTQHQIQEMEAFFKECPHPDDKQRKELSRELGLEPLQVKFWFQNKRTQMKNQHERQENAQLRAENDKLRAENMRYKEALGTASCPSCGGPAALGEMSFDEHHLRLENARLRDEIDRISGIAAKHVGKPMVSFPVLSSPLAAAAARSPLDLAGAYGVQPGGLGADHLFGVGAGAGDLLRSVSTGQLDADKPMIVELAVAAMDELLRMARLDAPLWGGGVAGVQLDEEEYGRMFPGGLGPRQYGLRPEASRDNAVVIMTRDSLVEILMDANRFAAVFSSIVSRASTHEVLSTGVAGSYNGALQVMSMEFQVPSPLVPTRESYFVRYCKNNPDGTWAVVDVSLDSLRPSPVMKCRRRPSGCLIQEMPNGYSKVTWVEHVEVDDRSVHNLYRPLVNSGLAFGAKRWVGTLDRQCERLASAMASNIPNGDLGVITSIEGRKSMLKLAERMVASFCGGVTASAAHQWTTLSGSGAEDVRVMTRKSVDDPGRPPGIVLNAATSFWLPVPPKRVFDFLRDETSRSEWDILSNGGAVQEMAHIANGRDHGNCVSLLRVNSANSNQSNMLILQESCTDASGSYVVYAPVDVVAMNVVLNGGDPDYVALLPSGFAILPDGPPGMAPHGEGAALETGGGSLLTVAFQILVDSVPTAKLSLGSVATVNSLIACTVERIKAAVCVEGGGQQGFGEILVGSQERTSDSPCHVEKEGVTTMQGGMVRVLTSPLIKSTTERMLRRRCCFWISFNIFRVSICCCVLRHVRGVAVVQAKVPVPARS

SEQ ID NO: 18738 - DNA, 687 bp, Sorghum bicolor
  misc_feature: Ceres ANNOT ID no. 8705031
  misc_feature: Encodes the peptide sequence at SEQ ID NO 18739
atggctcccgccacctactttctccttgtttctcttctagcagtagtcgcttctcaggccattgcttctgaccctagcccgctccaggacttctgtgttgcggacatacactctccagtgaaagtgaatggatttgtttgcaaggaccccatggccgtgaacgcagatgactttttcaaggcagcaaaccttgacaagcctagggacacaatgaaaagtaaggtcggatcaaatgtcactttgatcaatgtcatgcagttgcctggactcaacaccctgggcatctcgttggctcgcattgactacgcaccattaggtcagaatccgccacacacccacccacgtgccacagagatcctcaccgtgcttgagggtacactctatgttggatttgtcacatccaacactgacaacggtaacaagttatttgctaaggttctcaacaagggtgacgtgtttgtattcccacaagggctcatccacttccaattcaacccaatccatgacaagccagctgtcgcaatcgctgcactaagcagccagaatcctggggctattactattgccaacgcggtctttggatcaaaaccaccgatctcagatgatgtcttggccaaggccttccaggtgcaaaaggggacagttgattggcttcaagctcagttttgggagaacaaccacaactaa

SEQ ID NO: 18739 - protein, 228 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8705031
  misc_feature (24)..(222): SWISSPROT Homolog: EC 1.15.1.1 Superoxide dismutase
  misc_feature (62)..(216): Pfam ID: Cupin_1 Pfam Description: Cupin
MAPATYFLLVSLLAVVASQAIASDPSPLQDFCVADIHSPVKVNGFVCKDPMAVNADDFFKAANLDKPRDTMKSKVGSNVTLINVMQLPGLNTLGISLARIDYAPLGQNPPHTHPRATEILTVLEGTLYVGFVTSNTDNGNKLFAKVLNKGDVFVFPQGLIHFQFNPIHDKPAVAIAALSSQNPGAITIANAVFGSKPPISDDVLAKAFQVQKGTVDWLQAQFWENNHN

SEQ ID NO: 18740 - DNA, 966 bp, Sorghum bicolor
  misc_feature: Ceres ANNOT ID no. 8705055
  misc_feature: Encodes the peptide sequence at SEQ ID NO 18741
atggccgccagcccgcctggtcgcctactcgcctggatggctggccgcgccgccgctcctcctgctcctctttcatcaggaatggcaactggtagtgaagcctcgaagccagctgaggtgccagctgagactgtgcttgactggcataaacaggacaacaagaggatgctccacgcggtttaccgtgtcggggatctggaccgcacaatcaaatactacacggaatgctttgggatgaaactgctgaggaaaagggatattcctgaagagaagtacaccaacgccttccttggctttggaccagaggacaccaactttgcagttgaattgacttacaactatggcgttgacaagtatgacattggaacgggctttgggcattttgcaatcgctaatgaggatgtgtacaagttggctgagaatattaaatccaagggtggcaagatcacccgcgaacctggtcctgtcaagggaggatccactgttattgccttcgcacaggaccctgatggctacatgtttgagcttatccagagggctgagacacccgagcctctttgccaggtcatgcttcgtgttggtgaccttgagcgttctatcaagttttatgagaaggccctaggtttgaagctcctaaggaagaaggatgtacctgattacaagtataccattgccatgttgggctatgctgatgaggacaagacaactgttctggagttgacatacaactatggggtcacagaatacagcaagggcaatgcatatgctcaggttgccattggcaccaacgatgtgtacaagagtgctgaggcggttgagctggcgaccaaagaactaggtggcaagattttgcggcagccagggccgctacctgggatcaacactaagatagcctcttttgttgatccagatggctggaaagtggttctggttgacaacaccgacttcctcagggaactccactga

SEQ ID NO: 18741 - protein, 321 aa, Sorghum bicolor
  misc_feature: Useful for making plants with modulated nitrogen use efficiency
  misc_feature: Functional homolog of the protein sequence given in SEQ ID NO 13155
  misc_feature: Ceres ANNOT ID no. 8705055
  misc_feature (30)..(320): SWISSPROT Homolog: EC 4.4.1.5 Lactoylglutathione lyase
  misc_feature (55)..(176): Pfam ID: Glyoxalase Pfam Description: Glyoxalase/Bleomycin resistance protein/Dioxygenase superfamily
  misc_feature (185)..(310): Pfam ID: Glyoxalase Pfam Description: Glyoxalase/Bleomycin resistance protein/Dioxygenase superfamily
MAASPPGRLLAWMAGRAAAPPAPLSSGMATGSEASKPAEVPAETVLDWHKQDNKRMLHAVYRVGDLDRTIKYYTECFGMKLLRKRDIPEEKYTNAFLGFGPEDTNFAVELTYNYGVDKYDIGTGFGHFAIANEDVYKLAENIKSKGGKITREPGPVKGGSTVIAFAQDPDGYMFELIQRAETPEPLCQVMLRVGDLERSIKFYEKALGLKLLRKKDVPDYKYTIAMLGYADEDKTTVLELTYNYGVTEYSKGNAYAQVAIGTNDVYKSAEAVELATKELGGKILRQPGPLPGINTKIASFVDPDGWKVVLVDNTDFLRELH

SEQ ID NO: 18742 - DNA, 699 bp, Sorghum bicolor
  misc_feature: Ceres ANNOT ID no. 8705030
  misc_feature: Encodes the peptide sequence at SEQ ID NO 18743
atggctgcctccagctacttcattctcgttgcttttgtagcattggtcatttcacaggccactgcctctgaccctagtccgctccaagacttttgtgttgccgacaaacactctgggtatgcatactctctgaaggtgaatggatttgtttgcaaggacccaatggctgtgaacgcagatgacttcttcaaggcagcaaaccttgacaagcctagggacacaatgaaaagcaaggttggatccaatgtcactttgatcaatgtcatgcagctgcctggactcaacaccctgggcatgtcattggctcgcattgattatgcaccattaggtcagaatccgccacacacacacccccgtgccacagagattctcaccgtgcttgagggtacactctatgttggatttgtcacctccaacacagacaacggtaacaagctattcgccaaggttctcaacaagggtgatgtgtttgtgttccctcaagggctcatacacttccaattcaacccgatccatgacaagccagctgtcgcaatcgctgcactaagcagccaaaaccctggagctattacagttgcaaacgctgtctttggatcaaagccaccgatctcagatgatgtcttggccaaggccttccagatgcaaaagggaacaattgattggcttcaagctcagttctgggagaacaaccactactaa

SEQ ID NO: 18743 - protein, 232 aa, Sorghum bicolor
  misc_feature: Useful for making plants with modulated nitrogen use efficiency
  misc_feature: Functional homolog of the protein sequence given in SEQ ID NO 14277
  misc_feature: Ceres ANNOT ID no. 8705030
  misc_feature (1)..(226): SWISSPROT Homolog: EC 1.2.3.4 Oxalate oxidase
  misc_feature (66)..(220): Pfam ID: Cupin_1 Pfam Description: Cupin
MAASSYFILVAFVALVISQATASDPSPLQDFCVADKHSGYAYSLKVNGFVCKDPMAVNADDFFKAANLDKPRDTMKSKVGSNVTLINVMQLPGLNTLGMSLARIDYAPLGQNPPHTHPRATEILTVLEGTLYVGFVTSNTDNGNKLFAKVLNKGDVFVFPQGLIHFQFNPIHDKPAVAIAALSSQNPGAITVANAVFGSKPPISDDVLAKAFQMQKGTIDWLQAQFWENNHY

SEQ ID NO: 18744 - DNA, 873 bp, Sorghum bicolor
  misc_feature: Ceres ANNOT ID no. 8705053
  misc_feature: Encodes the peptide sequence at SEQ ID NO 18745
atggcaactggtagtgaagccgtaaagccagctgaggctgtgcttgggtggcataaacaggacagcaagaggatgctccatgcggtttaccgtgtcggggatctggatcgcacgattaagtactacacagaatgctttgggatgaagctgctgaggaaaagagatgttcctgatgagaagtacaccaacgccttccttggctttggaccagaggacaccaacttcgcacttgaattgacatacaactatggtgttgacaagtatgacattggagagggctttgggcatttcggaatcgctaatgaggatgtgtacaagttggccgaccatattaaatccaagggtggcaatatcactcgtgaacctggtcctgtcaagggaggatccactgttattgcctttgcacaggaccctgatggctacaggtttgcccttatccagagggctgagatacatgaccctctttgccaagtcatgcttcgtgttggtgatcttgagcgttctatcaagttctatgagaaggcccttgggatgaagctactaacgaagaaggatgtacctgattataagcataccattgccaaattgggttatgccgaagaggacaagacaactgctctggagttgatatacaactatggagtcacagaatatagcaagggcaatgcatatgctcagattgccattggcaccaacgatgtgtacaagagtgcagaggcagttgatttggcaaccaaagaactaggtggcaagattttgcggcagccaggacctctacctgggatcaacactaagatcgcctcttttgttgatccagatggctggaaagtggttctggttgaccatgctgacttcctcaaggaacttcagtga

SEQ ID NO: 18745 - protein, 290 aa, Sorghum bicolor
  misc_feature: Useful for making plants with modulated nitrogen use efficiency
  misc_feature: Functional homolog of the protein sequence given in SEQ ID NO 13155
  misc_feature: Ceres ANNOT ID no. 8705053
  misc_feature (1)..(290): SWISSPROT Homolog: EC 4.4.1.5 Lactoylglutathione lyase
  misc_feature (24)..(145): Pfam ID: Glyoxalase Pfam Description: Glyoxalase/Bleomycin resistance protein/Dioxygenase superfamily
  misc_feature (154)..(279): Pfam ID: Glyoxalase Pfam Description: Glyoxalase/Bleomycin resistance protein/Dioxygenase superfamily
MATGSEAVKPAEAVLGWHKQDSKRMLHAVYRVGDLDRTIKYYTECFGMKLLRKRDVPDEKYTNAFLGFGPEDTNFALELTYNYGVDKYDIGEGFGHFGIANEDVYKLADHIKSKGGNITREPGPVKGGSTVIAFAQDPDGYRFALIQRAEIHDPLCQVMLRVGDLERSIKFYEKALGMKLLTKKDVPDYKHTIAKLGYAEEDKTTALELIYNYGVTEYSKGNAYAQIAIGTNDVYKSAEAVDLATKELGGKILRQPGPLPGINTKIASFVDPDGWKVVLVDHADFLKELQ

SEQ ID NO: 18746 - DNA, 675 bp, Sorghum bicolor
  misc_feature: Ceres ANNOT ID no. 8705078
  misc_feature: Encodes the peptide sequence at SEQ ID NO 18747
atggacacggaagggcaaccctctgagagtgcagtgagcgaaggtgtgacaaacggtgatgccattccttcagacttccaggatgatgccccagtgatccaacctccactctcacatcaccaccaggttgcatcccaatcccagcaagacgatcactgccactgccagcaaccgctccaggccttctggtctggccagcttgccgagatcaagcagacaactaatttcaagacccacagccttccgctagcaaggatcaagaagatcatgaaggctgactccaacatcccaaaaagggttgcaggcgaggcaccattgctcttcgccaaggcttgtgagatgttcatccaggagctgacgttgcgggcgtggcttcacactgaggaggacatgaggaggacactgcagaagaaggatgtcaccgcggcgctggctagcaccgaagtctttgatttcctggtggccgacagttcgacggacaacaagccaaagggaaatggcgagggattgccgcctccaacaactgccaaagatgatgatgattcctatggtgactactactgggatgactattcacccccttggtccccagaacccccaagcccggacttgcgcaatgtgacctgtgatgacccaagatactacacttacatccatgactactattctctgtga

SEQ ID NO: 18747 - protein, 224 aa, Sorghum bicolor
  misc_feature: The sequence is a functional homolog of SEQ ID NO 1188 in the 10/412,699 US patent application
  misc_feature: The sequence is a functional homolog of SEQ ID NO 835 in the 10/374,780 US patent application
  misc_feature: The sequence is a functional homolog of SEQ ID NO 1190 in the 10/412,699 US patent application
  misc_feature: The sequence is a functional homolog of SEQ ID NO 837 in the 10/374,780 US patent application
  misc_feature: The sequence is a functional homolog of SEQ ID NO 712 in the 11/479,226 US patent application
  misc_feature: Ceres ANNOT ID no. 8705078
  misc_feature (81)..(153): SWISSPROT Homolog: EC 2.7.7.7 DNA-directed DNA polymerase
  misc_feature (79)..(144): Pfam ID: CBFD_NFYB_HMF Pfam Description: Histone-like transcription factor (CBF/NF-Y) and archaeal histone
MDTEGQPSESAVSEGVTNGDAIPSDFQDDAPVIQPPLSHHHQVASQSQQDDHCHCQQPLQAFWSGQLAEIKQTTNFKTHSLPLARIKKIMKADSNIPKRVAGEAPLLFAKACEMFIQELTLRAWLHTEEDMRRTLQKKDVTAALASTEVFDFLVADSSTDNKPKGNGEGLPPPTTAKDDDDSYGDYYWDDYSPPWSPEPPSPDLRNVTCDDPRYYTYIHDYYSL

SEQ ID NO: 18748 - DNA, 2094 bp, Sorghum bicolor
  misc_feature: Ceres ANNOT ID no. 8705224
  misc_feature: Encodes the peptide sequence at SEQ ID NO 18749
atggcgtcgatgtcagacagcgagacgacaaaccggggcagcatgtgggaactagatcagaaccttgatcagcccatggacgaggaggccagtcagctgaagaacatgtacagagaaaagaaattttcgtcaattttgttactgcggctcgcatttcaaagcctcggggtagtatttggtgacttgggtacatcaccattgtatgttttctataatatctttccacatggtgttgacgaagatgaggatgtaattggagctctatccttgatcatttacacactcactctcatccctctgatgaagtatgtttttgtcgtcttgcgagctaatgataatggtcaagttctttcagcagcaggtggaataagggttcagaatcagaatatgagtacagatgtggttgtaatcgtcgcagtgatcatattaattggcttattctgcatgcaacactatgggacagataaagttgggtggctctttgcaccattggtgctcctttggtttattctaattgggagcgttgggttagtgaacatacacaaatacaacagttctgttctaaaagcatataacccggtctacaccttccggtattttagacggggcaagtctgagatttggacatctcttggaggggtcatgcttagcatcacagggactgaagcattgtatgctgatctatgtcacttccctgtactggctattcagattgcgttcaccttagtggtgttcccttgccttctactggcgtacactgggcaggctgcctacattattgaccacaaggatcatgtagttgatgccttctaccgctccattccagaggcaatatactggccagccttcatcatagcaactcttgcggcagtagttgcaagtcaagcaaccatatctgccacctactcaataattaagcaagctcttgcactgggctgtttcccccgtgtcaatgttgtgcatacctcaaagaaatttctggggcagatttacatccctgacatcaattgggtacttatgattctttgcattgctgtaactgctggattcaagaatcaaagccagataggaaatgcatatggcactgcagtggtgattgttatgctagttacaacatttctcatgatcccagtgatgctgctggtatggaagagccactggatacttgttgtcatcttccttgtactctccttgacggttgagctcccatacttcacggcctgcataaataaagtggatcaaggtggctgggttccactagtcatcgcaataaccttcttcgtcatcatgtacgtgtggcatttctgcaccgtgaagcgctatgaatttgagatgcacagcaaggtctctatggcttggattctgggactggggccaagccttggccttgtcagggtccctgggataggctttgtgtacacggagctggcaagtggcgtcccgcacatcttctctcatttcatcaccaacctccctgccatccactcagttgttgtcttcgtttgcgtcaagtacctcccggtatatacagtgccagccgaggaacggttcatcatgaagcggattgggccaaagaactaccacatgttccgttgcgtcgcgagatatggatacaaggacatccacaagaaagatgacaactttgagaagatgctcctcgacaggctcctgatatttgtcagactggagagcatgatggatggctactctgactccgaggacttcaccattatggagcagaagctgatcgagaaggctgggggcaacacactgagctccatcggtgacctgagctactcatcacaggactccatcgttccagccaagtcgcccctgacagggaacagcctgacaaggtactcaagccagacattcggcgacgagctggagttcctgaaccggtgcaaggacgcaggcgtcgtgcacatccttgggaacacggtcgtgcaggcgcgcagggactcggggttcgtgaagaaggttgctgtgaattatgtgtatgccttccttaggaagctgtgcagagagaacagtgtgatcttcaatgtcccacatgaaagcctcctgaatgtagggcagatatactatatatga

SEQ ID NO: 18749 - protein, 697 aa, Sorghum bicolor
  misc_feature: Useful for making plants with modulated biomass
  misc_feature: Functional homolog of the protein sequence given in SEQ ID NO 13565
  misc_feature: Ceres ANNOT ID no. 8705224
  misc_feature: Up-regulated in shoot tissues in response to salicylic acid treatment
  misc_feature: Up-regulated in root tissues in response to salicylic acid treatment
  misc_feature (49)..(697): Pfam ID: K_trans Pfam Description: K+ potassium transporter
MASMSDSETTNRGSMWELDQNLDQPMDEEASQLKNMYREKKFSSILLLRLAFQSLGVVFGDLGTSPLYVFYNIFPHGVDEDEDVIGALSLIIYTLTLIPLMKYVFVVLRANDNGQVLSAAGGIRVQNQNMSTDVVVIVAVIILIGLFCMQHYGTDKVGWLFAPLVLLWFILIGSVGLVNIHKYNSSVLKAYNPVYTFRYFRRGKSEIWTSLGGVMLSITGTEALYADLCHFPVLAIQIAFTLVVFPCLLLAYTGQAAYIIDHKDHVVDAFYRSIPEAIYWPAFIIATLAAVVASQATISATYSIIKQALALGCFPRVNVVHTSKKFLGQIYIPDINWVLMILCIAVTAGFKNQSQIGNAYGTAVVIVMLVTTFLMIPVMLLVWKSHWILVVIFLVLSLTVELPYFTACINKVDQGGWVPLVIAITFFVIMYVWHFCTVKRYEFEMHSKVSMAWILGLGPSLGLVRVPGIGFVYTELASGVPHIFSHFITNLPAIHSVVVFVCVKYLPVYTVPAEERFIMKRIGPKNYHMFRCVARYGYKDIHKKDDNFEKMLLDRLLIFVRLESMMDGYSDSEDFTIMEQKLIEKAGGNTLSSIGDLSYSSQDSIVPAKSPLTGNSLTRYSSQTFGDELEFLNRCKDAGVVHILGNTVVQARRDSGFVKKVAVNYVYAFLRKLCRENSVIFNVPHESLLNVGQIYYI

SEQ ID NO: 18750 - DNA, 1317 bp, Sorghum bicolor
  misc_feature: Ceres ANNOT ID no. 8705230
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 18751
atgacacagggagattttaagccgcactcacaatgcaagactctattacagagtccaagacaattaattacatattatttatggtattttgctgatgtgacagcatatttattgaagaaagagatgagcgccaagatcaatggggcagcagcagctgctgcattcctgctcttctacactcacctctacttcccaaccactgttcatctctactcctcagccactccattgcttggagccctcgttaatcttacaacgccttcccttccattatacccgttttcggttgattccacctctacccatcatcagtatgactgtaaatacaacccgctatgcgacgacttcccaccggattttcccccgcccgacataccagcagtgtccatcttctgtgtcgatcccaatggctgttgtgaattcacaaccgtgcaggcggcggtcgatgcagttccaaaccacagcagcaaaaggaatgttgtgtggatcaacaagggcatctactttgagaaggtgacagtcccagcatccaagcccaacatcacattccaagggcaggggttcgacctgacagcgatcgcgtggaacgatactgccaagtcggcgaacggcacattctatagcgcctcagtctctgttttcgcatcaggattcattgcgaagaacataagcttcattaatgtagcaccaattccaaggcctggcgctgtcgatgcacaggcagtggcaatcaggatcaatggtgaccaagcagcattctggggttgtggcttctttggagcgcaagacacactccatgacgacagaggccggcattacttcaaggaatgtttcatccagggctccattgactttatctttggagatgctaggtcactctatgaaaattgcagattgatatctattgcagacccagtgccttcagggcaaagatcaattactggttcagtcactgcacatgcccgggtatcagaagatgacaacactggctactcatttgtcaattgtagcataggtggcaccggttggatatggcttggacgagcatggagaccatattctcgggtcatctttgcctacacatcaatgtcagacatcatagcttctgaaggatggaatgactggaatgaccacacaagagatcagactgtattttatggagagtacaagtgtacaggtgatggtgcaaacctggcagatagagtgccttatgctcagaagcttagtgatgtgcaagtgttaccttacctgaacacatctttcatcgatggagatcaatggctgaaaccatactgtgactcactaatatctgcttga

SEQ ID NO: 18751 - protein, 438 aa, Sorghum bicolor
  misc_feature: Useful for making plants with altered carbohydrate content
  misc_feature: Functional homolog of the protein sequence given in SEQ ID NO 14564
  misc_feature: Useful for making plants with altered cell wall content and/or composition
  misc_feature: Functional homolog of the protein sequence given in SEQ ID NO 14565
  misc_feature: Ceres ANNOT ID no. 8705230
  misc_feature (133)..(428): SWISSPROT Homolog: EC 3.1.1.11 Pectinesterase
  misc_feature (133)..(425): Pfam ID: Pectinesterase Pfam Description: Pectinesterase
MTQGDFKPHSQCKTLLQSPRQLITYYLWYFADVTAYLLKKEMSAKINGAAAAAAFLLFYTHLYFPTTVHLYSSATPLLGALVNLTTPSLPLYPFSVDSTSTHHQYDCKYNPLCDDFPPDFPPPDIPAVSIFCVDPNGCCEFTTVQAAVDAVPNHSSKRNVVWINKGIYFEKVTVPASKPNITFQGQGFDLTAIAWNDTAKSANGTFYSASVSVFASGFIAKNISFINVAPIPRPGAVDAQAVAIRINGDQAAFWGCGFFGAQDTLHDDRGRHYFKECFIQGSIDFIFGDARSLYENCRLISIADPVPSGQRSITGSVTAHARVSEDDNTGYSFVNCSIGGTGWIWLGRAWRPYSRVIFAYTSMSDIIASEGWNDWNDHTRDQTVFYGEYKCTGDGANLADRVPYAQKLSDVQVLPYLNTSFIDGDQWLKPYCDSLISA

SEQ ID NO: 18752 - DNA, 633 bp, Sorghum bicolor
  misc_feature: Ceres ANNOT ID no. 8705270
  misc_feature: Encodes the peptide sequence at SEQ ID NO 18753
atggcgcccaagagatcgacgtcgctgtcgtctggaagcaacagcagcagcggcggcggtgtgtgcccgttggcggcggcggcggagcagccgaggctgcgcggcgtgcggaagcggccgtggggccggtacgcggcggagatccgtgacccggtgcggaaggcgcgcgtgtggctcggcaccttcgacacgcccgagcaggcggcgcgggcctacgacgccgccgcgcgcaggctccgcgggcccggcgccaccaccaactacccccaggcctcagagccggttccagcggcgagcgcgagcgggagcggcgtggtgtacgagccgtcgtcgtcgtcttcgtggtccctgccgctgccgccgcaggagtcggtgacggtggcggtcgcggcgtcactggacctcagcctggcgctgccggctgatgcggcggcggccgtgaagccctaccagctgttcatggacccgacggctgcgctggcgctgcgtcagttgttgccgccgaggagcgaggaagagcggaggagccgctccgcacggtggtcatcgtcgtcgtcgtcgtctgcggggcaggtggtgggcttggggcttcttgacctcaacctgcctccgcccgtcgagatggtcatgtag

SEQ ID NO: 18753 - protein, 210 aa, Sorghum bicolor
  misc_feature: Useful for making plants with altered lignin content
  misc_feature: Functional homolog of the protein sequence given in SEQ ID NO 13219
  misc_feature: Useful for making plants with modulated biomass
  misc_feature: Useful for making plants with modulated flowering time
  misc_feature: Functional homolog of the protein sequence given in SEQ ID NO 13801
  misc_feature: Ceres ANNOT ID no. 8705270
  misc_feature (31)..(82): Pfam ID: AP2 Pfam Description: AP2 domain
MAPKRSTSLSSGSNSSSGGGVCPLAAAAEQPRLRGVRKRPWGRYAAEIRDPVRKARVWLGTFDTPEQAARAYDAAARRLRGPGATTNYPQASEPVPAASASGSGVVYEPSSSSSWSLPLPPQESVTVAVAASLDLSLALPADAAAAVKPYQLFMDPTAALALRQLLPPRSEEERRSRSARWSSSSSSSAGQVVGLGLLDLNLPPPVEMVM

SEQ ID NO: 18754 - DNA, 657 bp, Sorghum bicolor
  misc_feature: Ceres ANNOT ID no. 8705269
  misc_feature: Encodes the peptide sequence at SEQ ID NO 18755
atggcgcccaagagatcgtcgtcaccggccggaagcagcggcagcggcgtgttcgaggcggcggcggcggagcagccgaggctgcgcggcgtgcggaagcggccgtggggccggtacgcggcggagatccgtgaccccgttaggaaggcgcgcgtgtggctgggcaccttcgacacgcccgagcaggcggcgcgggcgtacgacgccgccgcgcgcaggctccgtgggcccggcgccaccaccaactacccccagtcctcggagccgatggcgccggcggaggctccagcgcggagcgcgagcgggagcgggagcgccgttgtgcacgagtcgtcgttgtcgtcgtcctcctcctcctcctcctcgtgctccctgctgccggagtcggtgacggtggccgtcacggcgccggccccgtcgctggacctgagcctggcgctgccggcttcggcttcggtcgcaaagacgtaccagctgttcatggatccgacaccggccctgctgccgttcctgcttccgaagagcgaggaggagcggagctgctctgggtcgccgtcgtcgtcatctgtggtgttcgacgcggcgccgccgcccgtgggcctgggtctagggctcgacctcaacctggcgctgctgccggccgagatggtcgtgtga

SEQ ID NO: 18755 - protein, 218 aa, Sorghum bicolor
  misc_feature: Useful for making plants with altered lignin content
  misc_feature: Functional homolog of the protein sequence given in SEQ ID NO 13219
  misc_feature: Ceres ANNOT ID no. 8705269
  misc_feature (26)..(77): Pfam ID: AP2 Pfam Description: AP2 domain
MAPKRSSSPAGSSGSGVFEAAAAEQPRLRGVRKRPWGRYAAEIRDPVRKARVWLGTFDTPEQAARAYDAAARRLRGPGATTNYPQSSEPMAPAEAPARSASGSGSAVVHESSLSSSSSSSSSCSLLPESVTVAVTAPAPSLDLSLALPASASVAKTYQLFMDPTPALLPFLLPKSEEERSCSGSPSSSSVVFDAAPPPVGLGLGLDLNLALLPAEMVV

SEQ ID NO: 18756 - DNA, 711 bp, Sorghum bicolor
  misc_feature: Ceres ANNOT ID no. 8705277
  misc_feature: Encodes the peptide sequence at SEQ ID NO 18757
atgtgccctaactacctccctctttctcctctgctcaacaaccttgctgcctttgcaattgcattgcttccaccagtctatacagctagaggactcaggtcagggaagatgcaacctcatgagaaggttgctgttttgaagcctgtggcctccaggcctttctccaggttcaggccctttccgaatgttctgcaagacttcaatgccaatggttccccaacaatcaccgtcccagaggagactgaactaatcaggccaaaagccactcgatctgcatccctactgggtaatcttccaacacagatagcagcaacaatagatgctgggtcagatgccatatctgaggaggtggaagccaatgcagagcatttgacgtgttgtgaccatgtaacagcatgccaagctgccaggcggaatggtgtgcgcagccgtctgtcactcgatgggtacaactggaggaaatatgggcaaaagaaagtgaaaggcagcgagttcccacggagctactacaagtgcactcaccctagctgccctgtgaagaggaaggtggagacgacaatagatggccggatcgctgaaattgtgtacagtggcgaacacaaccacctgaagccaggcaagccttgtctccccaggaagccattgtcgtcgacaagcacagaggttgtggtgtgcgacatgcgtggtactgacgacacgatgagggagtag

SEQ ID NO: 18757 - protein, 236 aa, Sorghum bicolor
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8705277
  misc_feature (146)..(204): Pfam ID: WRKY Pfam Description: WRKY DNA -binding domain
MCPNYLPLSPLLNNLAAFAIALLPPVYTARGLRSGKMQPHEKVAVLKPVASRPFSRFRPFPNVLQDFNANGSPTITVPEETELIRPKATRSASLLGNLPTQIAATIDAGSDAISEEVEANAEHLTCCDHVTACQAARRNGVRSRLSLDGYNWRKYGQKKVKGSEFPRSYYKCTHPSCPVKRKVETTIDGRIAEIVYSGEHNHLKPGKPCLPRKPLSSTSTEVVVCDMRGTDDTMRE

SEQ ID NO: 18758 - DNA, 645 bp, Sorghum bicolor
  misc_feature: Ceres ANNOT ID no. 8705274
  misc_feature: Encodes the peptide sequence at SEQ ID NO 18759
atggcacccaagaggagcatcagcgaggaggtcacggcggcggcggagctgccggtgccggagccggagcaggggaagccgaggctgcgcggggtgcggaagcggccgtggggccggtacgcggcggagatcagggacccggcgcggaaggcgcgggtgtggctgggcaccttcgacacgcccgagcaggccgcgcgcgcctacgacgccgccgcgcgcaggctccgcggcccgcgcgccaccaccaactacacctaccccgacgccgtcgtcccagcaccgccgccgtgcgccgccgcgcaggttccgagcgccagcgccagcgccagcgcccgggaagagtcttgttcgtcctcgttctccaccagggacgacgactaccacccgctggcagtgaccgtagcggtcgctgcgccgccggctccgtcgcagtcgcagtcgccgtcgtcgctcgacctaggccttgggctcttcccggcgatggtggccgcccagccgtacctgttcctgaacccgatgcagttggcgccggtgaagagggaggcggagcggagctgctactcggggtcgtcgtcgccgtcgccgtcggtgctgggactgggactcgacctcaacctgcctccgccggccgagatggtcatgtag

SEQ ID NO: 18759 - protein, 214 aa, Sorghum bicolor
  misc_feature: Useful for making plants with altered lignin content
  misc_feature: Functional homolog of the protein sequence given in SEQ ID NO 13219
  misc_feature: Ceres ANNOT ID no. 8705274
  misc_feature (27)..(78): Pfam ID: AP2 Pfam Description: AP2 domain
MAPKRSISEEVTAAAELPVPEPEQGKPRLRGVRKRPWGRYAAEIRDPARKARVWLGTFDTPEQAARAYDAAARRLRGPRATTNYTYPDAVVPAPPPCAAAQVPSASASASAREESCSSSFSTRDDDYHPLAVTVAVAAPPAPSQSQSPSSLDLGLGLFPAMVAAQPYLFLNPMQLAPVKREAERSCYSGSSSPSPSVLGLGLDLNLPPPAEMVM

SEQ ID NO: 18760 - DNA, 864 bp, Sorghum bicolor
  misc_feature: Ceres ANNOT ID no. 8705263
  misc_feature: Encodes the peptide sequence at SEQ ID NO 18761
atggcggaggcgacggcgtacgaggagcagcggcggaggcaggtggaggcgaacaagcggaagttggaggagctgcagctccaccacctctccgccgccgtcagagaggccgccgccgccgccaagccctcgccggtcaagaagcggaaggcgcgggtgccgcttgacgccgccgacgccgtgatgcagccactacggcggtccggcagagtcgccaacctccccgataagcccgcgtaccgcgaggaggttcctgctttcgcgaggaggattaggaggacgtacggaagaaaggatctggccaaccgggtgtacgcgaccgacgaggcgaggagctacaccatctctaaggcggaggatcttgagcaagagctggactccaggttccccttgttcatcaagcccatgacccagtcccatgtcaccgggggcttctggctgggcctgccgactggtttctgccggaagcacctgcccaagcgcgacgagacgatcaccctggtggatgaggatgatgtcgagtccaacacgctctacctcgcaatgaagaagggcctcagcggtggatggagagggttcgccatccagcacaagctggttgatggagattgcttggtcttccagctgattgagaggactaagttcaagaagtccacaattgaaccaaaagaggtgttttttataactacactgtacttccattgtgggtgccttggacaagctcacatctggaaattgctgggtgtgttgaaccttttgggtggcagaaagttagctgattatctaccaatggctaatttgtgtacttcttgggctttaccacttgcacggttcagcaacctgcactatgtaaggggatgttga

SEQ ID NO: 18761 - protein, 287 aa, Sorghum bicolor
  misc_feature: Useful for making plants with altered terpenoid content
  misc_feature: Functional homolog of the protein sequence given in SEQ ID NO 13124
  misc_feature: Ceres ANNOT ID no. 8705263
  misc_feature (131)..(220): Pfam ID: B3 Pfam Description: B3 DNA binding domain
MAEATAYEEQRRRQVEANKRKLEELQLHHLSAAVREAAAAAKPSPVKKRKARVPLDAADAVMQPLRRSGRVANLPDKPAYREEVPAFARRIRRTYGRKDLANRVYATDEARSYTISKAEDLEQELDSRFPLFIKPMTQSHVTGGFWLGLPTGFCRKHLPKRDETITLVDEDDVESNTLYLAMKKGLSGGWRGFAIQHKLVDGDCLVFQLIERTKFKKSTIEPKEVFFITTLYFHCGCLGQAHIWKLLGVLNLLGGRKLADYLPMANLCTSWALPLARFSNLHYVRGC

SEQ ID NO: 18762 - DNA, 2289 bp, Sorghum bicolor
  misc_feature: Ceres ANNOT ID no. 8705315
  misc_feature: Encodes the peptide sequence at SEQ ID NO 18763
atgtggaggctcaagattgccaagggtggaccgtggctcaagagtggcaacagtcacattggaagagaaacatgggagtttgatcaagattttggatcaaaagaagagagggaagctgttgactctgcacgggaagaattcaagaagaacaggttccaaatgagacacagctccgatattttggcccgcatgcagttagcaaaggagaacggtttcagtcttgatctacagaagacaaaagatgaatctcctttagttataaactccagcacagtgtcggagatactgagaaaggcacttaattacttctcagccatacaagcacacgatgggcactggccaggagattttccaggtccattgtttaccacagcaaccatgattatagttctatacgtcacagagtcattaagtagtacactatcgtcagaacactgcaaggagatttgtcgttacctgtacaaccgtcagaacatggacggaggatgggggctacatgcagaaggtgaaagctccatgcttagcacagctctcaactatactactctaaggctacttggtgagaatatagatgatggaccagatatgtctatgcttaaagcaagaaaatggatacatgatcatggtggtgcaacaatgataccaatcttggggaaagtgtggctctcggtgcttggagtttttgaatggtcaggtgtaaatcccatccccccagaattgtttcttcttccatcatgggttcctattcaaccaggacgattgtggagtcacttcagaatggcattcattcccatgtgctatttatatggcaagaaatttgtcggccccattacgagattggttatgtcactaagggaagagctacatattcatccctataaaaagattgactggaagcaagctcgtaaattatgtgcaaaggaagatgtgtataatccacatacatggctacaggagtgtctatctgactgcctttacagttttggtgaaccttttctcacacgttggccaatttcctacatgagaaagaaagccctaaaacaagtggctgaattcttgaaatacgaagatgagaattctcaatacatctgcattggtgccgcacagaaggcattgtccatgttgtgctgttggatcgaaaaatccaactcagatgcattcaagcgccatttggctagagttgctgatttcctatggattggtgaagatggcatgaaagtgcgggtctgtgctggtcaactatgggatgttgcttttgcagtccaagcaatattagcatgtaatattgcagaagaatatagaagcaccctcaagaaagcgcatgatttcataaaagcctcccagatcatggacaatccttctggtgacttcagcagaaagtaccgtcacatatctaaaggagggtggggcttccaggttgcagatcaggggtggcaggtttcagattgcacagcagaagctcttaaggttttgttaatgctgtccaaattttcatcagacattggtagtgatcagatggaaacatgccgcttatataatgcagtgaatgtattattatccttacagaacccaaacggtggctatggaacttgggagctagctcgcacatatccatggatggagattttcaacatgacagaaatatatgcagacatcatggtggagcatcagtacgtcgagtgtacctcatcagtcatgcaagcattagcattgtttcaggagaagtacccttggcatcgaaaagatgagatagatcaatgcattaggggagctactgaattcattgagaagttacagaatgatgatggctcatggtttggatcttggggtatttgtttcacatatggcacatggtttgctattgagggtctatcagctgttggacagagttatggtaacagcacttgtatccggaaggcctgtaagtttctcttaacaaagcagctaaacaatggtggatggggtgagagttatctttcatcaagaaccaaggcatacacaaatctggataggcagaagtcacacatagtgaacactgcatgggcaatgttggcgctcatgaaagctggacaggtggaaagagatcctactccactgcacaaagctgcaagacttatcatgagtatgcagctcggcaatggtgacttcccacaggaggaaatgattggaagtttcttgaaaaatggtcccttgtgctacatggcttatcgtaacatatttcctatatgggcgcttggagagtatcagaaattagtcctccagtgtgacctccaacggccaaccttctag

SEQ ID NO: 18763 - protein, 762 aa, Sorghum bicolor
  misc_feature: The sequence is a functional homolog of SEQ ID NO 6 in US patent 7122717
  misc_feature: The sequence is a functional homolog of SEQ ID NO 4 in US patent 7135624
  misc_feature: Ceres ANNOT ID no. 8705315
  misc_feature (1)..(753): SWISSPROT Homolog: EC 5.4.99.8 Cycloartenol synthase
  misc_feature (586)..(628): Pfam ID: Prenyltrans Pfam Description: Prenyltransferase and squalene oxidase repeat
  misc_feature (144)..(187): Pfam ID: Prenyltrans Pfam Description: Prenyltransferase and squalene oxidase repeat
  misc_feature (635)..(690): Pfam ID: Prenyltrans Pfam Description: Prenyltransferase and squalene oxidase repeat
MWRLKIAKGGPWLKSGNSHIGRETWEFDQDFGSKEEREAVDSAREEFKKNRFQMRHSSDILARMQLAKENGFSLDLQKTKDESPLVINSSTVSEILRKALNYFSAIQAHDGHWPGDFPGPLFTTATMIIVLYVTESLSSTLSSEHCKEICRYLYNRQNMDGGWGLHAEGESSMLSTALNYTTLRLLGENIDDGPDMSMLKARKWIHDHGGATMIPILGKVWLSVLGVFEWSGVNPIPPELFLLPSWVPIQPGRLWSHFRMAFIPMCYLYGKKFVGPITRLVMSLREELHIHPYKKIDWKQARKLCAKEDVYNPHTWLQECLSDCLYSFGEPFLTRWPISYMRKKALKQVAEFLKYEDENSQYICIGAAQKALSMLCCWIEKSNSDAFKRHLARVADFLWIGEDGMKVRVCAGQLWDVAFAVQAILACNIAEEYRSTLKKAHDFIKASQIMDNPSGDFSRKYRHISKGGWGFQVADQGWQVSDCTAEALKVLLMLSKFSSDIGSDQMETCRLYNAVNVLLSLQNPNGGYGTWELARTYPWMEIFNMTEIYADIMVEHQYVECTSSVMQALALFQEKYPWHRKDEIDQCIRGATEFIEKLQNDDGSWFGSWGICFTYGTWFAIEGLSAVGQSYGNSTCIRKACKFLLTKQLNNGGWGESYLSSRTKAYTNLDRQKSHIVNTAWAMLALMKAGQVERDPTPLHKAARLIMSMQLGNGDFPQEEMIGSFLKNGPLCYMAYRNIFPIWALGEYQKLVLQCDLQRPTF

SEQ ID NO: 18764 - DNA, 1581 bp, Sorghum bicolor
  misc_feature: Ceres ANNOT ID no. 8705326
  misc_feature: Encodes the peptide sequence at SEQ ID NO 18765
atggcgcgcggcgggcggtccgtgtcccagcccgtggcggcggagctgctgctggtgctcgcggtggcgctgtgcgcggcggcgaggcgcacgagcgcgatcggcgtgaactggggcacgcagctgagccaccagcttccggcgagcacggtggtgcggctgctgcaggacaacggcttcgacaaggtcaagctgttcgacgccgaggacaccatcctcggcgcgctcaagggatccggcatccaggtcatggtcggcatccccaacgacctgctcgccgacctcgccgccggcggcaaggccgccgacaactgggtcgccaagaacgtctctggtcacgtccgcgacggcgtcgatatcaggtacgtggcggtgggcaacgagccgttcctggagacgttcaacgggacgtacctgaagacgacgttcccggcgatgcagaacgtccaggcggcgctggtgaaggccgggctggcggacaaggtgaaggtgacggtgccgttgaacgccgacgtgtaccagtcgccgacggggaagccgtcggacggcgacttccgcgccgacatccacggcctcatgctcaccatcgtgcagttcctggcgtccacggggtcccccttcgtcgccaacgtctaccctttcatcagcctctacgccgacccaaacttcccgctcgactacgccttcttccagggctcctcgtcccccgtcgtcgacggcggcggcgtcacgtaccagaacaccttcgacgccaaccacgacacgctcgtggccgcgctgcgccggaacggcttcggcaacgtctccgtcgtcgtcggcgaggtggggtggccgaccgacggcgacgccaacgctaacctcgactacgcccgccgcttcaaccagggcttcctcacccacatcgcctccggccagggcacgccgctgcggccggggccggtagatgcctacctcttcagcctcatcgacgaggaccgcaagagcatccagccgggcaacttcgagcgacactggggcatcttctactacgacggcacgcccaagtacccgctcagcctcgccgccggcgaggggagtcaagtacctggagaagaagtggtgcgtgctgaagccggcggcggacctcgccgaccagaaggtgggcgacagcgtcagctacgcgtgcgggctcgccgactgcaccagcctcggctacaagacctcctgcgctggcctcgacgccaagggcaacgtctcctacgcctacaacatctactaccagaccatggaccaggacgaccgcgcctgcggcttcaacgggctcgccaccaccacctccgtcgacccgtccgccgggacatgccgcttcatcgtcgagatcgacgtcggcgccgccgccgcgcccagctctgccatggccggcgtcgccgtcgggtgggccgctgccgtgctcgcggccttcgtgctgtccgtggtgttgtgaaactgaatcaagctttggtttccctcgatcgtcgtcacatagataagaccgatcgtggtcttcgcgtgcccttttgtcttgagctcgcttctggtgatgccaggagaattattgactag

SEQ ID NO: 18765 - protein, 526 aa, Sorghum bicolor
  misc_feature: Useful for making plants with altered carbohydrate content
  misc_feature: Functional homolog of the protein sequence given in SEQ ID NO 14665
  misc_feature: Useful for making plants with altered cell wall content and/or composition
  misc_feature: Functional homolog of the protein sequence given in SEQ ID NO 14666
  misc_feature: Ceres ANNOT ID no. 8705326
  misc_feature (33)..(354): SWISSPROT Homolog: EC 3.2.1.39 Glucan endo-1,3-beta-D-glucosidase
  misc_feature (34)..(353): Pfam ID: Glyco_hydro_17 Pfam Description: Glycosyl hydrolases family 17
MARGGRSVSQPVAAELLLVLAVALCAAARRTSAIGVNWGTQLSHQLPASTVVRLLQDNGFDKVKLFDAEDTILGALKGSGIQVMVGIPNDLLADLAAGGKAADNWVAKNVSGHVRDGVDIRYVAVGNEPFLETFNGTYLKTTFPAMQNVQAALVKAGLADKVKVTVPLNADVYQSPTGKPSDGDFRADIHGLMLTIVQFLASTGSPFVANVYPFISLYADPNFPLDYAFFQGSSSPVVDGGGVTYQNTFDANHDTLVAALRRNGFGNVSVVVGEVGWPTDGDANANLDYARRFNQGFLTHIASGQGTPLRPGPVDAYLFSLIDEDRKSIQPGNFERHWGIFYYDGTPKYPLSLAAGEGSQVPGEEVVRAEAGGGPRRPEGGRQRQLRVRARRLHQPRLQDLLRWPRRQGQRLLRLQHLLPDHGPGRPRLRLQRARHHHLRRPVRRDMPLHRRDRRRRRRRAQLCHGRRRRRVGRCRARGLRAVRGVVKLNQALVSLDRRHIDKTDRGLRVPFCLELASGDARRIID

SEQ ID NO: 18766 - DNA, 504 bp, Sorghum bicolor
  misc_feature: Ceres ANNOT ID no. 8705318
  misc_feature: Encodes the peptide sequence at SEQ ID NO 18767
atgcatacatactacaggcacgtcaagtgtacctcatcagtcatgcaagcattagcattgttcaaggagaagtacccttggcatcgaaaagatgaaatagatcaatgcattaggggagctactgaattcattgagaagttacagaatgatgatggtttggatcttggggtatttgtttcacatattggcacatggtttgctattgagggtctctcagttgttggacagagttatggtaacagcacttgtatccggaaggcctgtaagtttctcttaacaaagcagctaaagagtggtggatggggtgagagtcatctttcatcaagaaccaagctagagaatgtggaaagagatcccactccactgcacaaagctgcaagacttaccatgagtatgcagctcggcaatggtgacttcccacaggaggtgactgctaagtgtgctctgtattatacaattcactttttaatcttggcattctctgttataatgacgctaacataa

SEQ ID NO: 18767 - protein, 167 aa, Sorghum bicolor
  misc_feature: The sequence is a functional homolog of SEQ ID NO 6 in US patent 7122717
  misc_feature: Ceres ANNOT ID no. 8705318
  misc_feature (5)..(159): SWISSPROT Homolog: EC 5.4.99.8 Cycloartenol synthase
MHTYYRHVKCTSSVMQALALFKEKYPWHRKDEIDQCIRGATEFIEKLQNDDGLDLGVFVSHIGTWFAIEGLSVVGQSYGNSTCIRKACKFLLTKQLKSGGWGESHLSSRTKLENVERDPTPLHKAARLTMSMQLGNGDFPQEVTAKCALYYTIHFLILAFSVIMTLT

SEQ ID NO: 18768 - DNA, 471 bp, Sorghum bicolor
  misc_feature: Ceres ANNOT ID no. 8705414
  misc_feature: Encodes the peptide sequence at SEQ ID NO 18769
atggcgtcccccaagtggcaggtttgttttatgaattacaaagttgtatctgtgaggtcaccggtgttcaaggcaaagttctatgggcctgagatggaggagaatctaggttgcattgctgttgaggatgtgcggcctgctgtcttaaaagccatgctccatttcatctacactgactcattgcctgatatggatgctcttggcgatgttgataagcaagaaatgattcggcatttgctggtgattgcagatcagtatgaaatgaagaggctgaagttgatgtccttagtgtggattctgtctgagcagcataatttatgcatcctaaaagatgcttgcatcgagtatattgcgttctcaaacaagattgatgatgtggtggcaagacaaggctatgttcagataaaaagattgtgtccttcagttttgctggaggtattggagaagtcaagcaagtttccccgggtctag

SEQ ID NO: 18769 - protein, 156 aa, Sorghum bicolor
  misc_feature: The sequence is a functional homolog of SEQ ID NO 1918 in the 10/374,780 US patent application
  misc_feature: Ceres ANNOT ID no. 8705414
  misc_feature (1)..(95): Pfam ID: BTB Pfam Description: BTB/POZ domain
MASPKWQVCFMNYKVVSVRSPVFKAKFYGPEMEENLGCIAVEDVRPAVLKAMLHFIYTDSLPDMDALGDVDKQEMIRHLLVIADQYEMKRLKLMSLVWILSEQHNLCILKDACIEYIAFSNKIDDVVARQGYVQIKRLCPSVLLEVLEKSSKFPRV

SEQ ID NO: 18770 - DNA, 474 bp, Sorghum bicolor
  misc_feature: Ceres ANNOT ID no. 8705538
  misc_feature: Encodes the peptide sequence at SEQ ID NO 18771
atggcgccgcgcgaggggaagggcgccaggtaccatgttccctgtttgtttcttcaaccaggcaacaatgatatagtccttttcgagcaatttggtggtgacccaagcaagatatcctttgtgataaggcagacaggaagtgtgatcgcacaagtatcagaggaacatccagcccaaattgatagttggaattcttctcaacagacaatgcaaagatatggacctgaacttcgcctggaatgcccaaaagatggacaggtcatcagcagcatcaagtttgcaagctttgggacaccgagcggcacgtgcagaagctacagccacggagaatgcagcagcattcaggctatctcagttgttcaggaggcttgcattggagtgagcaactgcagcgtgccagtgtcgtcgaattactttggaaatccatggacaggggtcacaaaaagccttgcggttgaagctgcatgttcgtga

SEQ ID NO: 18771 - protein, 157 aa, Sorghum bicolor
  misc_feature: Useful for making plants with altered cell wall content and/or composition
  misc_feature: Functional homolog of the protein sequence given in SEQ ID NO 14667
  misc_feature: Ceres ANNOT ID no. 8705538
  misc_feature (11)..(157): SWISSPROT Homolog: EC 3.2.1.23 Beta-galactosidase
  misc_feature (79)..(156): Pfam ID: Gal_Lectin Pfam Description: Galactose binding lectin domain
MAPREGKGARYHVPCLFLQPGNNDIVLFEQFGGDPSKISFVIRQTGSVIAQVSEEHPAQIDSWNSSQQTMQRYGPELRLECPKDGQVISSIKFASFGTPSGTCRSYSHGECSSIQAISVVQEACIGVSNCSVPVSSNYFGNPWTGVTKSLAVEAACS

SEQ ID NO: 18772 - DNA, 474 bp, Sorghum bicolor
  misc_feature: Ceres ANNOT ID no. 8705544
  misc_feature: Encodes the peptide sequence at SEQ ID NO 18773
atggcgccgcgcgaggggaagtgcgccaggtaccatgttccctgtttgtttcttcaaccaggcagcaatgatatagtcctttttgagcaatttggtggtgacccaagcaagatatcctttgtgataaggcagacacgaagtgtgtgcgcacaagtatcagaggaacatccagcccaaattgatagttggaattcttctcaacagacaatgcaaagatatagacctgaacttcgcctggaatgcccaaaagatggacaggtcatcagcagcatcaagtttgcaagctttgggacaccgagcggcacgtgcggaagctacagccatggagaatgcagcagcactcaggctatctcagttgttcaggaggcttgcattggagtgagcaactgcagcgtgccagtgtcgtcgaattactttggaaatccatggacaggggtcacaaaaagccttgcggttgaagctgcatgttcgtga

SEQ ID NO: 18773 - protein, 157 aa, Sorghum bicolor
  misc_feature: Useful for making plants with altered cell wall content and/or composition
  misc_feature: Functional homolog of the protein sequence given in SEQ ID NO 14667
  misc_feature: Ceres ANNOT ID no. 8705544
  misc_feature (11)..(157): SWISSPROT Homolog: EC 3.2.1.23 Beta-galactosidase
  misc_feature (79)..(156): Pfam ID: Gal_Lectin Pfam Description: Galactose binding lectin domain
MAPREGKCARYHVPCLFLQPGSNDIVLFEQFGGDPSKISFVIRQTRSVCAQVSEEHPAQIDSWNSSQQTMQRYRPELRLECPKDGQVISSIKFASFGTPSGTCGSYSHGECSSTQAISVVQEACIGVSNCSVPVSSNYFGNPWTGVTKSLAVEAACS

SEQ ID NO: 18774 - DNA, 474 bp, Sorghum bicolor
  misc_feature: Ceres ANNOT ID no. 8705541
  misc_feature: Encodes the peptide sequence at SEQ ID NO 18775
atggcgctgcgcgaggggaagtgcgccaggtaccatgttccctgtttgtttcttcaaccaggcagcaatgatatagtcctttttgagcaatttggtggtgacccaagcaagatatcctttgtgataaggcagacacgaagtgtgtgcgcacaagtatcagaggaacatccagcccaaattgatagttggaattcttctcaacagacaatgcaaagatatagacctgaacttcgcctggaatgcccaaaagatggacaggtcatcagcagcatcaagtttgcaagctttgggacaccgagcggcacgtgcggaagctacagccatggagaatgcagcagcactcaggctatctcagttgttcaggaggcttgcattggagtgagcaactgcagcgtgccagtgtcgtcgaattactttggaaatccatggacaggggtcacaaaaagccttgcggttgaagctgcatgttcgtga

SEQ ID NO: 18775 - protein, 157 aa, Sorghum bicolor
  misc_feature: Useful for making plants with altered cell wall content and/or composition
  misc_feature: Functional homolog of the protein sequence given in SEQ ID NO 14667
  misc_feature: Ceres ANNOT ID no. 8705541
  misc_feature (11)..(157): SWISSPROT Homolog: EC 3.2.1.23 Beta-galactosidase
  misc_feature (79)..(156): Pfam ID: Gal_Lectin Pfam Description: Galactose binding lectin domain
MALREGKCARYHVPCLFLQPGSNDIVLFEQFGGDPSKISFVIRQTRSVCAQVSEEHPAQIDSWNSSQQTMQRYRPELRLECPKDGQVISSIKFASFGTPSGTCGSYSHGECSSTQAISVVQEACIGVSNCSVPVSSNYFGNPWTGVTKSLAVEAACS

SEQ ID NO: 18776 - DNA, 2076 bp, Sorghum bicolor
  misc_feature: Ceres ANNOT ID no. 8705633
  misc_feature: Encodes the peptide sequence at SEQ ID NO 18777
atgtggaggctcaaggtcgccgaggggggcgggccatggctgaagtcgtgcaacaacttccgcgggcgggtggtgtgggagttcgacccggagctcggcacgccagaggagcgcgccgaggtggagagggtgcgccgggagttcacggagcgccgcttcgagaagagggagtcctctgatctcttattgcgtatgcaggtattcgctctatataccactgggtcactcgataccgtcctatctaaagaacatcgacgtgagatatgtcgctatatttacaatcatcagaatgaagatggtggctggggtaaacaagtgttgggaccaagcaccatgttcggctcatgcttgaactatgttgccttaagacttattggtgaaaagcccacgaatgctgcattgaccaaaggacgtcagtggattttatcccatggaagtgcagctgcaattccacagtggggaaagatatggttctcggtgatgggtttgtatgattggtctggaaataatccaatagttcctgaattatggcttgtcccacactttcttccaattcatccaggacgattttgggtattttgtcgtatggtgtatctgcctatggcttatctctttggtagaaaattcatcggaacgattactccaactatattggaattaagggatgagctctattccgtaccatacagtgaggttgattgggaaaaagctcgtgatacttgtgccaaggtggaccttatatatcctcgaacaatggcacaaaatcttgtatggacctgccttaataaggttatagagccaatgctgaattgttggccagtaaataagttaagagatatagcattgaaaaacatcatgaaacatatccactacgaagatgaaactagtaaatacatctgtacatgtccgataaacaaggcgctagatatgatttgttgttgggcagagaatccaaattcagattcattcaaaaaacatcttccaaggatatatgatatgttatggattgcggaagatggcatgaaggcacaggtctatgatggtaatccaacatgggagacttctttcattgtccaagcctattgctccacaggtcttgttaatgagattggttcaacactccgtaaagctcatgaatttattaagagttcacagatttgtgagaaccaccccgactacaaaacttactaccgtcataaatcaaaaggttcatggacactttcaacagcagataatggatggtcagtatctgactgtactgctgaagcagtgaaggcattgatgttgttatcaaagatttccccagatcttgtgggggaacccatagaaggacaaagtttgtacaatgcagtggattgcctactttcttatgtgaacaatgatggcaccttctcaacatatgagtgtaagagaaccacacctttattggaggttctcaacccttcagagagctttataaatattgttgttgattatccatctgttgaatgcacatcatcagtgctacaagctctgattatgttcagagacctagatcatgggtatcgcaaagaagagataggaaattgcattgaaagcgcaactaagtttattgagaaagaacaacgaaaagatggctcctggtttggcagttggggtgtatgtttcacatatgggtcgttctttgcgataaaagggttagctgcttctggaagaacttacaaaaatagtgataccatcaggaaagcatgtaactttttgttgtcgaagcaactacatacaggtggatggggagaaagttatctttctagtgaaactgaggaatatgtggatgctagtagacctcatgctgtgaacactgcttgggcaatgttagccttagtttatggtgggcaggtggaacgtgatccaacaccattatataaagctgcaaaagtgttgatcaatatgcaactagaatctggtgactttccacaacaagaacatgttgggtgctttaatagttctttgtacttcaactacgggaactaccgcaacttgtatcctatatgggctcttggggaatttcgtcaacggctccttgcaagaaagaagtga

SEQ ID NO: 18777 - protein, 691 aa, Sorghum bicolor
  misc_feature: The sequence is a functional homolog of SEQ ID NO 15 in US patent 7186884
  misc_feature: The sequence is a functional homolog of SEQ ID NO 6 in US patent 7122717
  misc_feature: The sequence is a functional homolog of SEQ ID NO 4 in US patent 7135624
  misc_feature: Ceres ANNOT ID no. 8705633
  misc_feature: Down-regulated in shoot tissues in response to methyl jasmonate treatment
  misc_feature (62)..(690): SWISSPROT Homolog: EC 5.4.99.8 Cycloartenol synthase
  misc_feature (83)..(126): Pfam ID: Prenyltrans Pfam Description: Prenyltransferase and squalene oxidase repeat
  misc_feature (522)..(564): Pfam ID: Prenyltrans Pfam Description: Prenyltransferase and squalene oxidase repeat
  misc_feature (571)..(624): Pfam ID: Prenyltrans Pfam Description: Prenyltransferase and squalene oxidase repeat
MWRLKVAEGGGPWLKSCNNFRGRVVWEFDPELGTPEERAEVERVRREFTERRFEKRESSDLLLRMQVFALYTTGSLDTVLSKEHRREICRYIYNHQNEDGGWGKQVLGPSTMFGSCLNYVALRLIGEKPTNAALTKGRQWILSHGSAAAIPQWGKIWFSVMGLYDWSGNNPIVPELWLVPHFLPIHPGRFWVFCRMVYLPMAYLFGRKFIGTITPTILELRDELYSVPYSEVDWEKARDTCAKVDLIYPRTMAQNLVWTCLNKVIEPMLNCWPVNKLRDIALKNIMKHIHYEDETSKYICTCPINKALDMICCWAENPNSDSFKKHLPRIYDMLWIAEDGMKAQVYDGNPTWETSFIVQAYCSTGLVNEIGSTLRKAHEFIKSSQICENHPDYKTYYRHKSKGSWTLSTADNGWSVSDCTAEAVKALMLLSKISPDLVGEPIEGQSLYNAVDCLLSYVNNDGTFSTYECKRTTPLLEVLNPSESFINIVVDYPSVECTSSVLQALIMFRDLDHGYRKEEIGNCIESATKFIEKEQRKDGSWFGSWGVCFTYGSFFAIKGLAASGRTYKNSDTIRKACNFLLSKQLHTGGWGESYLSSETEEYVDASRPHAVNTAWAMLALVYGGQVERDPTPLYKAAKVLINMQLESGDFPQQEHVGCFNSSLYFNYGNYRNLYPIWALGEFRQRLLARKK

SEQ ID NO: 18778 - DNA, 753 bp, Sorghum bicolor
  misc_feature: Ceres ANNOT ID no. 8705697
  misc_feature: Down-regulated in shoot tissues in response to methyl jasmonate treatment
  misc_feature: Encodes the peptide sequence at SEQ ID NO 18779
atggtgaagggtaagtcgaccaagggtaggcaaaggattgagatgaagcgcatcaaaggtgaggaggcacggcaggtatgcttctccaagcgacgcccaagcttattcaagaaggctagcgagctttccaccctatgcggtgcagaggttgctgttgtcacgttctcccctggtggcaaatgcttgtcatttggccatccctctactttgtctgttgctgaccgcttccttgccgcgcatactttggatggcctcaccattggaagtgatagccatggtactcaagggttgaccggtagtagtcaagagatgaatcagcaggttatggagttgcaaaaattaatggagaccgagaagaggaggaaggagatgctagtagacgctatggatagggagagtggggggcctgtaatgcaactgttgaatgccaatgttagtgcattagggatacatgagttggagcagttgagaaaggagctttgtatggtacaagacatggttaaggagaagtcccacgagatgctgcaagatgccatgcaaacaagaaggctgccaccacaacctcctatgcatatggcagcaatgccctggcaagttttgtctggtgaccagagggccggaaccatgtataccactgttcccagttcgagcagtggaccatgtgaagggcttcacgccagctctctgctccattgttcccatggtggtcttggcaattactctaatgaactggtgagcctagcaacgttataa

SEQ ID NO: 18779 - protein, 250 aa, Sorghum bicolor
  misc_feature: Useful for making plants with modulated flowering time
  misc_feature: Functional homolog of the protein sequence given in SEQ ID NO 13660
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8705697
  misc_feature (16)..(66): Pfam ID: SRF-TF Pfam Description: SRF-type transcription factor (DNA-binding and dimerisation domain)
MVKGKSTKGRQRIEMKRIKGEEARQVCFSKRRPSLFKKASELSTLCGAEVAVVTFSPGGKCLSFGHPSTLSVADRFLAAHTLDGLTIGSDSHGTQGLTGSSQEMNQQVMELQKLMETEKRRKEMLVDAMDRESGGPVMQLLNANVSALGIHELEQLRKELCMVQDMVKEKSHEMLQDAMQTRRLPPQPPMHMAAMPWQVLSGDQRAGTMYTTVPSSSSGPCEGLHASSLLHCSHGGLGNYSNELVSLATL

SEQ ID NO: 18780 - DNA, 207 bp, Sorghum bicolor
  misc_feature: Ceres ANNOT ID no. 8705635
  misc_feature: Encodes the peptide sequence at SEQ ID NO 18781
atgtggaggctcaaggtcgccgaggggggcgggccatggctgaagtcgtgcaacaacttccgcgggcgggcggtgtgggagttcgacccggagctcggcacgccagaggagcgcgccgaggtggagagggtgcgccgggagttcacggagcgccgcttccagaagagggagtcctctgacctcctcttgcgcatgcaggtgctttag

SEQ ID NO: 18781 - protein, 68 aa, Sorghum bicolor
  misc_feature: The sequence is a functional homolog of SEQ ID NO 15 in US patent 7186884
  misc_feature: Ceres ANNOT ID no. 8705635
  misc_feature (1)..(66): SWISSPROT Homolog: EC 5.4.99.8 Cycloartenol synthase
MWRLKVAEGGGPWLKSCNNFRGRAVWEFDPELGTPEERAEVERVRREFTERRFQKRESSDLLLRMQVL

SEQ ID NO: 18782 - DNA, 1164 bp, Sorghum bicolor
  misc_feature: Ceres ANNOT ID no. 8705694
  misc_feature: Encodes the peptide sequence at SEQ ID NO 18783
atggtgaagggtaagtcgaccaagggtaggcaaaggattgagatgaagcgcatcaaaggtgaggaggcacggcaggtatgcttctccaagcgacgcccaagcttattcaagaaggctagcgagctttccaccctatgcggtgcagaggttgctgttgtcacgttctcccctggtggcaaatgcttgtcatttggccatccctctactttgtctgttgctgaccgcttccttgccgcgcatactttggatggcctcaccattggaagtgatagccatggtactcaagggttgaccggtagtagtcaagagatgaatcagcaggttatggagttgcaaaaattaatggagaccgagaagaggaggaaggagatgctagtagacgctatggatagggagagtggggggcctgtaatgcaactgttgaatgccaatgttagtgcattagggatacatgagttggagcagttgagaaaggagctttgtatggtacaagacatggttaaggagaagtcccacgagatgctgcaagatgccatgcaaacaagaaggctgccaccacaacctcctatgcatatggcagcaatgccctggcaagttttgtctggtgaccagagggccggaaccatgtataccactgttcccagttcgagcagtggaccatgtgaagggcttcacgccagctctctgctccattgttcccatggtggtcttggcaattactctaatgcctctgtttcagaaagtttgttgttctacgttgtactagtaacaactaaccacagttctcagcgccatgtggcgactcgagaatctgttctctcctggcgactagggtttccgttccaccttcgtgcttggactggatccttcccccttgatctgagccttgactccaccatcgcgtccaacgtttgtgtccacgttcaattctccaattcgagcctagccttgccgagtctcaggtcgccagggggccctagggtttgtgactgcgtcattggtcgcagggatcctttggatccagagggttatgggggtgtcggggttgatggagagaaattgaggctgatggataatgagaagatgggcatcaagatcgaaggcatgaaggcagcgatctattggcccggtggaactgcaggcggtggcaaaagtccaggctga

SEQ ID NO: 18783 - protein, 387 aa, Sorghum bicolor
  misc_feature: Useful for making plants with modulated flowering time
  misc_feature: Functional homolog of the protein sequence given in SEQ ID NO 13660
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8705694
  misc_feature (16)..(66): Pfam ID: SRF-TF Pfam Description: SRF-type transcription factor (DNA-binding and dimerisation domain)
MVKGKSTKGRQRIEMKRIKGEEARQVCFSKRRPSLFKKASELSTLCGAEVAVVTFSPGGKCLSFGHPSTLSVADRFLAAHTLDGLTIGSDSHGTQGLTGSSQEMNQQVMELQKLMETEKRRKEMLVDAMDRESGGPVMQLLNANVSALGIHELEQLRKELCMVQDMVKEKSHEMLQDAMQTRRLPPQPPMHMAAMPWQVLSGDQRAGTMYTTVPSSSSGPCEGLHASSLLHCSHGGLGNYSNASVSESLLFYVVLVTTNHSSQRHVATRESVLSWRLGFPFHLRAWTGSFPLDLSLDSTIASNVCVHVQFSNSSLALPSLRSPGGPRVCDCVIGRRDPLDPEGYGGVGVDGEKLRLMDNEKMGIKIEGMKAAIYWPGGTAGGGKSPG

SEQ ID NO: 18784 - DNA, 864 bp, Sorghum bicolor
  misc_feature: Ceres ANNOT ID no. 8705736
  misc_feature: Encodes the peptide sequence at SEQ ID NO 18785
atggggaaggctagagctcatcagctcctagcctccctagcggccatctacctcatcctagccgtcacccagcatgtcaccggcaatctgaccgatgacctggaggtaatgtggggcaacgcaaagttcgtcactgacagcagcggccaacaggccatcgcgctggctcttgatcgctcaactagctctgcgttccgctccaagaagacatgccagttttgcagggtggacatagagatcaagctcgtccctggaaactcagccggcaccgtcaccacattctatatgataaccgagaacccgtggcagttccatgatgaaatcgacatcgagtttttgggcaacagcagtggccagccttatactatgcacactaacatgtatgccagaggacagggtggaagagagaagcagtacaagtttgatttcaatcccactcaagattaccacaagtacaccatcatctggaacaaagattggatcctatttcttgtggatgacaagctgtaccggcagatcaagaacaaccagatatacggtgccccatacccatactactacccaatgagggtgtatgccaccatctggaacgccgatgactgggctacacagggcggccgcgtcaagactgactgggcgcaggcgccattcaccgcgtacttccggaactacagagctatttcatgcgacctataccaggcctcccctctgtgtctcccaggctccggttggttcgaccagcagctggatgtgtcacggaaacagcaactggcgcaggtggaatctagtaacaagatatatgattactgcaatgactccaagaggtacaaaaatggggcccctaaggagtgcggggtaaactag

SEQ ID NO: 18785 - protein, 287 aa, Sorghum bicolor
  misc_feature: Useful for making plants with altered cell wall content and/or composition
  misc_feature: Functional homolog of the protein sequence given in SEQ ID NO 14668
  misc_feature: Ceres ANNOT ID no. 8705736
  misc_feature (22)..(284): SWISSPROT Homolog: EC 2.4.1.207 Xyloglucan:xyloglucosyl transferase
  misc_feature (30)..(214): Pfam ID: Glyco_hydro_16 Pfam Description: Glycosyl hydrolases family 16
  misc_feature (238)..(284): Pfam ID: XET_C Pfam Description: Xyloglucan endo-transglycosylase (XET) C-terminus
MGKARAHQLLASLAAIYLILAVTQHVTGNLTDDLEVMWGNAKFVTDSSGQQAIALALDRSTSSAFRSKKTCQFCRVDIEIKLVPGNSAGTVTTFYMITENPWQFHDEIDIEFLGNSSGQPYTMHTNMYARGQGGREKQYKFDFNPTQDYHKYTIIWNKDWILFLVDDKLYRQIKNNQIYGAPYPYYYPMRVYATIWNADDWATQGGRVKTDWAQAPFTAYFRNYRAISCDLYQASPLCLPGSGWFDQQLDVSRKQQLAQVESSNKIYDYCNDSKRYKNGAPKECGVN

SEQ ID NO: 18786 - DNA, 882 bp, Sorghum bicolor
  misc_feature: Ceres ANNOT ID no. 8705724
  misc_feature: Encodes the peptide sequence at SEQ ID NO 18787
atggtgaagggtaagtcgaccaagggtaggcaaaggattgagatgaagcgcatcaaaggtgaggaggcacggcaggtatgcttctccaagcgccgtccaagcttattcaagaaggctagcgagctttccaccctatgcggtgcagaggttgctgttgtcacgttctcccctggtggcaaatgctggtcatttggccatccctctactttgtctgttgctgaccgcttccttgccgagcatactttgaatggcctcaccattggaagtgagagccatggtactcaagggttgaccggtattagtcatgagatgaatcagcaggttatggagttgcaacaattaatggagaccgagaagaggaggaaggagaagctagtagaggctatggatagggagagtggggggcctgtaatgcaactgttgaatgccaatgttagtgcattagggatacatgagttggagcagttgagaaaggagatttgtatggtacaagacatggtcaaggagaggtcccgcgagatgctgcaagatgccatgcaaacaagaaggctgccaccacaatctcctatgcatatggcagcaatgccctcgcaagttttgtctggtgaccagagggccggaaccatgtataccactgttccaagttcgagcagtggaccgtgtgaagggcttcacgtcagctctctgctccatggttcccatggtggtcttggcaattactctaatgggatcctttggatccagagggttatgggggtgtcggggttgatggagaaattgacgctgatggatattgataagaagggcatcaagatcggaggcataaaggcagcgatccaggggcccggcggaactgcaggcggtggcaaaagtcctggctga

SEQ ID NO: 18787 - protein, 293 aa, Sorghum bicolor
  misc_feature: Useful for making plants with modulated flowering time
  misc_feature: Functional homolog of the protein sequence given in SEQ ID NO 13660
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8705724
  misc_feature (16)..(66): Pfam ID: SRF-TF Pfam Description: SRF-type transcription factor (DNA-binding and dimerisation domain)
MVKGKSTKGRQRIEMKRIKGEEARQVCFSKRRPSLFKKASELSTLCGAEVAVVTFSPGGKCWSFGHPSTLSVADRFLAEHTLNGLTIGSESHGTQGLTGISHEMNQQVMELQQLMETEKRRKEKLVEAMDRESGGPVMQLLNANVSALGIHELEQLRKEICMVQDMVKERSREMLQDAMQTRRLPPQSPMHMAAMPSQVLSGDQRAGTMYTTVPSSSSGPCEGLHVSSLLHGSHGGLGNYSNGILWIQRVMGVSGLMEKLTLMDIDKKGIKIGGIKAAIQGPGGTAGGGKSPG

SEQ ID NO: 18788 - DNA, 876 bp, Sorghum bicolor
  misc_feature: Ceres ANNOT ID no. 8705747
  misc_feature: Encodes the peptide sequence at SEQ ID NO 18789
atgtggcggcagtcatctagggcttactgcatagcctccctagctgctctctgtctcagcctggctatctctccagcaacaagcagcgacatggctgatagcgttgacatgatgtggggcaacacacaggtgctctatgacggcgccggccgccaaatggtgtcactgtccctcgactgctggaccacttctgcgttccgttccaagaacaagtacctctttgggaggttcgacattgacatcaagcttgtccccaaggactcagccggcactgttaccacaatatatctggtgacagaggggccatggaaataccatgacgagattgaccttgagttcctggggaacaccactggtgaaccatacaccctgcacactaacatctatgcaaaagggaaaggtgaccgagagatgcagtatcgtctttggttcgatcctactgaagacttcaacacctactccatcatatggaacccgcatatgatcttaatacttgttaacggcgtaccaatccggcggatgaggaatcagatgagggatgatactcccttcccactgtatcagcctatgaggttgtatgccagcatctgggacgctgacgaatgggcgacccagggcggacgcatcaaaactgactggtcgcatgcgcccttcacagccttcttccggaactacaccgccaacgcttgtgtcccaaacaataaggcctggatctgcggccaggaatctggtgatagcagttggttcaaccaggagttggatgaggaggggcagcaaaaactgaatgatgtcaatgctaaaaacaagatatatgactactgcactgactccaggaggtttcctaatggataccctccagaatgtgggtcacagtag

SEQ ID NO: 18789 - protein, 291 aa, Sorghum bicolor
  misc_feature: Useful for making plants with altered cell wall content and/or composition
  misc_feature: Functional homolog of the protein sequence given in SEQ ID NO 14610
  misc_feature: Useful for making plants with altered carbohydrate content
  misc_feature: Functional homolog of the protein sequence given in SEQ ID NO 14669
  misc_feature: Ceres ANNOT ID no. 8705747
  misc_feature (35)..(288): SWISSPROT Homolog: EC 2.4.1.207 Xyloglucan:xyloglucosyl transferase
  misc_feature (31)..(215): Pfam ID: Glyco_hydro_16 Pfam Description: Glycosyl hydrolases family 16
  misc_feature (230)..(288): Pfam ID: XET_C Pfam Description: Xyloglucan endo-transglycosylase (XET) C-terminus
MWRQSSRAYCIASLAALCLSLAISPATSSDMADSVDMMWGNTQVLYDGAGRQMVSLSLDCWTTSAFRSKNKYLFGRFDIDIKLVPKDSAGTVTTIYLVTEGPWKYHDEIDLEFLGNTTGEPYTLHTNIYAKGKGDREMQYRLWFDPTEDFNTYSIIWNPHMILILVNGVPIRRMRNQMRDDTPFPLYQPMRLYASIWDADEWATQGGRIKTDWSHAPFTAFFRNYTANACVPNNKAWICGQESGDSSWFNQELDEEGQQKLNDVNAKNKIYDYCTDSRRFPNGYPPECGSQ

SEQ ID NO: 18790 - DNA, 111 bp, Sorghum bicolor
  misc_feature: Ceres ANNOT ID no. 8705810
  misc_feature: Encodes the peptide sequence at SEQ ID NO 18791
atgttatacattcttagtgttcttatccatcgtctttgtgatgtgtacatgcacacaacagatgcaaaaattatgtgggatccgctgaatgttatattgaatttagtataa

SEQ ID NO: 18791 - protein, 36 aa, Sorghum bicolor
  misc_feature: The sequence is a functional homolog of SEQ ID NO 1433 in the 10/374,780 US patent application
  misc_feature: The sequence is a functional homolog of SEQ ID NO 1519 in the 10/412,699 US patent application
  misc_feature: Ceres ANNOT ID no. 8705810
MLYILSVLIHRLCDVYMHTTDAKIMWDPLNVILNLV

SEQ ID NO: 18792 - DNA, 627 bp, Sorghum bicolor
  misc_feature: Ceres ANNOT ID no. 8705947
  misc_feature: Encodes the peptide sequence at SEQ ID NO 18793
atgacggaggctgggccggtgctgtccatgtgcctggcgttcgccaaggagcccttcaaggtgaagtccggcgcgtgcggcacggtggtgcgcaacgccgagctcaagatcgtcgaccccgacaccggcaagtccctcgcccggaacctccccggagagatctgcatcaggggccagcagatcatgaaaggttacctgaacaacccggatgcgacgaagaatagcatcgacgctgacggttggctgcacaccggcgacgtcggctttgtggacgacgacgacgagatcttcatcgtcgacaggcttaaggagatcataaagtacaagggtctccaggtggcccctgcagagatagaggccctgctcatcacccacccaagcatcgccgatgccgctgtcgtcgggaaacaagtcgagccggaaatcggagaaatcccggtcgcctttgtggccaaggccaaagggagcgagcttagtgaagatgacgtcaaacaatttgtggccaaggaggtgatctactacaagaaggtccgtgaagtgatcttcattgacaagatccccaaggccccatcgggcaagatattgcgcaaggagctaaggaagcagcttcagcaacaagtggcgtga

SEQ ID NO: 18793 - protein, 208 aa, Sorghum bicolor
  misc_feature: Useful for making plants with altered carbohydrate content
  misc_feature: Functional homolog of the protein sequence given in SEQ ID NO 14004
  misc_feature: Useful for making plants with altered lignin content
  misc_feature: Functional homolog of the protein sequence given in SEQ ID NO 14211
  misc_feature: Useful for making plants with altered cell wall content and/or composition
  misc_feature: Functional homolog of the protein sequence given in SEQ ID NO 13696
  misc_feature: Ceres ANNOT ID no. 8705947
  misc_feature (1)..(194): SWISSPROT Homolog: EC 6.2.1.12 4-coumarate--CoA ligase
MTEAGPVLSMCLAFAKEPFKVKSGACGTVVRNAELKIVDPDTGKSLARNLPGEICIRGQQIMKGYLNNPDATKNSIDADGWLHTGDVGFVDDDDEIFIVDRLKEIIKYKGLQVAPAEIEALLITHPSIADAAVVGKQVEPEIGEIPVAFVAKAKGSELSEDDVKQFVAKEVIYYKKVREVIFIDKIPKAPSGKILRKELRKQLQQQVA

SEQ ID NO: 18794 - DNA, 1320 bp, Sorghum bicolor
  misc_feature: Ceres ANNOT ID no. 8706286
  misc_feature: Encodes the peptide sequence at SEQ ID NO 18795
atgcaggagaaggacgacggcggcaggacgcaacaggagaagtcgatcgatgagtggctcccaatcaactcctccaggaaggccaagtggtggtactccgccttccacaatgtcaccgccatggtcggcgccggcgtgcttggccttccctacgccatgtccgagctcggctggggccctggcatcgtggtgatgatcctgtcatggatcatcacgctgtacacgctatggcagatggtggagatgcacgagatggtgccagggaagcggttcgaccgctaccacgagctcgggcagcacgtgttcggcgagcggctgggcctctggatcgtcgtgccgcagcagctcgccgtggaggtgagcctcaatatcatctacatggtcaccggcggccagtccctcaagaagttccacgacgtcatctgcgacggcaagtgcagcgacttcaagctctcctacttcatcatgatcttcgcctccgtccacttcgtcctctcacagctccccaacttcaactccatctccgccgtctccctcgccgccgccatcatgtcgcttagttactccaccattgcgtggggcgcatcactggacaaggggaagggcacagacgtggactatagtctgcgcgcgacgacgactccagggaaggtgttcgacttcctcgggggcctaggggacgtcgcgttcgcgtattcggggcacaacgtggtgctggagatccaggctaccatcccgtccacgccggagaagccatctaagaagcccatgtggaagggtgccttcgtcgcctacgtcattgtcgcgatctgctacttccccgtcgcattcgttgggtactgggcctttggcagtggtgtcgatgagaacatcctcatgacgctctccaagcctaagtggctcattgccctcgccaacatgtttgtcgtcatccatgtcattggcagttaccaggtttatgccatgccagtgttcgacatgatagagacggtgctggtgaagaaactgcggttcgctccaagcttcactctccgtcttattgcccggagtgtttacgttgcgttcacaatgtttgtaggcatcactttccccttctttggtggattgctcagtttctttggcggattagccttcgcaccaacaacttattttcttccctgcatcatgtggctcaaggtctacaagcccaaacgcttcggcctttcatggttcatcaactggatctgcattgttattggagtgctgctgctggttctgggtccgataggagggatgcggcagattattttgtcagccaagacatacaaattctaccagtaa

SEQ ID NO: 18795 - protein, 439 aa, Sorghum bicolor
  misc_feature: Useful for making plants with altered oil content
  misc_feature: Functional homolog of the protein sequence given in SEQ ID NO 13448
  misc_feature: Ceres ANNOT ID no. 8706286
  misc_feature (26)..(426): Pfam ID: Aa_trans Pfam Description: Transmembrane amino acid transporter protein
MQEKDDGGRTQQEKSIDEWLPINSSRKAKWWYSAFHNVTAMVGAGVLGLPYAMSELGWGPGIVVMILSWIITLYTLWQMVEMHEMVPGKRFDRYHELGQHVFGERLGLWIVVPQQLAVEVSLNIIYMVTGGQSLKKFHDVICDGKCSDFKLSYFIMIFASVHFVLSQLPNFNSISAVSLAAAIMSLSYSTIAWGASLDKGKGTDVDYSLRATTTPGKVFDFLGGLGDVAFAYSGHNVVLEIQATIPSTPEKPSKKPMWKGAFVAYVIVAICYFPVAFVGYWAFGSGVDENILMTLSKPKWLIALANMFVVIHVIGSYQVYAMPVFDMIETVLVKKLRFAPSFTLRLIARSVYVAFTMFVGITFPFFGGLLSFFGGLAFAPTTYFLPCIMWLKVYKPKRFGLSWFINWICIVIGVLLLVLGPIGGMRQIILSAKTYKFYQ

SEQ ID NO: 18796 - DNA, 1050 bp, Sorghum bicolor
  misc_feature: Ceres ANNOT ID no. 8706362
  misc_feature: Encodes the peptide sequence at SEQ ID NO 18797
atggcctatgatggagatgatggacaaagccagaattatctcttcaaaattgttctgcttggggattcctctgttggtaaatcaaacttgctagcaagatttgcaaggaatgagttgtacccaaactctaagtccactataggagtggagttccagacacaaaagttggtaatcgatggaaaggagattaaagctcagatctgggacactgctggacaaaaacgctttcgagcagtaacttctgcttactaccggggagctgtggatattagcaggcgtcagacttttgatagtgttggtcgatggctcaatgaactgcacaaaaacatacaacaacctgatatgatgcaagaggtcgcatcggacggcggcgagatgctggcggtgttcgatcccaaggtagccaagtgcccggagggcctccgcagcccgccggtcgccggagcagccgctgcagcagcacgcgtagccggcgcgggcgcgctgatgaagggcttctccgactcgcacgacggcgccgtcaccgtcagcctgggcccctccggcgcgctggcctactcgacagccaaccagaaccccctcgtcccaaggtgctgtgctctgctccccggcgggtcggcggcgagcaacagccaccggcggacggagggccggatccagaggacggtggcgtggggctcgattccggacgcgacggaaatcagcgccggtctcgattccgtggaggcttgcgtcgccgtcgcagaagaccggagatgggaggcctgcggcagctcgattccgtggagaagaccggagaagggaagcctgcgctgtcgtagaagattggagaaggaacgcaggaacggagatgtaatccctgtggcgagctctagaaggaaagagaaggaacgctggcgaagattgagaaactttctatttctgcaagattgcgcgatgggaggaggtgcctttcgcaggtgtcggaggcagacggaagaacgaaacatttttgcaccaaaaaatgtccacactttgttgtttttagttatagaagataagcgccactag

SEQ ID NO: 18797 - protein, 349 aa, Sorghum bicolor
  misc_feature: Useful for making plants with altered lignin content
  misc_feature: Functional homolog of the protein sequence given in SEQ ID NO 13238
  misc_feature: Useful for making plants with altered terpenoid content
  misc_feature: Functional homolog of the protein sequence given in SEQ ID NO 13157
  misc_feature: Ceres ANNOT ID no. 8706362
  misc_feature (16)..(179): Pfam ID: Ras Pfam Description: Ras family
MAYDGDDGQSQNYLFKIVLLGDSSVGKSNLLARFARNELYPNSKSTIGVEFQTQKLVIDGKEIKAQIWDTAGQKRFRAVTSAYYRGAVDISRRQTFDSVGRWLNELHKNIQQPDMMQEVASDGGEMLAVFDPKVAKCPEGLRSPPVAGAAAAAARVAGAGALMKGFSDSHDGAVTVSLGPSGALAYSTANQNPLVPRCCALLPGGSAASNSHRRTEGRIQRTVAWGSIPDATEISAGLDSVEACVAVAEDRRWEACGSSIPWRRPEKGSLRCRRRLEKERRNGDVIPVASSRRKEKERWRRLRNFLFLQDCAMGGGAFRRCRRQTEERNIFAPKNVHTLLFLVIEDKRH

SEQ ID NO: 18798 - DNA, 876 bp, Sorghum bicolor
  misc_feature: Ceres ANNOT ID no. 8706609
  misc_feature: Encodes the peptide sequence at SEQ ID NO 18799
atggcgcggccggcggcgtggactccgcctgctctgtcgctcgcggtcgccgtcctctgcctcgtcggccggtccacctccgcggagttctggctcgacgagttcaccacggacggcgacgtccgcaaagactacgacggttctggccggcaggtggcgtcgctggtcctcgaccagagttctggcgctggcttcaactccacccgcaagtacctcttcggcgagttcagcgtcgagatgaagctcgtcgccggcaactccgccggcactgtcacctccttctacctgacgtccggcgagggcgacgagcacgacgagatcgacatggagttcatgggcaactccagcgggtcgccgacggtgctcaacaccaacgtgtgggccagcggcgacggcaagaaggagcaccagttctacctgtggttcgacccggccgccgacttccacaagtacaagatcacctggaacgacaagaacatcatcttccaggtggacgacgtgacggtgcgcgtcttcaagcgctacgccgacctgccgtacccgagctccaagcccatggcggtgcacgccacgctgtgggacggcagctactgggccaccgagaagggcaaggtgcccatcgactggtcccgcgcgcccttcgtcgtctcctaccgagcatacacggccaacgcctgcgccgtcggcggcggcggcgggggctcgtcgtcgtcgtgccccgacgccgccggtgggaacgagtggatggacaggcagcccgacgacaccgaccggctcaccgtggagtgggcgcgccggaactgcttgcagtacaactactgcgaggacgggtggcgcttcccgcaggggttccccggcgagtgcgcccgcaactga

SEQ ID NO: 18799 - protein, 291 aa, Sorghum bicolor
  misc_feature: Useful for making plants with altered carbohydrate content
  misc_feature: Functional homolog of the protein sequence given in SEQ ID NO 14607
  misc_feature: Useful for making plants with altered cell wall content and/or composition
  misc_feature: Functional homolog of the protein sequence given in SEQ ID NO 14608
  misc_feature: Ceres ANNOT ID no. 8706609
  misc_feature (46)..(290): SWISSPROT Homolog: EC 2.4.1.207 Xyloglucan:xyloglucosyl transferase
  misc_feature (31)..(211): Pfam ID: Glyco_hydro_16 Pfam Description: Glycosyl hydrolases family 16
  misc_feature (239)..(288): Pfam ID: XET_C Pfam Description: Xyloglucan endo-transglycosylase (XET) C-terminus
MARPAAWTPPALSLAVAVLCLVGRSTSAEFWLDEFTTDGDVRKDYDGSGRQVASLVLDQSSGAGFNSTRKYLFGEFSVEMKLVAGNSAGTVTSFYLTSGEGDEHDEIDMEFMGNSSGSPTVLNTNVWASGDGKKEHQFYLWFDPAADFHKYKITWNDKNIIFQVDDVTVRVFKRYADLPYPSSKPMAVHATLWDGSYWATEKGKVPIDWSRAPFVVSYRAYTANACAVGGGGGGSSSSCPDAAGGNEWMDRQPDDTDRLTVEWARRNCLQYNYCEDGWRFPQGFPGECARN

SEQ ID NO: 18800 - DNA, 96 bp, Sorghum bicolor
  misc_feature: Ceres ANNOT ID no. 8706618
  misc_feature: Encodes the peptide sequence at SEQ ID NO 18801
atgtacaaagtccagtggaatcagtgcaccaaagcggaggttatttgtaaaagagaagaggatctaagaaaaacatacccgcagtggtttgagtaa

SEQ ID NO: 18801 - protein, 31 aa, Sorghum bicolor
  misc_feature: The sequence is a functional homolog of SEQ ID NO 1584 in the 10/374,780 US patent application
  misc_feature: Ceres ANNOT ID no. 8706618
MYKVQWNQCTKAEVICKREEDLRKTYPQWFE

SEQ ID NO: 18802 - DNA, 1119 bp, Sorghum bicolor
  misc_feature: Ceres ANNOT ID no. 8707093
  misc_feature: Encodes the peptide sequence at SEQ ID NO 18803
atggctcactccaccaccttggccctgcacctgctggtcgtcgtcgtgatggcgctcatctttgttgcctcggccagtgtctccgctcccgtcaacaagtcgtgcgtcaccggtagcgccggcgccagtgtgagcattggctacggcggggcaagggccagcgccggcgctggcgtgtcccttggtgccgacgcgtacaggaccacctgcccccgcgccgaggaggtcgtccgtgcggccgttgagtgggccgtcgctgccgacccacgcatggctgcgtctctcctgcgcctccatttccacgactgcttcgtcaacggttgtgatggctccgttcttctggacgacaagccgtttctcgttggcgagaagacggctgtgcccaacgccaactcgctcaggggcttcgaggtcattgacgccatcaaggccgagctggagcgggagtgcccagagacagtctcctgtgccgacctccttgccatcgctgcccgtgattccgtcgtcgtgtcgggcgggccgagctgggaggtagaggtcggccggaaggacagccgcaccgccagcctgcagggtgccaacaccaacctaccagcaccgacgtctggcgtcgccaccctcgtgcagaagttcaggaacgtcggtctttctgccaaggacatggtcgcactctccggcgcgcacacgatcgggaaagcgcggtgcacttcgttcagtgcgcgccttgcgggcgtcggcggcgtctcggaaggcggcgtcggcgcattcaaggacctaaccttcctgcagtcgctgcagcagctgtgcacggggtcggctggatcggcgctggcgcacctggacctcaccaccccagcgaccttcgacaaccagtactacatcaacctgctctccggcgacggcctgctgccgtcagaccaggcactagcgtcgtcgtcgggtgtcgcgccgggggttgaggcggacgtcgccagcctcgtcgccatctatgccttcgacgcctctgtattcttccaggacttcgcagagtccatgctgcggatggggaggcttgcaccaggcgcgggcaccagtggcgaggtccgccggaactgccgggtggtgaacatctccggctag

SEQ ID NO: 18803 - protein, 372 aa, Sorghum bicolor
  misc_feature: Useful for making plants with altered cell wall content and/or composition
  misc_feature: Functional homolog of the protein sequence given in SEQ ID NO 14670
  misc_feature: Useful for making plants with altered carbohydrate content
  misc_feature: Functional homolog of the protein sequence given in SEQ ID NO 14159
  misc_feature: Useful for making plants with modulated oxidative stress sensitivity
  misc_feature: Functional homolog of the protein sequence given in SEQ ID NO 13607
  misc_feature: Ceres ANNOT ID no. 8707093
  misc_feature (66)..(369): SWISSPROT Homolog: EC 1.11.1.7 Peroxidase
  misc_feature (77)..(325): Pfam ID: peroxidase Pfam Description: Peroxidase
MAHSTTLALHLLVVVVMALIFVASASVSAPVNKSCVTGSAGASVSIGYGGARASAGAGVSLGADAYRTTCPRAEEVVRAAVEWAVAADPRMAASLLRLHFHDCFVNGCDGSVLLDDKPFLVGEKTAVPNANSLRGFEVIDAIKAELERECPETVSCADLLAIAARDSVVVSGGPSWEVEVGRKDSRTASLQGANTNLPAPTSGVATLVQKFRNVGLSAKDMVALSGAHTIGKARCTSFSARLAGVGGVSEGGVGAFKDLTFLQSLQQLCTGSAGSALAHLDLTTPATFDNQYYINLLSGDGLLPSDQALASSSGVAPGVEADVASLVAIYAFDASVFFQDFAESMLRMGRLAPGAGTSGEVRRNCRVVNISG

SEQ ID NO: 18804 - DNA, 201 bp, Sorghum bicolor
  misc_feature: Ceres ANNOT ID no. 8708379
  misc_feature: Encodes the peptide sequence at SEQ ID NO 18805
atgatgcacacacaggagtggttacagaatgcgcgcctgagggcgctccccggcgtggcggagaggctggcgctgtgcaaggccgacctactcgactacgacgcgctgcggttgaccgttgtcggctgccacggcgtcttccacaacgcattgcctggatccgatccggtatgtatacgtgtaacctatagtagtacttga

SEQ ID NO: 18805 - protein, 66 aa, Sorghum bicolor
  misc_feature: Useful for making plants with altered carbohydrate content
  misc_feature: Functional homolog of the protein sequence given in SEQ ID NO 14118
  misc_feature: Useful for making plants with altered cell wall content and/or composition
  misc_feature: Useful for making plants with altered lignin content
  misc_feature: Functional homolog of the protein sequence given in SEQ ID NO 13818
  misc_feature: Ceres ANNOT ID no. 8708379
  misc_feature (13)..(52): SWISSPROT Homolog: EC 1.1.1.219 Dihydrokaempferol 4-reductase
MMHTQEWLQNARLRALPGVAERLALCKADLLDYDALRLTVVGCHGVFHNALPGSDPVCIRVTYSST

SEQ ID NO: 18806 - DNA, 96 bp, Sorghum bicolor
  misc_feature: Ceres ANNOT ID no. 8711313
  misc_feature: Encodes the peptide sequence at SEQ ID NO 18807
atgtacaaagtccagtggaatcagtgcaccgaagaggaggctatttgtaatagagaagaggatctaagaaaagcatacacgctttggtttgagtaa

SEQ ID NO: 18807 - protein, 31 aa, Sorghum bicolor
  misc_feature: The sequence is a functional homolog of SEQ ID NO 1584 in the 10/374,780 US patent application
  misc_feature: The sequence is a functional homolog of SEQ ID NO 1586 in the 10/374,780 US patent application
  misc_feature: The sequence is a functional homolog of SEQ ID NO 1585 in the 10/374,780 US patent application
  misc_feature: Ceres ANNOT ID no. 8711313
MYKVQWNQCTEEEAICNREEDLRKAYTLWFE

SEQ ID NO: 18808 - DNA, 1494 bp, Sorghum bicolor
  misc_feature: Ceres ANNOT ID no. 8712016
  misc_feature: Encodes the peptide sequence at SEQ ID NO 18809
atgaaaacgaagaaaaggaaaacgcttgagccccggaaccttccttccctccagtcgctgctcctcttccacgtcctccccgcccgcctccacgccgcctccttcctctcccgacgccaccaccccacgctcgccggcgagccgctggagctcgggcccgccgtgtcccgcgccgtgacgcggcccgacgcggtagtgcgcgcggacggcgtcatccacggcgtggaccgcctcctggtcccgcgctccgtccaggacgccttcaaccgccgccgcagcctcgcgtcgtccatctccgtcgcgctccccacgggcgcccccgaggtggacccgcgcacgcaccgcctcctcaaaaaacccgccccgccgctgggtgccccgccggcgctccctgtctgggacgcgatggcacccggcccatccatcgcgccggcgccggcgccgggtccaggcaccgggacgcaccgcttcgacgggcacgggcaggtgaaggacttcatccagaccctcctcctctacggcgggtacaacgagctggccgacatcctcgtgaacctcacctcgctcgccaccgagatgggccgcctcgtctccgagggctacgtcctcaccgtgctggcccccaacgacgaggccatggcgcggctcaccacggaccagctcagcgagccggggtcgccggagtccacgatggcgccgccggaccccgcggcgttggccgcgaacgcccgcgccgggagccgcaccgccttcccgcccactgtcacgcccgacagcgccaggggcacgtactgcatgggcacggaccacgaggtagctggcgctgaccatgaggacccccgacacgagcgtccagaggcagggccccatgccgtagcggacgtgcgcgagcttgagctccgcgatggagatggagagctggcccacgtcggtgccgacgagcttgagctcggcgatgtagcgcggggatcaatggcaccggtggtagtagagctgatgacgacgacggccagggacctgcagctcgctgatgacacggctgctgctactcaccagcaagcacgcgtgcaccaggtgggagacgacgacgaggaaggcatcaagctggccatggcggcggcgccagcggccgaggcgttcgcggtgcaggagccaccggcgaacgaggaggccttggcggagcggcaggcggaggtggcccggctcctggccgggttccggcggcacctcgaggaccggtccgcgcaccacctggggtacccgtacaacctggacttcgacttcgcctcgctggcgccgttcctgcagggcctctgcatcaacaacctcggcgaccccttcgtggagagcaactacggcgtgcactcccggccgctggaggtggcggtgctcgactggttcgcccgcctctgggacctcgtccccggcgactactggggctacgtcaccagctgcggcaccgaggaagtccgtgagatggcacagaagaagtaa

SEQ ID NO: 18809 - protein, 497 aa, Sorghum bicolor
  misc_feature: Useful for making plants with altered cell wall content and/or composition
  misc_feature: Functional homolog of the protein sequence given in SEQ ID NO 14044
  misc_feature: Ceres ANNOT ID no. 8712016
  misc_feature (398)..(488): SWISSPROT Homolog: EC 4.1.1.22 Histidine decarboxylase
MKTKKRKTLEPRNLPSLQSLLLFHVLPARLHAASFLSRRHHPTLAGEPLELGPAVSRAVTRPDAVVRADGVIHGVDRLLVPRSVQDAFNRRRSLASSISVALPTGAPEVDPRTHRLLKKPAPPLGAPPALPVWDAMAPGPSIAPAPAPGPGTGTHRFDGHGQVKDFIQTLLLYGGYNELADILVNLTSLATEMGRLVSEGYVLTVLAPNDEAMARLTTDQLSEPGSPESTMAPPDPAALAANARAGSRTAFPPTVTPDSARGTYCMGTDHEVAGADHEDPRHERPEAGPHAVADVRELELRDGDGELAHVGADELELGDVARGSMAPVVVELMTTTARDLQLADDTAAATHQQARVHQVGDDDEEGIKLAMAAAPAAEAFAVQEPPANEEALAERQAEVARLLAGFRRHLEDRSAHHLGYPYNLDFDFASLAPFLQGLCINNLGDPFVESNYGVHSRPLEVAVLDWFARLWDLVPGDYWGYVTSCGTEEVREMAQKK

SEQ ID NO: 18810 - DNA, 1527 bp, Sorghum bicolor
  misc_feature: Ceres ANNOT ID no. 8712273
  misc_feature: Encodes the peptide sequence at SEQ ID NO 18811
atggcggtgaaggtgtgggtgttcgtcgtggcactgatgttcatcggtgtagtagtagtagtagggcttggagctgacgacggcagcagtagggatggcgccggcagccttagccgctgtcgtctgagctcgcccaactaccatggcgctctggcaaaggccatcctgttcttcgaggggcagcggtcggggcggctgccggcgaaccagagggtcaagtggcgcggggactcggcgctcaccgacggccaacccgaaaacgtgaacttgacgggcgggtactacgacgccggagacaacgtgaagttcggtttcccgatggcgttcagcgtcaccctcctgagctggagcgccgtcgagtatcgcgacgaggtggcggcggcgggccagctccggtacctccggtccgccatccagtggggcgccgacttcctcctccgtgcacacacctcgccgaccaccctctacactcaggtcggcgacggcaacgccgaccaccagtgctgggagcggccagaggacatggacacgccgaggacgctgtacaagatcacccagagctcgccggggtccgaggccgccggcgaggcagccgcggcgctcgccgccgcatacctggtgttcagggacgaccgggacaagtccttggccacgcagctcctggccgcctccagatccctcttcgacttcgccaacaattacagaggatcctaccagttgtcctgcccattctactgctcctactcaggctaccaggacgagctccagtgggcgtcggcatggctgtaccgggcaaccaaggacagcaaatacctcgacttcctgcagaacaaccagggcggcagcggaaccgagttcagctgggacaacaagtatcccggagctcagctgcttgcaacacaggagtacttgggtggaaggacagagctggagggctacaagaggggcctggactctttcgtctgcgctgtcatgcccaacagcggcaacacgcagatccacaccacccctggagggcttctctttacccgcgattcagtcaatctgcagtacacaaccactgcagccctgctgctgtcaatctactcaaagaccctgacttctgtaggcgaccaagtagtccagtgcagcgccgcaagtttctctccagatcagatcagttcattcgcaacgtggattacatcctgggagacaatccaaagggcatgtcgtacatggtgggcttcagctccaagttcccaaggcggattcaccaccgcggctcctccatcccgtccatcaaggttctccccaggaaggtcacctgcaacgagggcttctcgtcatggttcccgaccagcaacgccaaccctaacaaccatgtcggcgccatcgtcggcggacctgacgggaacgaccagttcagtgacaacagggaggactccacgcactccgagccagcaacgtacatcaacgccgcatttgtgggtgcctgcgctgctgccctcgggcagcagaaccagctcaaggagcctgtggacaacatag

SEQ ID NO: 18811 - protein, 508 aa, Sorghum bicolor
  misc_feature: Useful for making plants with altered cell wall content and/or composition
  misc_feature: Functional homolog of the protein sequence given in SEQ ID NO 14671
  misc_feature: Ceres ANNOT ID no. 8712273
  misc_feature (41)..(391): SWISSPROT Homolog: EC 3.2.1.4 Cellulase
  misc_feature (46)..(456): Pfam ID: Glyco_hydro_9 Pfam Description: Glycosyl hydrolase family 9
MAVKVWVFVVALMFIGVVVVVGLGADDGSSRDGAGSLSRCRLSSPNYHGALAKAILFFEGQRSGRLPANQRVKWRGDSALTDGQPENVNLTGGYYDAGDNVKFGFPMAFSVTLLSWSAVEYRDEVAAAGQLRYLRSAIQWGADFLLRAHTSPTTLYTQVGDGNADHQCWERPEDMDTPRTLYKITQSSPGSEAAGEAAAALAAAYLVFRDDRDKSLATQLLAASRSLFDFANNYRGSYQLSCPFYCSYSGYQDELQWASAWLYRATKDSKYLDFLQNNQGGSGTEFSWDNKYPGAQLLATQEYLGGRTELEGYKRGLDSFVCAVMPNSGNTQIHTTPGGLLFTRDSVNLQYTTTAALLLSIYSKTLTSVGDQVVQCSAASFSPDQISSFATWITSWETIQRACRTWWASAPSSQGGFTTAAPPSRPSRFSPGRSPATRASRHGSRPATPTLTTMSAPSSADLTGTTSSVTTGRTPRTPSQQRTSTPHLWVPALLPSGSRTSSRSLWTT

SEQ ID NO: 18812 - DNA, 342 bp, Sorghum bicolor
  misc_feature: Ceres ANNOT ID no. 8712279
  misc_feature: Encodes the peptide sequence at SEQ ID NO 18813
atgacgatccggttcgtgctgttcgtgaacaagcagggccagacgcggctgtgttcgttcgtggagcaccggaactacaaggtcgtgtacaggcgctacgcctcccttttcttcctcgtcggcgtcgacaatgatgagaatgagttagctatccttgaattcatacatcttttggtggaaactatggatcgtcactttggcaatgtgtgcgagcttgatatcatgttccatctagagaaagtgcacttcatgttggaagagatggtgatgaacggttgcattgtagagacaagtaaacagaacatcttggcaccaatacaacttatggagaaaacttcctaa

SEQ ID NO: 18813 - protein, 113 aa, Sorghum bicolor
  misc_feature: Useful for making plants with modulated oxidative stress sensitivity
  misc_feature: Functional homolog of the protein sequence given in SEQ ID NO 14672
  misc_feature: Ceres ANNOT ID no. 8712279
  misc_feature (2)..(113): Pfam ID: Clat_adaptor_s Pfam Description: Clathrin adaptor complex small chain
MTIRFVLFVNKQGQTRLCSFVEHRNYKVVYRRYASLFFLVGVDNDENELAILEFIHLLVETMDRHFGNVCELDIMFHLEKVHFMLEEMVMNGCIVETSKQNILAPIQLMEKTS

SEQ ID NO: 18814 - DNA, 93 bp, Sorghum bicolor
  misc_feature: Ceres ANNOT ID no. 8712306
  misc_feature: Encodes the peptide sequence at SEQ ID NO 18815
atgggatcaggtggatacgagaccattcccaagtggcaaaaaatggaagcagacattattgccaaggggatcaaaccaaaatcagccaagtga

SEQ ID NO: 18815 - protein, 30 aa, Sorghum bicolor
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: Ceres ANNOT ID no. 8712306
MGSGGYETIPKWQKMEADIIAKGIKPKSAK

SEQ ID NO: 18816 - DNA, 1131 bp, Sorghum bicolor
  misc_feature: Ceres ANNOT ID no. 8712596
  misc_feature: Encodes the peptide sequence at SEQ ID NO 18817
atgacgaagcagggcgtggtggtgccggtgccggaggcggccgtggcggtgccgcccaacacggcgccgctgttccagtacccgccgccgcgggccgcgccgggcatcgccgtgcgcaagaagtacctgcagatgggcgccgccgccggtgccggcgccggggcgcgcatcggcggcggcggctgggtggagtccatgcgcgcgtcctcgcccacgcacgccagggcggccgccgcgctcgccgcgggcgtcgacgaggagcgctacgccgagtggatggtgaagcacccgtcggcgctgggcatgttcgaccaggtggtggcggcgtccaaggggaagcagatcgtcgtgttcctcgactacgacggcacgctgtcccccatcgtcgacgaccccgacgccgcctacatgtcggacacgatgcggcgggcggtgcggagcgtcgccaagcacttcccgacggcgatcgtgagcgggcggtgccgcgacaaggtgttcgagttcgtgaagctggctgagctgtactacgccggcagccacggcatggacatcaagggccccgcgaaagggtcccggcacaccaaggccgccaaggccaaaggcgttctctttcagccggccagccagttcctgcccatgatagagcaggtgcacgattctctggtggaaaagaccaagtgcatacctggagccaaggtggagaacaacaagttttgtgtgtctgtccacttcagatgcgtcgatgagaagagctggagcacattggctgacctggtgaagtcggtgctgacggactacccgaagctgaagctgacgcaggggcggatggtgttcgaggtccgccccaccatcaagtgggacaagggcaaggccctggagttcctcctcgagtccctgggcttcgccgactgcaccgacgtgctccccgtctacatcggcgacgaccgcaccgacgaggacgccttcaaggtgctccgcaagcgcggccagggcgtgggcatcctcgtctccaagcaccccaaggacacctccgcctcctactcgctgcaggagcccgccgaggtgatggagttcctgctgcggcttgtcgagtgggagcgcctctccaaggcccgccccgccaagtggtga

SEQ ID NO: 18817 - protein, 376 aa, Sorghum bicolor
  misc_feature: Useful for making plants with modulated flowering time
  misc_feature: Useful for making plants with modulated low light sensitivity
  misc_feature: Functional homolog of the protein sequence given in SEQ ID NO 13725
  misc_feature: Useful for making plants with modulated drought sensitivity
  misc_feature: Functional homolog of the protein sequence given in SEQ ID NO 13424
  misc_feature: The sequence is a functional homolog of SEQ ID NO 16 in US patent 7214858
  misc_feature: Useful for making plants with modulated water use efficiency
  misc_feature: Functional homolog of the protein sequence given in SEQ ID NO 13348
  misc_feature: Ceres ANNOT ID no. 8712596
  misc_feature (118)..(359): SWISSPROT Homolog: EC 3.1.3.12 Trehalose-phosphatase
  misc_feature (118)..(353): Pfam ID: Trehalose_PPase Pfam Description: Trehalose-phosphatase
MTKQGVVVPVPEAAVAVPPNTAPLFQYPPPRAAPGIAVRKKYLQMGAAAGAGAGARIGGGGWVESMRASSPTHARAAAALAAGVDEERYAEWMVKHPSALGMFDQVVAASKGKQIVVFLDYDGTLSPIVDDPDAAYMSDTMRRAVRSVAKHFPTAIVSGRCRDKVFEFVKLAELYYAGSHGMDIKGPAKGSRHTKAAKAKGVLFQPASQFLPMIEQVHDSLVEKTKCIPGAKVENNKFCVSVHFRCVDEKSWSTLADLVKSVLTDYPKLKLTQGRMVFEVRPTIKWDKGKALEFLLESLGFADCTDVLPVYIGDDRTDEDAFKVLRKRGQGVGILVSKHPKDTSASYSLQEPAEVMEFLLRLVEWERLSKARPAKW

SEQ ID NO: 18818 - DNA, 828 bp, Sorghum bicolor
  misc_feature: Ceres ANNOT ID no. 8712715
  misc_feature: Encodes the peptide sequence at SEQ ID NO 18819
atggatccgagcgcggtcagtttcgactccggcggcgcgcggcggggcggcggcggcggcggcgcgcagatgctgctcttcggcggcggaggcagcgccaacagcaacggcttcttccgaggtgttccgatggcggtcctgggcatggacgacgcgacgcgcgtgggcaagcggcctttcttcaccacgcacgaggagctcctggaggaggagtactacgacgagcaggcgcccgagaagaagcgccgtctgacggcggagcaggtgcagctgctggagcggagcttcgaggaagagaacaagctggagccggagcgcaagaccgagctggctcgccgcctcgggatggcgcctcgccaggtggccgtctggttccagaaccgccgcgcgcgctggaagactaagcagctcgagaccgactatgaccgcctcaaggctgcctacgacgcgctcgccgccgaccaccagggcctcctggccgacaacgatagcctccgggcacaggtgatctccctaacggataagctgcaacgcaaggagacatccccgtcggcgaccactgctgcccaagaggtcgaccagccagacgaacacaccgctgcgtcaggcactgagaaactgctggtgcagcagctcaaggacgacctccacagcagcggcgacttcactggccatggtgccctctcttcagaggaagaggatggtggtgtggtcagcgacgagggctgcagctttgatctcccggatgccatgttcgctgccggggtcacccaccatggcgccgaggaggcgcagctggccaactggacatcctggttctggaactga

SEQ ID NO: 18819 - protein, 275 aa, Sorghum bicolor
  misc_feature: The sequence is a functional homolog of SEQ ID NO 218 in the 10/225,068 US patent application
  misc_feature: The sequence is a functional homolog of SEQ ID NO 262 in the 10/412,699 US patent application
  misc_feature: The sequence is a functional homolog of SEQ ID NO 574 in the 11/479,226 US patent application
  misc_feature: The sequence is a functional homolog of SEQ ID NO 74 in the 10/374,780 US patent application
  misc_feature: The sequence is a functional homolog of SEQ ID NO 1075 in the 11/479,226 US patent application
  misc_feature: The sequence is a functional homolog of SEQ ID NO 470 in the 10/412,699 US patent application
  misc_feature: Useful for making plants with modulated flowering time
  misc_feature: Ceres ANNOT ID no. 8712715
  misc_feature (80)..(134): Pfam ID: Homeobox Pfam Description: Homeobox domain
  misc_feature (135)..(179): Pfam ID: HALZ Pfam Description: Homeobox associated leucine zipper
MDPSAVSFDSGGARRGGGGGGAQMLLFGGGGSANSNGFFRGVPMAVLGMDDATRVGKRPFFTTHEELLEEEYYDEQAPEKKRRLTAEQVQLLERSFEEENKLEPERKTELARRLGMAPRQVAVWFQNRRARWKTKQLETDYDRLKAAYDALAADHQGLLADNDSLRAQVISLTDKLQRKETSPSATTAAQEVDQPDEHTAASGTEKLLVQQLKDDLHSSGDFTGHGALSSEEEDGGVVSDEGCSFDLPDAMFAAGVTHHGAEEAQLANWTSWFWN

SEQ ID NO: 18820 - DNA, 792 bp, Sorghum bicolor
  misc_feature: Ceres ANNOT ID no. 8712746
  misc_feature: Encodes the peptide sequence at SEQ ID NO 18821
atgcaggccgccgccgccttcaaccgggcagccttcaccgcccgcccgctgcatcgccccacgaggcccctcctccacctagctggggcggaggatgctttggcgggaagaagaggcaagcccctgacacgtccctggtgctccgggagcctctccgtcggcgtcggcagctacggcagcgagcacactccagtatttccaaggcaacaagcatgggatccctacaagcttcttggtgttgatcatgatgcatctcaagaagaggtccggagtgcacggaattttcttctaaaacaatacgctggatatgaagaaagtgaagaggccattgaaggtgcttatgacaaaataataatgaatagctactcacaccgtaagaaatccaaaatcaatctgaaaagcaagctaaaaaagcaagttgaagaatccccatcatggcttaaggcactgcttggatacttcgaggtgccatcactagagatcacttcaaggagattagctttttttgcattctttgctgggtggagcattgcaacttctgctgagactgggcctgcctttcagcttgcactatcactcgtctcatgcatatacttcctcaatgagaagatgaagaatcttgtcagggcgtccaccacagggctcggagtatttgtcggtggctggatcttaggttcttttcttgttccagtgatcccagctttcatcatcccgcctacatggtcccttgagctccttacttcgctgacggcctatgttttcatgttcttgggttgcactttcctcaagtga

SEQ ID NO: 18821 - protein, 263 aa, Sorghum bicolor
  misc_feature: Useful for making plants with altered protein content
  misc_feature: Functional homolog of the protein sequence given in SEQ ID NO 13478
  misc_feature: Ceres ANNOT ID no. 8712746
MQAAAAFNRAAFTARPLHRPTRPLLHLAGAEDALAGRRGKPLTRPWCSGSLSVGVGSYGSEHTPVFPRQQAWDPYKLLGVDHDASQEEVRSARNFLLKQYAGYEESEEAIEGAYDKIIMNSYSHRKKSKINLKSKLKKQVEESPSWLKALLGYFEVPSLEITSRRLAFFAFFAGWSIATSAETGPAFQLALSLVSCIYFLNEKMKNLVRASTTGLGVFVGGWILGSFLVPVIPAFIIPPTWSLELLTSLTAYVFMFLGCTFLK

SEQ ID NO: 18822 - DNA, 2301 bp, Sorghum bicolor
  misc_feature: Ceres ANNOT ID no. 8712871
  misc_feature: Encodes the peptide sequence at SEQ ID NO 18823
atggcgccggacgcgaagaagcctgccgagtttacaaggaagaagcgggctaggcacgcggcgccgccggatctcgcctcgtcgtctgcgagggtgacgacgcgcggcatggccgggaccgggaggatggccgccgcgaagcttcgtcagcacgccgacggggaggaggttgttgtcgacgatgtcgacggtagttccgcctccgtcgacgggccaccaccggagctccaccggcgggctgacgtcgtcgcgaaggtgatgctcgtcgccggcgcatcagaggggaacgccgccgccgcgtcgtcgccggagtcggtgacagacaaagtggctaatgagagcaagaacgagagctactacttgcttcattacctgctgccgtgcctagcggagctcaacaaagagcagcaagccgagaaggaggtagaggccaacataaaaggggtttcattgtccaagctgagcgtaccgccggcagcctataacaaaaaggagagggtgacctgcgacaactgcgacacgtcgatctacgacctccacagggcctgcccacgctgcgactacgagctctgcatcacctgctgcagggagctccgtgaaggaaacctacgaggttcctgcttgaaaaccaaggacaacgagtatcccaacctcggcgcagactacctgcacggcggcgacgctgcggctgcagcactgccagatccaagcccgtcgtcaggcgacccatcagacgacgaggtgatcacatctatgatcggagcttgggtggccgatacccacgagctcgccgacggccgcatccggtgtcctccggaagagcttggcggctgtggcggccgccgcacgctcaggctcaagaggatgtttccggagaactggctcgccgaccttgaagccgatgcctctgctgcattgccgaccaagtttaagattgctgatgagagtgtgtgctcatgctattactctggtgatccagcaacccagagcacaacaaaggtagcatcagctagggaaaactcgcaggataatcgcttgtactacctggtgtcggacggcagcgaggaggatgatgtgaagcatttccagaagcactgggtgagaggagaagccgtggtggctcggggtgtgctccggaaaatgtcaggcttgagctgggagccaccagagttgtggtctgcattaaagttaaacggcgatcacaggcggcgttcagagttcaggaatattaaggccatagattgccttgctctctgtgaggttaaactacacaaaaatgatttcttcagagggtattacaaaggcatgaggcttcccaatcagtggccacaaatgctaaagctaaatgattggcctccttcagcagattttgaagatcttttacctgtgcatggagacaagtatataaacgcattgccttttcagccttacacaaatgcaaaatctggcttcttcaatatctctactttgcttcctgatggggtcataaaggttgatcttggacccaaatcatatatagcttatggcttcccacaagagcttggcagaggggattccgtcacaaagcttcactgcgacttaactgatgctgtcaatgttcttgtgcacaccacaaaggtccccccttctaataaggaacaagagaatgcagttgcggagctcaaaagaaaacatagggcacaaagtcggaaggaattggcaaatggcgatggtagtgacggtgacgcacaagataataagcaatcacctaactatatggaggatgaggaaggtgctctttgggacatatttagaagagaagatgtcccaaaattaaaagaatatctcattaagcactccaaggagttccgccatacacattgctcccaagtgtataatccgatgcatgatggaacattttatttgacaagagagcacataaagaagctcaaagaggaattcggagtagagccgtggaccctactacaaaagcttggggaagctgttttcatacctgctggttgccctcatcaagtccgcaatcttcagtcctgcatgaagattgctctagactttgtttcaccagagaatgttagagaatgtctgcgcttgactgaagacttccgcatgctacctaaaggacatagggcaaagaaagatatattagagattgatttatcggataaagggccgggggtgaaacaactatgctatgagttcaggaatttaatacagccaagttacatttgctgtcacttcactatatggcgactttttgatcaccaggggtccttggaactcttgctccatcgcctgctataa

SEQ ID NO: 18823 - protein, 766 aa, Sorghum bicolor
  misc_feature: The sequence is a functional homolog of SEQ ID NO 1432 in the 10/666,642 US patent application
  misc_feature: The sequence is a functional homolog of SEQ ID NO 1596 in the 11/479,226 US patent application
  misc_feature: Ceres ANNOT ID no. 8712871
  misc_feature (572)..(685): Pfam ID: JmjC Pfam Description: JmjC domain
MAPDAKKPAEFTRKKRARHAAPPDLASSSARVTTRGMAGTGRMAAAKLRQHADGEEVVVDDVDGSSASVDGPPPELHRRADVVAKVMLVAGASEGNAAAASSPESVTDKVANESKNESYYLLHYLLPCLAELNKEQQAEKEVEANIKGVSLSKLSVPPAAYNKKERVTCDNCDTSIYDLHRACPRCDYELCITCCRELREGNLRGSCLKTKDNEYPNLGADYLHGGDAAAAALPDPSPSSGDPSDDEVITSMIGAWVADTHELADGRIRCPPEELGGCGGRRTLRLKRMFPENWLADLEADASAALPTKFKIADESVCSCYYSGDPATQSTTKVASARENSQDNRLYYLVSDGSEEDDVKHFQKHWVRGEAVVARGVLRKMSGLSWEPPELWSALKLNGDHRRRSEFRNIKAIDCLALCEVKLHKNDFFRGYYKGMRLPNQWPQMLKLNDWPPSADFEDLLPVHGDKYINALPFQPYTNAKSGFFNISTLLPDGVIKVDLGPKSYIAYGFPQELGRGDSVTKLHCDLTDAVNVLVHTTKVPPSNKEQENAVAELKRKHRAQSRKELANGDGSDGDAQDNKQSPNYMEDEEGALWDIFRREDVPKLKEYLIKHSKEFRHTHCSQVYNPMHDGTFYLTREHIKKLKEEFGVEPWTLLQKLGEAVFIPAGCPHQVRNLQSCMKIALDFVSPENVRECLRLTEDFRMLPKGHRAKKDILEIDLSDKGPGVKQLCYEFRNLIQPSYICCHFTIWRLFDHQGSLELLLHRLL

SEQ ID NO: 18824 - DNA, 1494 bp, Sorghum bicolor
  misc_feature: Ceres ANNOT ID no. 8713073
  misc_feature: Encodes the peptide sequence at SEQ ID NO 18825
atggggtcgctgccgacggaggagcgggagaggcgccagcagcagccgccgcacgtggtgatggtcccgtacccggcgcagggccatgtcacgccgatgctgcagctggccaagctactccacacgcgcggcttccacgtcaccttcgtcaacaacgagttcaaccaccgccgccacctgcgcgcgcgcgggcctggagcgctcgacggcgcgccggggttccgcttcgtcgccatcgacgacggccttccacgctccgacgccgacgccacgcaggacgtccccgcgctctgctactccaccatgaccacctgcctgccccggtttaaggacctcgtcgcccggaccaatgccgaggccgaggcccagggacggcccgccgtgacgtgcgtcgtcgccgacagcgtcatgaccttcgctctccgcggcgcgcgggagctcggcctccgctgcgccacgctctggaccgccagcgcctgcggcttcatcggctactactactaccgccacctcgtggagcggggcatcgtcccgctccagaacgaggcgcagctcaccgacgggtacctggacgacaccgtcgtcgactggatccccgacggcgcggcgcccaaggacctgcggctccgggacttcccgagcttcgtacgcaccacggacccggacgacatcatgctcaactacttcatccacgaggtggccgggatgtcgcaggcgtcggcggtggtcatcaacaccttcgacgagctcgacgcgacaccgctccacgccatggcgaagctcctgtcgcggccggtctacaccgtcggcccgctcccgctgacggtgcgaaacaacgtccccgcggacagccccgtcgcggccatcgcgtccaacctgtggaaggaggaggacgcgccgctccggtggctccacggccgcgcgccgcgctcggtcgtgtacgttaacttcgggagcatcacggtgatgtccaacgagcagctggccgagttcgcgtgggggctggccaacaccggctacgccttcctgtggaacgtgcgtccggacctcgtcaagggcggcggcggcggcggcgggctgccgtcggagttcgcggccgcgacggagggccggagcatgctgtcgacgtggtgcccgcaggcggcggtgctggagcacgatgccgtgggggtgttcttgacgcactccgggtggaactccacgctggagagcatctgcggcggcgtgcccatggtgtgctggcccttcttcgccgagcagcagaccaactgccggtacaagcgcaccgagtggggcatcgggatggagatcggcagcgacgtccggcggggcgaggtggaggcgctcatacgggaggccatggagggggagaaagggcgggagatgcgccggcgagtgacggagctcaaggaaagcgccgtggccgcggcgaggcccgacggacgatccatgcgcaacgtggacaggctcatcgacgaggtgctcctagcctga

SEQ ID NO: 18825 - protein, 497 aa, Sorghum bicolor
  misc_feature: Useful for making plants with altered carbohydrate content
  misc_feature: Functional homolog of the protein sequence given in SEQ ID NO 14338
  misc_feature: Ceres ANNOT ID no. 8713073
  misc_feature (207)..(494): SWISSPROT Homolog: EC 2.4.1.210 Limonoid glucosyltransferase
  misc_feature (18)..(494): Pfam ID: UDPGT Pfam Description: UDP-glucoronosyl and UDP-glucosyl transferase
MGSLPTEERERRQQQPPHVVMVPYPAQGHVTPMLQLAKLLHTRGFHVTFVNNEFNHRRHLRARGPGALDGAPGFRFVAIDDGLPRSDADATQDVPALCYSTMTTCLPRFKDLVARTNAEAEAQGRPAVTCVVADSVMTFALRGARELGLRCATLWTASACGFIGYYYYRHLVERGIVPLQNEAQLTDGYLDDTVVDWIPDGAAPKDLRLRDFPSFVRTTDPDDIMLNYFIHEVAGMSQASAVVINTFDELDATPLHAMAKLLSRPVYTVGPLPLTVRNNVPADSPVAAIASNLWKEEDAPLRWLHGRAPRSVVYVNFGSITVMSNEQLAEFAWGLANTGYAFLWNVRPDLVKGGGGGGGLPSEFAAATEGRSMLSTWCPQAAVLEHDAVGVFLTHSGWNSTLESICGGVPMVCWPFFAEQQTNCRYKRTEWGIGMEIGSDVRRGEVEALIREAMEGEKGREMRRRVTELKESAVAAARPDGRSMRNVDRLIDEVLLA

SEQ ID NO: 18826 - DNA, 213 bp, Sorghum bicolor
  misc_feature: Ceres ANNOT ID no. 8713084
  misc_feature: Encodes the peptide sequence at SEQ ID NO 18827
atggggagagggaagatagagatcaagaggatcgacaacgcgacgagcaggcaggtgacgttctcgaagcgccggagcgggctgttcaagaaggccaaagagctcgccatcctttgcgatgccgaggtcggcctcgtcgtcttctccagcaccggtcgcctgtatgacttcgctagcaccagtattttattcttaacatatatagaatgctga

SEQ ID NO: 18827 - protein, 70 aa, Sorghum bicolor
  misc_feature: The sequence is a functional homolog of SEQ ID NO 2195 in the 10/666,642 US patent application
  misc_feature: The sequence is a functional homolog of SEQ ID NO 1701 in the 10/412,699 US patent application
  misc_feature: The sequence is a functional homolog of SEQ ID NO 2197 in the 10/666,642 US patent application
  misc_feature: The sequence is a functional homolog of SEQ ID NO 2199 in the 10/666,642 US patent application
  misc_feature: The sequence is a functional homolog of SEQ ID NO 2189 in the 10/666,642 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: Useful for making plants with altered lignin content
  misc_feature: Functional homolog of the protein sequence given in SEQ ID NO 13210
  misc_feature: The sequence is a functional homolog of SEQ ID NO 2191 in the 10/666,642 US patent application
  misc_feature: The sequence is a functional homolog of SEQ ID NO 2193 in the 10/666,642 US patent application
  misc_feature: The sequence is a functional homolog of SEQ ID NO 1732 in the 10/412,699 US patent application
  misc_feature: The sequence is a functional homolog of SEQ ID NO 44 in the 10/666,642 US patent application
  misc_feature: The sequence is a functional homolog of SEQ ID NO 66 in the 10/412,699 US patent application
  misc_feature: The sequence is a functional homolog of SEQ ID NO 1460 in the 10/666,642 US patent application
  misc_feature: The sequence is a functional homolog of SEQ ID NO 938 in the 10/412,699 US patent application
  misc_feature: The sequence is a functional homolog of SEQ ID NO 1702 in the 10/412,699 US patent application
  misc_feature: The sequence is a functional homolog of SEQ ID NO 715 in the 10/666,642 US patent application
  misc_feature: Useful for making plants with modulated biomass
  misc_feature: Useful for making plants with modulated flowering time
  misc_feature: Functional homolog of the protein sequence given in SEQ ID NO 13133
  misc_feature: The sequence is a functional homolog of SEQ ID NO 1366 in the 10/666,642 US patent application
  misc_feature: The sequence is a functional homolog of SEQ ID NO 1730 in the 10/412,699 US patent application
  misc_feature: The sequence is a functional homolog of SEQ ID NO 207 in the 11/479,226 US patent application
  misc_feature: The sequence is a functional homolog of SEQ ID NO 64 in the 10/412,699 US patent application
  misc_feature: The sequence is a functional homolog of SEQ ID NO 729 in the 10/666,642 US patent application
  misc_feature: The sequence is a functional homolog of SEQ ID NO 42 in the 10/666,642 US patent application
  misc_feature: Useful for biocontainment applications
  misc_feature: Functional homolog of the protein sequence given in SEQ ID NO 14236
  misc_feature: Useful for making plants with altered alkaloid content
  misc_feature: Functional homolog of the protein sequence given in SEQ ID NO 13528
  misc_feature: The sequence is a functional homolog of SEQ ID NO 1468 in the 10/666,642 US patent application
  misc_feature: The sequence is a functional homolog of SEQ ID NO 282 in the 10/666,642 US patent application
  misc_feature: Useful for making plants with altered terpenoid content
  misc_feature: Functional homolog of the protein sequence given in SEQ ID NO 13438
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: The sequence is a functional homolog of SEQ ID NO 32 in the 10/666,642 US patent application
  misc_feature: The sequence is a functional homolog of SEQ ID NO 1454 in the 10/374,780 US patent application
  misc_feature: The sequence is a functional homolog of SEQ ID NO 14 in the 10/666,642 US patent application
  misc_feature: The sequence is a functional homolog of SEQ ID NO 30 in the 10/666,642 US patent application
  misc_feature: The sequence is a functional homolog of SEQ ID NO 4 in US patent 7057087
  misc_feature: The sequence is a functional homolog of SEQ ID NO 14 in the 10/374,780 US patent application
  misc_feature: The sequence is a functional homolog of SEQ ID NO 328 in the 10/225,066 US patent application
  misc_feature: The sequence is a functional homolog of SEQ ID NO 34 in the 10/286,264 US patent application
  misc_feature: The sequence is a functional homolog of SEQ ID NO 468 in the 11/435,388 US patent application
  misc_feature: The sequence is a functional homolog of SEQ ID NO 68 in the 10/412,699 US patent application
  misc_feature: The sequence is a functional homolog of SEQ ID NO 707 in the 10/666,642 US patent application
  misc_feature: The sequence is a functional homolog of SEQ ID NO 2 in US patent 7049489
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 1470 in the 10/666,642 US patent application
  misc_feature: The sequence is a functional homolog of SEQ ID NO 284 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 6 in US patent 7279615
  misc_feature: The sequence is a functional homolog of SEQ ID NO 122 in the 10/225,066 US patent application
  misc_feature: The sequence is a functional homolog of SEQ ID NO 234 in the 10/374,780 US patent application
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: The sequence is a functional homolog of SEQ ID NO 46 in the 10/666,642 US patent application
  misc_feature: The sequence is a functional homolog of SEQ ID NO 28 in the 10/666,642 US patent application
  misc_feature: The sequence is a functional homolog of SEQ ID NO 731 in the 10/666,642 US patent application
  misc_feature: The sequence is a functional homolog of SEQ ID NO 1453 in the 10/374,780 US patent application
  misc_feature: The sequence is a functional homolog of SEQ ID NO 1971 in the 10/412,699 US patent application
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 2 in US patent 7273968
  misc_feature: The sequence is a functional homolog of SEQ ID NO 730 in the 10/666,642 US patent application
  misc_feature: The sequence is a functional homolog of SEQ ID NO 919 in the 10/666,642 US patent application
  misc_feature: The sequence is a functional homolog of SEQ ID NO 1973 in the 10/412,699 US patent application
  misc_feature: The sequence is a functional homolog of SEQ ID NO 2232 in the 10/374,780 US patent application
  misc_feature: The sequence is a functional homolog of SEQ ID NO 232 in the 10/225,068 US patent application
  misc_feature: The sequence is a functional homolog of SEQ ID NO 310 in the 10/225,066 US patent application
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: The sequence is a functional homolog of SEQ ID NO 1961 in the 10/412,699 US patent application
  misc_feature: The sequence is a functional homolog of SEQ ID NO 1884 in the 10/412,699 US patent application
  misc_feature: The sequence is a functional homolog of SEQ ID NO 352 in the 10/374,780 US patent application
  misc_feature: The sequence is a functional homolog of SEQ ID NO 384 in the 10/225,066 US patent application
  misc_feature: The sequence is a functional homolog of SEQ ID NO 946 in the 10/412,699 US patent application
  misc_feature: The sequence is a functional homolog of SEQ ID NO 1963 in the 10/412,699 US patent application
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 428 in the 10/666,642 US patent application
  misc_feature: The sequence is a functional homolog of SEQ ID NO 892 in the 11/435,388 US patent application
  misc_feature: The sequence is a functional homolog of SEQ ID NO 4 in US patent 7303918
  misc_feature: The sequence is a functional homolog of SEQ ID NO 1056 in the 10/225,066 US patent application
  misc_feature: The sequence is a functional homolog of SEQ ID NO 1882 in the 10/412,699 US patent application
  misc_feature: The sequence is a functional homolog of SEQ ID NO 350 in the 10/374,780 US patent application
  misc_feature: The sequence is a functional homolog of SEQ ID NO 944 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1955 in the 10/412,699 US patent application
  misc_feature: The sequence is a functional homolog of SEQ ID NO 1953 in the 10/412,699 US patent application
  misc_feature: The sequence is a functional homolog of SEQ ID NO 2822 in the 10/374,780 US patent application
  misc_feature: The sequence is a functional homolog of SEQ ID NO 82 in the 11/375,241 US patent application
  misc_feature: The sequence is a functional homolog of SEQ ID NO 1949 in the 10/412,699 US patent application
  misc_feature: The sequence is a functional homolog of SEQ ID NO 1110 in the 10/225,066 US patent application
  misc_feature: The sequence is a functional homolog of SEQ ID NO 166 in the 10/374,780 US patent application
  misc_feature: The sequence is a functional homolog of SEQ ID NO 1812 in the 10/412,699 US patent application
  misc_feature: The sequence is a functional homolog of SEQ ID NO 568 in the 10/412,699 US patent application
  misc_feature: The sequence is a functional homolog of SEQ ID NO 1945 in the 10/412,699 US patent application
  misc_feature: The sequence is a functional homolog of SEQ ID NO 1947 in the 10/412,699 US patent application
  misc_feature: The sequence is a functional homolog of SEQ ID NO 1886 in the 10/412,699 US patent application
  misc_feature: The sequence is a functional homolog of SEQ ID NO 2146 in the 10/374,780 US patent application
  misc_feature: The sequence is a functional homolog of SEQ ID NO 948 in the 10/412,699 US patent application
  misc_feature: The sequence is a functional homolog of SEQ ID NO 1969 in the 10/412,699 US patent application
  misc_feature: The sequence is a functional homolog of SEQ ID NO 1951 in the 10/412,699 US patent application
  misc_feature: Useful for making plants with altered tocopherol content
  misc_feature: Functional homolog of the protein sequence given in SEQ ID NO 14261
  misc_feature: The sequence is a functional homolog of SEQ ID NO 216 in the 10/225,066 US patent application
  misc_feature: The sequence is a functional homolog of SEQ ID NO 2454 in the 10/374,780 US patent application
  misc_feature: The sequence is a functional homolog of SEQ ID NO 360 in the 10/666,642 US patent application
  misc_feature: The sequence is a functional homolog of SEQ ID NO 215 in the 11/479,226 US patent application
  misc_feature: The sequence is a functional homolog of SEQ ID NO 470 in the 11/435,388 US patent application
  misc_feature: Ceres ANNOT ID no. 8713084
  misc_feature (9)..(59): Pfam ID: SRF-TF Pfam Description: SRF-type transcription factor (DNA-binding and dimerisation domain)
MGRGKIEIKRIDNATSRQVTFSKRRSGLFKKAKELAILCDAEVGLVVFSSTGRLYDFASTSILFLTYIEC

SEQ ID NO: 18828 - DNA, 1179 bp, Sorghum bicolor
  misc_feature: Ceres ANNOT ID no. 8713115
  misc_feature: Encodes the peptide sequence at SEQ ID NO 18829
atgtgggaaggcggcggcatccacggcagccaccacgaggcgctcctgctgcaggccgccggatcaggagcggccgactacgggcacggcggcggcggcgtcccggcttcgctcctgccgccgtggctcggcccggccgccgcgccgggcgggttctcctcctacgccatggctccacaccacgcgcatcatctgcagccggggcccttgggcggcgccgccgagagctcttttggcttcggcgacggcggcggcgggtacagcgaagaaggcggggtggggcaattcggggtgttcggcccggagacgccgctgcctcttcttccgccgcacggtctgcaggctctggctgccggaggcagtagcggtgggacggcgacggcgctgatgccgcacgggccgaggatggtgtccggccttctggggaccctgcaggcggagctggggcggatgacggccaaggagatcatggacgccaaggcgctggcggcctcgcgcagccacagcgaggccgagcgccgccgccgccagcggatcaacagccacctcgccaggctccgcagcctgctccccaacaccaccaagacggacaaggcgtcgctgctggcggaggtgatcgagcacgtcaaggagctgaagcggcagacgtcggcggtgctcgacggggagggggaggaggaggaggagccggcggcggcgcggcagcacctgctcctgcccacggaggcggacgacctggcggtggacgccgcggaggacggcgacggcaggctcgtcgtgcgcgcgtcgctgtgctgcgaggaccgcgtggggctcatccccgacatcgcccgcgcgctcgccgcgctccgcctgcgcgcgcaccgcgccgagatcgccacgctcggcggccgcgtccgcaacgtgctcctcatcaccaccgccgccgacgacgaccaggaggaggaggaggaggaggaggaaggaggagagcgccaaggcgacaacgaccgcgaagactgcgccggcgcctcgttgtccaaccaccggaggcacgagctcgtcgcgtcgatccaggaggcgctgcgaggcgtcatggaccgcaagacggcgagcagcgacacgtcctcatctagcggcggcggcgggagcatcaagaggcagcgcatgaacggtgcgcatgagcaaggttcgctttag

SEQ ID NO: 18829 - protein, 392 aa, Sorghum bicolor
  misc_feature: The sequence is a functional homolog of SEQ ID NO 1899 in the 10/374,780 US patent application
  misc_feature: Ceres ANNOT ID no. 8713115
  misc_feature (164)..(213): Pfam ID: HLH Pfam Description: Helix-loop-helix DNA-binding domain
MWEGGGIHGSHHEALLLQAAGSGAADYGHGGGGVPASLLPPWLGPAAAPGGFSSYAMAPHHAHHLQPGPLGGAAESSFGFGDGGGGYSEEGGVGQFGVFGPETPLPLLPPHGLQALAAGGSSGGTATALMPHGPRMVSGLLGTLQAELGRMTAKEIMDAKALAASRSHSEAERRRRQRINSHLARLRSLLPNTTKTDKASLLAEVIEHVKELKRQTSAVLDGEGEEEEEPAAARQHLLLPTEADDLAVDAAEDGDGRLVVRASLCCEDRVGLIPDIARALAALRLRAHRAEIATLGGRVRNVLLITTAADDDQEEEEEEEEGGERQGDNDREDCAGASLSNHRRHELVASIQEALRGVMDRKTASSDTSSSSGGGGSIKRQRMNGAHEQGSL

SEQ ID NO: 18830 - DNA, 756 bp, Sorghum bicolor
  misc_feature: Ceres ANNOT ID no. 8713150
  misc_feature: Encodes the peptide sequence at SEQ ID NO 18831
atggcgtccgtcaccgcccgcgccccggtcgcggccctgcgcccgtcgtcggcgtcgtcgctcaagtcgtcgtcgtcgtcctcggccttccttggccactctagccgcctcggccgcaccgcgtcgccgacgaccaggcgcagcctcaaggcggaggccaagggcgagtggctccccggccttccctcccccgcctacctcgacggcagcctgccgggtgacaatggcttcgacccgttgggcctggcggaggaccccgagaacctgcggtggttcgtgcaggcggagctggtgaacgggcggtgggcgatgctcggcgtggccgggatgctgatcccggaggtgctgaccaaggccgggctcatcaacgcgccgcagtggtacgacgccggcaagtcggagtacttcgcgtcgtcgtcgacgctgttcgtgatcgagttcatcctgttccactacgtggagatccggcggtggcaggacatcaagaaccccggcagcgtcaaccaggaccccatcttcaagagctacagcctgccgccgcacgagtgcggctaccccggcagcgtcttcaacccgctcaacttcgcgcccacgctcgaggccaaggagaaggagctcgccaacgggaggctggcgatgctggcgttcctgggcttcctgatccagcacaacgtcaccggcaaggggcccttcgacaacctgctgcagcacctgtctgacccatggcacaacaccatcatccagaccctctcttag

SEQ ID NO: 18831 - protein, 251 aa, Sorghum bicolor
  misc_feature: Useful for making plants with modulated nitrogen use efficiency
  misc_feature: Functional homolog of the protein sequence given in SEQ ID NO 14301
  misc_feature: Ceres ANNOT ID no. 8713150
  misc_feature (62)..(224): Pfam ID: Chloroa_b-bind Pfam Description: Chlorophyll A-B binding protein
MASVTARAPVAALRPSSASSLKSSSSSSAFLGHSSRLGRTASPTTRRSLKAEAKGEWLPGLPSPAYLDGSLPGDNGFDPLGLAEDPENLRWFVQAELVNGRWAMLGVAGMLIPEVLTKAGLINAPQWYDAGKSEYFASSSTLFVIEFILFHYVEIRRWQDIKNPGSVNQDPIFKSYSLPPHECGYPGSVFNPLNFAPTLEAKEKELANGRLAMLAFLGFLIQHNVTGKGPFDNLLQHLSDPWHNTIIQTLS

SEQ ID NO: 18832 - DNA, 1470 bp, Sorghum bicolor
  misc_feature: Ceres ANNOT ID no. 8713157
  misc_feature: Encodes the peptide sequence at SEQ ID NO 18833
atgcaggtcactgttatcgcaaatgaagcaatcatgagatgcctgaaggtaatcgcaggctgcagacagcaagcatgggcaggcagatatttggcagtcagtgaccaccaccagcaccgatcacaattgggtgggaacaggcagcaaggggatatgaaagaaaacgtcgccaggcactgtgaggcgcagcaaagcaagcaaaggggctgcctgaaactggagtgcctcacgccccagcgcatggcagggcagggcatgccgccaacccacccacaagtacagcgtgaatatgcgctgctggctgctactacttactctgacccgttccatggaacagacatgaggagaggcggcatgcgtttgctcgctcgtgagacggtggtgctggtgctggtggtggtggggctccgagcgaggagagaatccagtcagtccaaggagcaagcaggcgagaaggaagcagccgccgctgtcgtcgtcgtctcgtctgcgactactactccggccgccgctgctgcggcttctcatgctggccacgccaccgacgctgctccttttgctgcgatacgaagcgccgcggtgggcacgctggaaatgtcgtcgctgggtggtcagcagcagcagcacgggcacggcgaggccgccagggcgcggctcaggtggacacgccagctccacgaccgcttcgtgctcgccgtggcccagctcggcggcgcagacaaggcgacacccaagtccgtgctgagggcgatggccgtgccggggctcacgctgtaccacctcaagagccacctccagaagtaccggctggcggtgagccgaggcgtcgcctccccgctcggcgacaacggagatggcaccatcgagcggtcgtcgtcctcggagagccagccggacgagtacgacgacgacggcaccatcgccgagctgcatggtgattcttccaggaccatggcgcggatgcagagggaggtgcagaggaagctgcaggagcagatcgaggtgcagcggcacctacagctgaggatcgaggcgcaggggaggtacctgcagtccgtgctgcgccgggcgcaggaggtcctcgccgacgaccacagcctgggctcgccggccggcgcggaggccgccaagggagagctctcggagctggctgcctccgcggtggagacggccgggtgcctgtcctcctcctgctcctgctgctgctgctccccctcgccgtccccgacgcgccaccgctctgccgacagcagctgcgtcacgtcgtcctcctcctcggaggccgagagccaccaggcccccgccgccggcgccaagtggcggctccacacgtgtggcgctggtactacgcgcgactgctccgacgtcgaccagccggtgctgcaggccgaggagagtacattcctgcagaggcacgacgcagaggatgcagaggacggcacttcatcagagattgatctcaacaggtag

SEQ ID NO: 18833 - protein, 489 aa, Sorghum bicolor
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
  misc_feature: Ceres ANNOT ID no. 8713157
  misc_feature (218)..(269): Pfam ID: Myb_DNA-binding Pfam Description: Myb-like DNA-binding domain
MQVTVIANEAIMRCLKVIAGCRQQAWAGRYLAVSDHHQHRSQLGGNRQQGDMKENVARHCEAQQSKQRGCLKLECLTPQRMAGQGMPPTHPQVQREYALLAATTYSDPFHGTDMRRGGMRLLARETVVLVLVVVGLRARRESSQSKEQAGEKEAAAAVVVVSSATTTPAAAAAASHAGHATDAAPFAAIRSAAVGTLEMSSLGGQQQQHGHGEAARARLRWTRQLHDRFVLAVAQLGGADKATPKSVLRAMAVPGLTLYHLKSHLQKYRLAVSRGVASPLGDNGDGTIERSSSSESQPDEYDDDGTIAELHGDSSRTMARMQREVQRKLQEQIEVQRHLQLRIEAQGRYLQSVLRRAQEVLADDHSLGSPAGAEAAKGELSELAASAVETAGCLSSSCSCCCCSPSPSPTRHRSADSSCVTSSSSSEAESHQAPAAGAKWRLHTCGAGTTRDCSDVDQPVLQAEESTFLQRHDAEDAEDGTSSEIDLNR

SEQ ID NO: 18834 - DNA, 1221 bp, Sorghum bicolor
  misc_feature: Ceres ANNOT ID no. 8713159
  misc_feature: Encodes the peptide sequence at SEQ ID NO 18835
atggagtgccagagatggaagagcaaaggtgttaacataaagtacgaggtcagggggaaccggaaggggtacaaggccggcgcactcaaggaaggattgaagcacgactacgtcaaagactgcgaatacattgccatgtttgacgctgacttccagcccgagtccgattttctcctcaggactatcccgttccttgtgcacaacccggagattgcccttgtccaaactcgctggaaattcgttaattccgatgagtgtctgctgacaagattccaagaaatgtcgttagactaccatttcaagtacgagcaagaggcagggtcctcggtgtattcattctttggcttcaatgggacagctggtgtctggaggatttcagcgatcgatgatgccgggggctggaaggaccggacgacagtggaagatatggacctggctgtccgtgcgatgctgcagggatggaaattcgtttacgtcggtgacataaaagtcaagagtgaattgccaagcacattcaaggcataccggtttcagcagcacaggtggtcatgtggaccggcaaacttgttcaagaaaatgatggtagagattttagaaaacaagaaagtgtcactgtggagtaaaatccacttatggtacgatttcttcttcgttgggaaggttgctgctcatacggtgacattcatctactactgctttgcgatccctgtgtctgttttgctgcctgagattcagatccctctctggggagttgtctatgtcccgacagccataaccctcttgaaggctcttggcacaccgagttcatttcacctggtgatcctctgggttctgtttgagaatgtcatgtcgttgcaccggattaaagctgcaataagtggtcttctggatgctggtggacgagtcaatgagtgggttgtcactgagaagttgggtgacaccaacaaggcaaagcctggcaccaatggatcagatgctgtaaaggtgatcgatgtaaagctaacagaaccccttattccgaagctagtgaagaggcgagcaagattttgggagaggtaccactgctcagaacttttcgttggaacctgcatactaatgtgtggtttctatgacttgcttcttgcaaagaagggatactacattttcctcttccttcaaggcacggctttccttgttgctggttttgggtatgtcggaacactacctccttgcactgcataa

SEQ ID NO: 18835 - protein, 406 aa, Sorghum bicolor
  misc_feature: Useful for making plants with altered cell wall content and/or composition
  misc_feature: Functional homolog of the protein sequence given in SEQ ID NO 13963
  misc_feature: Useful for making plants with altered carbohydrate content
  misc_feature: Functional homolog of the protein sequence given in SEQ ID NO 13964
  misc_feature: Ceres ANNOT ID no. 8713159
  misc_feature (11)..(191): SWISSPROT Homolog: EC 2.4.1.12 Cellulose synthase (UDP-forming)
MECQRWKSKGVNIKYEVRGNRKGYKAGALKEGLKHDYVKDCEYIAMFDADFQPESDFLLRTIPFLVHNPEIALVQTRWKFVNSDECLLTRFQEMSLDYHFKYEQEAGSSVYSFFGFNGTAGVWRISAIDDAGGWKDRTTVEDMDLAVRAMLQGWKFVYVGDIKVKSELPSTFKAYRFQQHRWSCGPANLFKKMMVEILENKKVSLWSKIHLWYDFFFVGKVAAHTVTFIYYCFAIPVSVLLPEIQIPLWGVVYVPTAITLLKALGTPSSFHLVILWVLFENVMSLHRIKAAISGLLDAGGRVNEWVVTEKLGDTNKAKPGTNGSDAVKVIDVKLTEPLIPKLVKRRARFWERYHCSELFVGTCILMCGFYDLLLAKKGYYIFLFLQGTAFLVAGFGYVGTLPPCTA

SEQ ID NO: 18836 - DNA, 1131 bp, Sorghum bicolor
  misc_feature: Ceres ANNOT ID no. 8713179
  misc_feature: Encodes the peptide sequence at SEQ ID NO 18837
atggagaagtcagatgagatactcatgccgggtttccggttccatcccaccgacgaagagctggttagtttctacctcaagaggaagatccagcaaaagcctatctccattgagcttatcaggcagctggacatctacaagtttgacccatgggatctcccaaagcttgcgagcaccggtgagaaggagtggtacttctactgcccaagggatcggaaataccgcaacagtgtaaggccgaacagagtcacggcagccggtttctggaaggccacagggacagacaggccaatctactcatctgagggcaccaagtgcataggcctgaagaagtcccttgtgttctacaaagggagagctgcaagagggatgaaaactgactggatgatgcatgagtttaggctcccttcgctcaccgatccctcgctccccaagcgcccgatcgacaagaccattccactcaatgactcctggactatctgtaggatcttcaagaaaaccagttccatggcgcaacgagcgctgtcccatacctgggggcctccactgcctggggcaacagaggcagacatgttcaccgcgttgcagtcagtgcaagcttcagaatttgctcttgagagctcactgcaagttgcaccgcttgcacctgcaggccagttcaccagcaggcatggtcagcaccaccaccagcagaagggtaacaacaacccatctctggacggctcctcatgcaagctcatcaacttcaacaacagcagcccatccgaggaacaccataacttcccaatcaccttccctttcgaagtgcaagaggcaccgcagaaggctgcagctgcggcggcgccaatcttcttcggcgcgcatcctgctcatcacctcagtggattcgtggtcgattcttctgccgatgtcaatggcggcggcatcggtggcaggagtcaggactcctcgtccaccaggaagcctagcaatggcttcagcactaacagcagtgactggggggaaactgcagggagaatcaacttcccttttgatctgggtgcagattcttcagaggagtggagatgcaacataccctgggagtccttcctgactagcccagctgctctccagactgagctgccacactag

SEQ ID NO: 18837 - protein, 376 aa, Sorghum bicolor
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 310 in the 10/666,642 US patent application
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 890 in the 10/374,780 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated water use efficiency
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: The sequence is a functional homolog of SEQ ID NO 745 in the 11/479,226 US patent application
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: Ceres ANNOT ID no. 8713179
  misc_feature (8)..(136): Pfam ID: NAM Pfam Description: No apical meristem (NAM) protein
MEKSDEILMPGFRFHPTDEELVSFYLKRKIQQKPISIELIRQLDIYKFDPWDLPKLASTGEKEWYFYCPRDRKYRNSVRPNRVTAAGFWKATGTDRPIYSSEGTKCIGLKKSLVFYKGRAARGMKTDWMMHEFRLPSLTDPSLPKRPIDKTIPLNDSWTICRIFKKTSSMAQRALSHTWGPPLPGATEADMFTALQSVQASEFALESSLQVAPLAPAGQFTSRHGQHHHQQKGNNNPSLDGSSCKLINFNNSSPSEEHHNFPITFPFEVQEAPQKAAAAAAPIFFGAHPAHHLSGFVVDSSADVNGGGIGGRSQDSSSTRKPSNGFSTNSSDWGETAGRINFPFDLGADSSEEWRCNIPWESFLTSPAALQTELPH

SEQ ID NO: 18838 - DNA, 360 bp, Sorghum bicolor
  misc_feature: Ceres ANNOT ID no. 8713180
  misc_feature: Encodes the peptide sequence at SEQ ID NO 18839
atggtgcagcgcctcacctaccggaagcgtcacagctacgcgaccaagtccaaccagacccgggtcgtcaagacccctggtgggaagcttgtgtaccagtacacgaagaagagggcgagcgggcccaagtgccccgtcaccgggaagaagatccaggggatcccccacttaaggcctgctgagtacaaaaggtccaggttgtctaggaaccgcaggactgtgaaccgtccatatggtggagtactctctggaattgctgttagggagagaatcatccgtgctttcttggttgaggaacagaagattgtcaagaaggtcctgaaaatacagaaaaccaaggacaagacagctgcaaaatag

SEQ ID NO: 18839 - protein, 119 aa, Sorghum bicolor
  misc_feature: Useful for making plants with modulated nitrogen use efficiency
  misc_feature: Functional homolog of the protein sequence given in SEQ ID NO 14309
  misc_feature: Ceres ANNOT ID no. 8713180
  misc_feature (5)..(103): Pfam ID: Ribosomal_L34e Pfam Description: Ribosomal protein L34e
MVQRLTYRKRHSYATKSNQTRVVKTPGGKLVYQYTKKRASGPKCPVTGKKIQGIPHLRPAEYKRSRLSRNRRTVNRPYGGVLSGIAVRERIIRAFLVEEQKIVKKVLKIQKTKDKTAAK

SEQ ID NO: 18840 - DNA, 375 bp, Sorghum bicolor
  misc_feature: Ceres ANNOT ID no. 8713192
  misc_feature: Encodes the peptide sequence at SEQ ID NO 18841
atggtgatcctgaggcggtgccacccgccgcctcctccggcggtgctcttcggcgggtgctgccgcagcgcaggcggcgtgcgctacggggagtgccggcggaaccacgcggcgagcatgggcggccacgccgtggacgggtgccgcgagttcttggcggagggggaggagggcaccaccgccgcgctccgctgcgcggcgtgcgggtgccaccgcagcttccaccgccgcatggtggtgccgcgctgctgctgctgcttctgctgcgacggcggcgccgatgatgccgccgccgtagccgcagccgccaccggccgcctgtgggacgacgactgctcgccagagtcctcggcgtccagcaccacgcccagctag

SEQ ID NO: 18841 - protein, 124 aa, Sorghum bicolor
  misc_feature: The sequence is a functional homolog of SEQ ID NO 108 in the 10/714,887 US patent application
  misc_feature: The sequence is a functional homolog of SEQ ID NO 108 in the 11/435,388 US patent application
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13913
  misc_feature: Useful for making plants with modulated low light sensitivity
  misc_feature: Functional homolog of the protein sequence given in SEQ ID NO 13756
  misc_feature: The sequence is a functional homolog of SEQ ID NO 116 in the 10/714,887 US patent application
  misc_feature: The sequence is a functional homolog of SEQ ID NO 116 in the 11/435,388 US patent application
  misc_feature: The sequence is a functional homolog of SEQ ID NO 118 in the 10/714,887 US patent application
  misc_feature: The sequence is a functional homolog of SEQ ID NO 118 in the 11/435,388 US patent application
  misc_feature: The sequence is a functional homolog of SEQ ID NO 120 in the 10/714,887 US patent application
  misc_feature: The sequence is a functional homolog of SEQ ID NO 120 in the 11/435,388 US patent application
  misc_feature: Ceres ANNOT ID no. 8713192
  misc_feature (24)..(83): Pfam ID: ZF-HD_dimer Pfam Description: ZF-HD protein dimerisation region
MVILRRCHPPPPPAVLFGGCCRSAGGVRYGECRRNHAASMGGHAVDGCREFLAEGEEGTTAALRCAACGCHRSFHRRMVVPRCCCCFCCDGGADDAAAVAAAATGRLWDDDCSPESSASSTTPS

SEQ ID NO: 18842 - DNA, 1488 bp, Sorghum bicolor
  misc_feature: Ceres ANNOT ID no. 8713207
  misc_feature: Encodes the peptide sequence at SEQ ID NO 18843
atggccgtctccctcctggccctctcctgctgggctctcgtcaattccaggatcaacgtcgccatgccttactctgccttcgtgatgcgcgacgtcgtcgacaagacgcccgcactcacagtcaccggcgtagaagacaggcaccccgccggcctcgacccagcgtcgtcaacctcggtgccggcgaccagtgacgccacgtcgggctcggtgaagctgagcggtccggtgatccggcgggagccgctggcaggagaaagggaacgacgggaacggagcgagacgaggtgcgacgcggacagcgcggcgctcagggtgtacgtgtacgacctgccggcggagttccatttcggcatgctggggtgggacgggaaggggaagccggcggcgtggcccgacgtccgcgacgcccgcgccgcgccgcactaccccggcgggctcaacctgcagcacagcgtggcgtactggctcacgctggacatcctgtcctccgcgctgccgcccggcaccggcaccggcagcgacgacgtggtcatcagggacaggccctgcgtcgccgtcagggtgacgaacgccagcctcgccgacgtcttcttcgtgccgttcttcgcgtcgctgagctacaaccgccactcgaagctccgccgcggggagaaggtgaaccggaacaggttcctgcaggccgagctggtcaggtacctgatgcggaaggaggagtggaggaggtggggcggcaagaaccacctcatcgtgccgcaccaccccaacagcatgatggaggcgaggaagaagctcagcgccgccatgttcgtgctgtccgacttcgggaggtactcgccgcacgtcgccaacctcaagaaggacgtcatcgcgccgtacatgcacgtcgtccgctccttcggcgacggcgactcgccggcgttcgaccaacgtcccatcctggcatacttccagggcgccatccatcggaaagctggcgggaaggttcggcagaagctgtaccagctgctcaaggacgagcgcgacgtgcacttcacctacggcagcgtgcggcagaacggcatccggcgcgccaccgcggggatgtcgacgtccaagttctgcctcaacatcgccggcgacacgccgtcgtcgaaccgcctcttcgacgccatcgtcagccactgcgtcccggtcatcatcagcgacgacatcgagctgcccttcgaggacgtgctcgactactcggagttctgcgtgttcgtgcgctccgccgacgccgccaagagggggttcctgctgcggctgctccggggcatctcgcgcgacgagtggaccaagatgtggatgaggttgaagaaggtgactcgccacttcgagtaccagtacccttcaaggtcaggtgatgctgtccagatgatatggagcgccgtggcgcggaagatgcactcggtgcagctgcagcttcacaaacgcggtagattccagaggacgggttctgaatcatga

SEQ ID NO: 18843 - protein, 495 aa, Sorghum bicolor
  misc_feature: Useful for making plants with altered carbohydrate content
  misc_feature: Functional homolog of the protein sequence given in SEQ ID NO 14192
  misc_feature: Useful for making plants with altered cell wall content and/or composition
  misc_feature: Functional homolog of the protein sequence given in SEQ ID NO 14673
  misc_feature: Ceres ANNOT ID no. 8713207
  misc_feature (106)..(445): Pfam ID: Exostosin Pfam Description: Exostosin family
MAVSLLALSCWALVNSRINVAMPYSAFVMRDVVDKTPALTVTGVEDRHPAGLDPASSTSVPATSDATSGSVKLSGPVIRREPLAGERERRERSETRCDADSAALRVYVYDLPAEFHFGMLGWDGKGKPAAWPDVRDARAAPHYPGGLNLQHSVAYWLTLDILSSALPPGTGTGSDDVVIRDRPCVAVRVTNASLADVFFVPFFASLSYNRHSKLRRGEKVNRNRFLQAELVRYLMRKEEWRRWGGKNHLIVPHHPNSMMEARKKLSAAMFVLSDFGRYSPHVANLKKDVIAPYMHVVRSFGDGDSPAFDQRPILAYFQGAIHRKAGGKVRQKLYQLLKDERDVHFTYGSVRQNGIRRATAGMSTSKFCLNIAGDTPSSNRLFDAIVSHCVPVIISDDIELPFEDVLDYSEFCVFVRSADAAKRGFLLRLLRGISRDEWTKMWMRLKKVTRHFEYQYPSRSGDAVQMIWSAVARKMHSVQLQLHKRGRFQRTGSES

SEQ ID NO: 18844 - DNA, 1173 bp, Sorghum bicolor
  misc_feature: Ceres ANNOT ID no. 8713205
  misc_feature: Encodes the peptide sequence at SEQ ID NO 18845
atggagggggtggtggacctcaagtaccagccggtgttcccgaacggcggcgtggccgcggcggccaagaagacggcgaggctcggggcggcgggggtgtaccgggagtgcctcaagaaccacgcggcgagcctgggcggccacgcgcttgacgggtgcggcgagttcatgccgtcgccggaggccgacccggcggacccgagctcgctcaggtgcgccgcgtgcgggtgccaccgcaacttccaccgccggctcgccgagctgcctccgccgccgccgctcctcaccttgccaccgccaccaccacagccgtcactggcggcgttggtgccggcgccggctgccgcgtcgcacgtcatgcgtgatagcttcacgatgcgcggcgaggagacgccagacgaccgcgtgccggccgccttcgacgaggagaccgaggaggagtcggacgagggctcggatttcgacgaggaccgcccggtgtcgccgctgccggtgccggccttgccgccgcacggctaccgccagcagaccgcgccggcgccgcacatgctcctcgggctgaacactggcgtgccgagcccgggcgtgcaaacccccgcggtggcgccgaggccgccgccgccgcccgcctctgcctcgctgggcccgatgcctcccgcgccgcccgggactgttgttcccggtgccgcggcggcggcggcgaggaagcggttccgcaccaaattcagcccggagcagaagcagcggatgcaggcgctgtcggagcggctgggctggcggctgcagaagcgcgacgaggccgtggtggacgagtgctgccaggagatgggcgtcaccaagggcgtcttcaaggtctggatgcacaacaacaagcacaacttcgtcggcggccacagcgcgcgccgcagcgcctcagcctctgccgccgccgccgcggccatccaccaccatccgtccgacgcagccgccggcgctgtctacccttcctcctcccacggccacgccgccgccgccccagcagcagcaccagccgccgctgtccaccacccttccgccccggccgctcctgtccacgctgacttcaacatcaacggcgccgccgctgacgctgccgactacttccgcgtccagccgtcgacggcgagtggcggcggctcgccgcagtcgtcctag

SEQ ID NO: 18845 - protein, 390 aa, Sorghum bicolor
  misc_feature: Useful for making plants with modulated low light sensitivity
  misc_feature: Functional homolog of the protein sequence given in SEQ ID NO 13756
  misc_feature: Ceres ANNOT ID no. 8713205
  misc_feature (29)..(90): Pfam ID: ZF-HD_dimer Pfam Description: ZF-HD protein dimerisation region
MEGVVDLKYQPVFPNGGVAAAAKKTARLGAAGVYRECLKNHAASLGGHALDGCGEFMPSPEADPADPSSLRCAACGCHRNFHRRLAELPPPPPLLTLPPPPPQPSLAALVPAPAAASHVMRDSFTMRGEETPDDRVPAAFDEETEEESDEGSDFDEDRPVSPLPVPALPPHGYRQQTAPAPHMLLGLNTGVPSPGVQTPAVAPRPPPPPASASLGPMPPAPPGTVVPGAAAAAARKRFRTKFSPEQKQRMQALSERLGWRLQKRDEAVVDECCQEMGVTKGVFKVWMHNNKHNFVGGHSARRSASASAAAAAAIHHHPSDAAAGAVYPSSSHGHAAAAPAAAPAAAVHHPSAPAAPVHADFNINGAAADAADYFRVQPSTASGGGSPQSS

SEQ ID NO: 18846 - DNA, 1140 bp, Sorghum bicolor
  misc_feature: Ceres ANNOT ID no. 8713261
  misc_feature: Encodes the peptide sequence at SEQ ID NO 18847
atgaccgtcgtcgacgccgtctccactgatgccgccggcgccgccccagctgccgccgcggcgccggtggtggtggcgcagcccgggaacgggcagaccgtgtgcgtcaccggcgcggccgggtacatcgcctcgtggctcgtcaagatgctgctcgagaagggatacactgtcaagggcaccgtcaggaacccaggcatgcttgttaactatgacccgaagaacgcgcacctcaaggcgctggacggcgcggccgagcggctgatcctctgcaaggccgacctcctggactacgacgccatctgccgcgccgtgcagggctgccagggcgtcttccacaccgcctcccccgtcaccgacgatccggagcaaatggtggagccggcggtgcgcggcacggagtacgtgatcaacgcggcggcggaggccggcacggtgcggcgggtggtgttcacgtcctccatcggcgcggtgaccatggaccccagccgcgggcccgacgtcgtggtcgacgagtcgtgctggagcgacctcgagttctgcaagaaaaccaggaactggtactgctacggcaaggcggtggcggagcaggcggcgtgggacgcggcccggcagcgcggcgtggacctggtggtggtgaacccggtgctggtggtgggcccgctgctgcagccgacggtgaacgccagcatcgcgcacgtgctcaagtacctggacggctccgcgcgcaccttcgccaacgccgtgcaggcgtacgtggacgtccgcgacgtcgccgacgcgcacctccgcgtcttcgagagccccgccgcgtccggccgatacctctgcgccgagcgcgtcctccaccgcgaggacgtcgtccgcatcctcgccaagctcttccccgagtaccccgtccccaccaggtgctccgacgaggtgaacccgcggaagcagccgtacaagttctcgaaccagaagctccgggacctgggattggagttccggccggtgagccagtcgctctacgatacggtgaagaaccttcaggagaagggccacctgccggtgctcggagagcagacgacggaggccgacaaggaggaggccaacgccgccgccgaggtgcagcagggaggaatcgccatccgtgcgtga

SEQ ID NO: 18847 - protein, 379 aa, Sorghum bicolor
  misc_feature: Useful for making plants with altered carbohydrate content
  misc_feature: Functional homolog of the protein sequence given in SEQ ID NO 14674
  misc_feature: Useful for making plants with altered cell wall content and/or composition
  misc_feature: Useful for making plants with altered lignin content
  misc_feature: Functional homolog of the protein sequence given in SEQ ID NO 13818
  misc_feature: Ceres ANNOT ID no. 8713261
  misc_feature (33)..(351): SWISSPROT Homolog: EC 1.1.1.219 Dihydrokaempferol 4-reductase
  misc_feature (34)..(278): Pfam ID: Epimerase Pfam Description: NAD dependent epimerase/dehydratase family
MTVVDAVSTDAAGAAPAAAAAPVVVAQPGNGQTVCVTGAAGYIASWLVKMLLEKGYTVKGTVRNPGMLVNYDPKNAHLKALDGAAERLILCKADLLDYDAICRAVQGCQGVFHTASPVTDDPEQMVEPAVRGTEYVINAAAEAGTVRRVVFTSSIGAVTMDPSRGPDVVVDESCWSDLEFCKKTRNWYCYGKAVAEQAAWDAARQRGVDLVVVNPVLVVGPLLQPTVNASIAHVLKYLDGSARTFANAVQAYVDVRDVADAHLRVFESPAASGRYLCAERVLHREDVVRILAKLFPEYPVPTRCSDEVNPRKQPYKFSNQKLRDLGLEFRPVSQSLYDTVKNLQEKGHLPVLGEQTTEADKEEANAAAEVQQGGIAIRA

SEQ ID NO: 18848 - DNA, 1332 bp, Sorghum bicolor
  misc_feature: Ceres ANNOT ID no. 8713281
  misc_feature: Encodes the peptide sequence at SEQ ID NO 18849
atgaaggtcgacgtggtggggacgacgctggtggcgccgagcgaggacacgccgcgccgggagctgtggctgtccaacctggacctggccgtgcccaagacgcacacgccgctcgtgtactactacccggcgccggcgccggcggccgccacgggcacggacgacggaggagaccgggcggccttcttcgcgccggagcggctggaggcggcgctggccagggcgctggtgccgttctacccgctggcggggaggctgggcgtcggcgtgggcgagggcggacgcctgcgcatcgactgcaacgcccagggcgcgctcttcgtcgtcgccagggccgacttcgccggcgaggacgtgttcggcgacaccgacggcggctacgagccgtcgccggaggtcaggcggatgttcgtgccgttcgtgccgtccggcgacccgccctgcgtcatgtccatgttccaggtgacgttcctcaagtgcggcggcgtggtgctaggcacgggcatccaccacgtgaccatggacggcatgggcgcgttccacttcatgcagacctggaccggcgtggcgcggggcctcgacgtcgccgaggcgtgcggcccgctgccgccgttccacgaccggacgctcctccgcgcgcgctccccgccgacgccggccttcgaccacccggtctactcgccgtccctgctcaacggccggccccgccccttcgtcacccgcgtgtacgccgtctcgccgaagctcctcgccgacgtcaagtcccgctgcgcgccgggcgtgtccacctactgcgccgtcaccgcgcacctgtggcgctgcatgtgcgtggcgcgcgggctggcgccgtgctccgacacgcggctccgcgtcccggccaacgtccgccaccgcctccgcccggcgctcccgcggagctacttcggcaacgccatcgtgcgcgacctcgtcgtcgcccgggtggaggacgtcctggaccgcccgctcgggttcgtggcgcaggccatcaaggacgccgtggaccgcgtcgacgacgcctacgtgcgctccgtggtggactacctggaggtggagtcggagaagggcagccaggcggcgcgcgggcagctcatgccggagtccgacctgtgggtggtcagctggctcgggatgcccatgtacgacgccgacttcggctggggcacgccgcggttcgtcgcgccggcgcagatgttcggcagcggcacggcgtacgtgacgcagcgcgccaacaaggacgacggcatcgccgtgctctttgggctggagccccagtatctgcagtgcttcgagaaggtgttctatggggagtga

SEQ ID NO: 18849 - protein, 443 aa, Sorghum bicolor
  misc_feature: Useful for making plants with altered carbohydrate content
  misc_feature: Functional homolog of the protein sequence given in SEQ ID NO 14310
  misc_feature: Ceres ANNOT ID no. 8713281
  misc_feature (1)..(441): SWISSPROT Homolog: EC 2.3.1.144 Anthranilate N-benzoyltransferase
  misc_feature (1)..(443): Pfam ID: Transferase Pfam Description: Transferase family
MKVDVVGTTLVAPSEDTPRRELWLSNLDLAVPKTHTPLVYYYPAPAPAAATGTDDGGDRAAFFAPERLEAALARALVPFYPLAGRLGVGVGEGGRLRIDCNAQGALFVVARADFAGEDVFGDTDGGYEPSPEVRRMFVPFVPSGDPPCVMSMFQVTFLKCGGVVLGTGIHHVTMDGMGAFHFMQTWTGVARGLDVAEACGPLPPFHDRTLLRARSPPTPAFDHPVYSPSLLNGRPRPFVTRVYAVSPKLLADVKSRCAPGVSTYCAVTAHLWRCMCVARGLAPCSDTRLRVPANVRHRLRPALPRSYFGNAIVRDLVVARVEDVLDRPLGFVAQAIKDAVDRVDDAYVRSVVDYLEVESEKGSQAARGQLMPESDLWVVSWLGMPMYDADFGWGTPRFVAPAQMFGSGTAYVTQRANKDDGIAVLFGLEPQYLQCFEKVFYGE

SEQ ID NO: 18850 - DNA, 1314 bp, Sorghum bicolor
  misc_feature: Ceres ANNOT ID no. 8713290
  misc_feature: Encodes the peptide sequence at SEQ ID NO 18851
atggccaggccgcgcaagaacgccggtaccgacgaggataatcctaacgccgccacgggcgtcagcgtcaccgggaagccgccgaagctgaagcgggtgcggaggaagggcgagccgcgggagagcagcaccccgtcccagcgcagctccgcgtaccgcggcgtcacacggcaccggtggacggggcggttcgaggcgcacctgtgggacaaggacgcccgcaatggctcccggaacaagaaaggcaagcaaggtgcgtacgacgacgaggaagcggcggcgcgcgcgcacgacctggcggcgctcaagtactggggccccgccaccgtcctcaacttcccgctgtgcggctacgacgaggagctgagggagatggaggcgcagcccagggaggagtacatcgggtcgctgcgtcggcggagcagcggcttctcgcgaggggtgtccaagtacaggggcgttgccaggcatcatcacaacgggcgatgggaggcgaggatcgggcgcgtgctgggcaacaagtacctctacctcgcaacgcaagaggaggcggcggtggcgtacgacatcgccgctatagagcaccgtggcctcaacgcggtcaccaacttcgacatcagccactacgtcaatcactggcatcgacactgccacggcccctccgacgacagcctcggcgtggtggtggacgacgtcgccgcgttccagctaccagatgacctgcccgagtgcccggcggccgccatcggcgtcgaggagaccacgggcggcgacgcggaattccacaacggcgaggagggctacctgcagcaccacaccagcggacccttcggcgcgcagcagcagcttcctgacgagacgggagcgctagcggctcatcaaatggcgccaaattcgtcggcgctcgacatggtgttgcagtctcccaagttcaaggagctgatggagcaggtctccgcggcggcggcggcggtggcctccgagagcagcatcggcggcagcatgagcagcagctcgccgtcgccgtctttgtcctcgttctcgccttcgcctctgcagctgccatcgccgtcgtctttgtcctcgttctcgccttcgtcgcctctgcagcagccatcgccgccgctgcagcagcctgagttcgtcgaaggagcgccggcggctcggtgcagcttcccggacgacgtgcagacgttcttcgatttcgagaacgagagcgacatgagcttcatgtacgcggaggttgacacgttcctcttcggggacctgggcgcgtacgcggcgccgatattccacttcgacctagacgtgtga

SEQ ID NO: 18851 - protein, 437 aa, Sorghum bicolor
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: The sequence is a functional homolog of SEQ ID NO 1900 in the 10/412,699 US patent application
  misc_feature: The sequence is a functional homolog of SEQ ID NO 358 in the 10/666,642 US patent application
  misc_feature: The sequence is a functional homolog of SEQ ID NO 676 in the 11/435,388 US patent application
  misc_feature: Useful for biocontainment applications
  misc_feature: Functional homolog of the protein sequence given in SEQ ID NO 13650
  misc_feature: Ceres ANNOT ID no. 8713290
  misc_feature (50)..(107): Pfam ID: AP2 Pfam Description: AP2 domain
  misc_feature (149)..(198): Pfam ID: AP2 Pfam Description: AP2 domain
MARPRKNAGTDEDNPNAATGVSVTGKPPKLKRVRRKGEPRESSTPSQRSSAYRGVTRHRWTGRFEAHLWDKDARNGSRNKKGKQGAYDDEEAAARAHDLAALKYWGPATVLNFPLCGYDEELREMEAQPREEYIGSLRRRSSGFSRGVSKYRGVARHHHNGRWEARIGRVLGNKYLYLATQEEAAVAYDIAAIEHRGLNAVTNFDISHYVNHWHRHCHGPSDDSLGVVVDDVAAFQLPDDLPECPAAAIGVEETTGGDAEFHNGEEGYLQHHTSGPFGAQQQLPDETGALAAHQMAPNSSALDMVLQSPKFKELMEQVSAAAAAVASESSIGGSMSSSSPSPSLSSFSPSPLQLPSPSSLSSFSPSSPLQQPSPPLQQPEFVEGAPAARCSFPDDVQTFFDFENESDMSFMYAEVDTFLFGDLGAYAAPIFHFDLDV

SEQ ID NO: 18852 - DNA, 1341 bp, Sorghum bicolor
  misc_feature: Ceres ANNOT ID no. 8713285
  misc_feature: Encodes the peptide sequence at SEQ ID NO 18853
atgacgaagcaagtggtggtggtggacaccgcgctggtggcgccaagcgaggagacgccgcggcagcctctgtggctgtccaacctcgacctggccgtgccgcggacgcacacgccgctcgtctactactacccggcaccggcgcagggcggcgccgccctgggcacgggctccttcgcgcccgaccggctgagggccgcgctggccgtcgctctggtgccattctacccactcgccggccggctcggtgttggcccggacggccggctgcagatcgagtgcaacagcaacggcgcgctcttcgtcgtcgccaacgcggacctcaccggcgccgacgtctttgacgactacgagccgtcggcggaggtcaggaacacttttgtgccggtagcggactccggcgatgcgaccagcagccccatggccatgttccaggtgacgttcctcaagtgcggcggcgtggtgctcggcacggccatccaccacgcggccatggacggcgtcggcgcgttccagttcatgcagacgtggtccggggtggcacgcggcctccaagtcgcggaggcgtgcgggccgcaggcgccgttccacgaccggaccctgctgcgggcgcggtgcccgccgtgcccgacctcggaccacttcgtctactccccggggttcctcagcgggcggccccgggcctacgtgacccgcgtgtacgccgtctcgccgaagctcctcgccgacgtcaagtcccgctgcgcgcccggcgtgtccacctactgcgccctcaccgcgcacctgtggcgctgcgtgtgcgtcgcgcgcgggctggcgcccggggccgacaccctgctcggcctgccagccaacgtccggcaccgcctgcggcccccgctaccgcgcaccttcttcgggaacgccgtcgtgcgcgacctcgtcaccgcccccgtcagcaccgtcctcgacagctcgctcgggtccgtggcggagaccatcaagaaggcggtggaccgcgtcgacgacgccttcgcgcggtcggtgctggactacctggagctgcagcagaataatgcaggcggcggcggccagcaggcccaggcggcgcaggcgcccagcagggagcagctcgtgccggcgacggatctgtgggcggtgagctggctggggatggccatgtacgacgccgacttcggcacgggcgcgccccggttcgtcgcgccggcgcagatgttcggcgtcggcacggcgtatatgacgccgcgcggtccggacagggacgacggcatcgccgtgctcatctcgctggagcccgagtacttgccgagctttgagaaggtcttcttctataacgagtga

SEQ ID NO: 18853 - protein, 446 aa, Sorghum bicolor
  misc_feature: Useful for making plants with altered carbohydrate content
  misc_feature: Functional homolog of the protein sequence given in SEQ ID NO 14310
  misc_feature: Ceres ANNOT ID no. 8713285
  misc_feature (5)..(443): SWISSPROT Homolog: EC 2.3.1.144 Anthranilate N-benzoyltransferase
  misc_feature (3)..(445): Pfam ID: Transferase Pfam Description: Transferase family
MTKQVVVVDTALVAPSEETPRQPLWLSNLDLAVPRTHTPLVYYYPAPAQGGAALGTGSFAPDRLRAALAVALVPFYPLAGRLGVGPDGRLQIECNSNGALFVVANADLTGADVFDDYEPSAEVRNTFVPVADSGDATSSPMAMFQVTFLKCGGVVLGTAIHHAAMDGVGAFQFMQTWSGVARGLQVAEACGPQAPFHDRTLLRARCPPCPTSDHFVYSPGFLSGRPRAYVTRVYAVSPKLLADVKSRCAPGVSTYCALTAHLWRCVCVARGLAPGADTLLGLPANVRHRLRPPLPRTFFGNAVVRDLVTAPVSTVLDSSLGSVAETIKKAVDRVDDAFARSVLDYLELQQNNAGGGGQQAQAAQAPSREQLVPATDLWAVSWLGMAMYDADFGTGAPRFVAPAQMFGVGTAYMTPRGPDRDDGIAVLISLEPEYLPSFEKVFFYNE

SEQ ID NO: 18854 - DNA, 225 bp, Sorghum bicolor
  misc_feature: Ceres ANNOT ID no. 8713322
  misc_feature: Encodes the peptide sequence at SEQ ID NO 18855
atgtacggcagcgtggaggaggaggaggagaacaagggtgtgaaggagaagaagttcaacggcagcctggagttggaggtgtacaaccagaacatgcttaagacagagctgtgcaataagtgggaggagattgtcgcatgctcgtatagtgaccagtgccagtttgtacatgacatcgttgagctttgccatattcgctttttgattcggctacaactcgtatag

SEQ ID NO: 18855 - protein, 74 aa, Sorghum bicolor
  misc_feature: Useful for making plants with altered lignin content
  misc_feature: Useful for making plants with altered terpenoid content
  misc_feature: Functional homolog of the protein sequence given in SEQ ID NO 12987
  misc_feature: The sequence is a functional homolog of SEQ ID NO 646 in the 10/666,642 US patent application
  misc_feature: Ceres ANNOT ID no. 8713322
  misc_feature (33)..(59): Pfam ID: zf-CCCH Pfam Description: Zinc finger C-x8-C-x5-C-x3-H type (and similar)
MYGSVEEEEENKGVKEKKFNGSLELEVYNQNMLKTELCNKWEEIVACSYSDQCQFVHDIVELCHIRFLIRLQLV

SEQ ID NO: 18856 - DNA, 1191 bp, Sorghum bicolor
  misc_feature: Ceres ANNOT ID no. 8713324
  misc_feature: Encodes the peptide sequence at SEQ ID NO 18857
atggcgtcgaggttacacgtctcgacgctatggatcacggcgtcgaggtccctggctgcgccagcgtggcttctgacgtggcagagacctcgacgccgtagatcatggcgtcgagctcgacgccatagatcacggcgtcgagctctctccaacctggaccagaacattgccgtcatcgtgcagaccgtgtactgcttcagggcggctgacgacggcggcgccggcagaagcagcgcctgcgacgtgctgagggagtcgctggcgaaggtgctcgtccactactacccgctcgctgggcggctggcgatctcagacgatgggaagctggtcgtggactgcacgggcgacggcgccgtgttcgtggaggccgaggcggactgcgccatggcggacatcggtgacgtcaccgaccccgacccctccgtcctcggcaggctcgtgtacagcgtccccggcgccaagaacatactcgagatgccgctgcttgcagcccaggtgaccaagttcaagtgtggcggcttcgtgctggggctggccatcaaccactgcatgttcgacggcgtcggcgccatgcagttcgtcaactcgtggggcgagacggcgcgcggcctcccgctgtcgctcccgccggccctcgaccgcgccgtcctccgtgcgcgcgacccgccgcaggtcgacttcccgcaccacgagttcacgcagatcaccgacgacgacgccgacgacggggaggacgaggaggactcggagtccccgctcctgcaccgctcgttccggttcacgccggcgtccatcgcgcgcctcaaggcggcggtgggggtgctggaggagggccgccgcgcgtgcaccacgttcgaggcgctggccgggttcgtgtggagcgcgcgcacgcgggcgctggggatgcgcccgtcgcgccggagcaagctgctgttcgcggtggacgggcggccgaggttctcgccgccgctccccgcggggtacttcggcaacgccatcgtgctgaccagcgcggcgtgccccgcgggggagctggcgtcgtcgctgccgcgcgccgtgcggctggttcgcggcgccgcggcggccgtgacggacgtctacatgcggtccgcggtggactacttcgaggcgacgcgcgcggggccgtcgctggcgtcgacactgctcatcacggcatgtagaactggatga

SEQ ID NO: 18857 - protein, 396 aa, Sorghum bicolor
  misc_feature: Useful for biocontainment applications
  misc_feature: Functional homolog of the protein sequence given in SEQ ID NO 14111
  misc_feature: Ceres ANNOT ID no. 8713324
  misc_feature (82)..(347): SWISSPROT Homolog: EC 2.3.1.162 Taxadien-5-alpha-ol O-acetyltransferase
  misc_feature (29)..(395): Pfam ID: Transferase Pfam Description: Transferase family
MASRLHVSTLWITASRSLAAPAWLLTWQRPRRRRSWRRARRHRSRRRALSNLDQNIAVIVQTVYCFRAADDGGAGRSSACDVLRESLAKVLVHYYPLAGRLAISDDGKLVVDCTGDGAVFVEAEADCAMADIGDVTDPDPSVLGRLVYSVPGAKNILEMPLLAAQVTKFKCGGFVLGLAINHCMFDGVGAMQFVNSWGETARGLPLSLPPALDRAVLRARDPPQVDFPHHEFTQITDDDADDGEDEEDSESPLLHRSFRFTPASIARLKAAVGVLEEGRRACTTFEALAGFVWSARTRALGMRPSRRSKLLFAVDGRPRFSPPLPAGYFGNAIVLTSAACPAGELASSLPRAVRLVRGAAAAVTDVYMRSAVDYFEATRAGPSLASTLLITACRTG

SEQ ID NO: 18858 - DNA, 1755 bp, Sorghum bicolor
  misc_feature: Ceres ANNOT ID no. 8713348
  misc_feature: Encodes the peptide sequence at SEQ ID NO 18859
atggcgtcgacgtcgacgtcgacgtttccgcgcgccacagcacctcagctcctcctcctcgtgctctccctgctgctggccgctgccagcgcctcgtccctgcttcctcccctgaacaatgcacacccgcagagaccttcgccggtggcgaaggcaagggaggaggagggcggcggcggctcggcggggctgatctcgacgctgcgcgagacgctggacgcgatcagggacgtggcgtccatcatctcgtcgttccccatcagcgtcggcggaggcatcctcgggggcggcgcaggcgacctccgcctgtcctccgccgtcgccgactgcctcgacctcctcgacctctcctccgacgagctgtcgtggtccatgtccacaaccacctcctcttcggacggctacagccccgccagcgccggggcgggggcgggggcgggtggccgcgtcgtcggcaccggcgacgaccggtccgacctgcggtcctggctgagcggcgcgctcgggaaccaggacacctgcaaggaaggcctggacgagaccggctccccgctggcctcgctcgtcgccacggggctcgacgccgtcacctcgctcctcgccgacggcctcggccaggtcgcggccgaggaagcagtcgcggccgaggaagcagtcgcggcgtcgtcggcctcctctcgccgcggcgcgctcggcgccgccgccccgccgccacggtgggtgcgcgcgagggagcggcggctgctgcagatgcccgtggggcccgggggcctggcggtggacgccgtggtggcgcaggacgggagcggcaacttcacgacggtgagcgcggccgtggatgcggcgccgtcgcagagcgcggcgcggcacgtgatctacgtgaagaagggcgtgtacagggagacggtggaggtgaagaagaagaagtggaacctgatgctggtcggcgacggcatgggcgtcacggtcatctccggccaccgcagctacgtcgacggctacaccacctaccgcagcgccaccgtcgctgtgagcggcaagggcttcatcgcgcgtgacctgacgttcgagaacacggcgggcccgtccaagcaccaggccgtggcgctgcggtgcgactcggacctctccgtcttctaccgctgcggcttcgagggctaccaggacacgctgtacgcgcactcgctccgccacttctaccgcgactgccgcgtcacgggcaccgtcgacttcgtcttcggcaacgccgccgccgtgttccagaactgctccctcctcccgcgccgcccgctccccgaccagaagaactccgtcaccgcgcagggcaggctcgacgccaacatgaccaccggattcgccttccagttctgcaacgtctccgcccaccccgagctcctcctcaacaacgccaccgccgccgccgcggctgcgccgccgacgcagacgcagacgtaccttggacggccgtggaagcagtactcgcgggtggtgttcatgcagtcctacatcggcgacctggtgcgcccagaggggtggctcgcgtgggacggggacttcgcgctcgacacgctctactacggggagtacagcaacaccggccccggcgccggcgtcgccgccagggtcaagtggccagggttccacgtcatgaccagcgccgccgaggccggcaacttcaccgtcgcgcagttcatcgagggcaacatgtggttgccgcccaccggcgtcaagtacaccgccggcctcacgtcctga

SEQ ID NO: 18859 - protein, 584 aa, Sorghum bicolor
  misc_feature: Useful for making plants with altered carbohydrate content
  misc_feature: Functional homolog of the protein sequence given in SEQ ID NO 14329
  misc_feature: Useful for making plants with altered cell wall content and/or composition
  misc_feature: Functional homolog of the protein sequence given in SEQ ID NO 14330
  misc_feature: Useful for making plants with modulated time to senescence
  misc_feature: Functional homolog of the protein sequence given in SEQ ID NO 14413
  misc_feature: Ceres ANNOT ID no. 8713348
  misc_feature (257)..(580): SWISSPROT Homolog: EC 3.1.1.11 Pectinesterase
  misc_feature (261)..(568): Pfam ID: Pectinesterase Pfam Description: Pectinesterase
  misc_feature (4)..(206): Pfam ID: PMEI Pfam Description: Plant invertase/pectin methylesterase inhibitor
MASTSTSTFPRATAPQLLLLVLSLLLAAASASSLLPPLNNAHPQRPSPVAKAREEEGGGGSAGLISTLRETLDAIRDVASIISSFPISVGGGILGGGAGDLRLSSAVADCLDLLDLSSDELSWSMSTTTSSSDGYSPASAGAGAGAGGRVVGTGDDRSDLRSWLSGALGNQDTCKEGLDETGSPLASLVATGLDAVTSLLADGLGQVAAEEAVAAEEAVAASSASSRRGALGAAAPPPRWVRARERRLLQMPVGPGGLAVDAVVAQDGSGNFTTVSAAVDAAPSQSAARHVIYVKKGVYRETVEVKKKKWNLMLVGDGMGVTVISGHRSYVDGYTTYRSATVAVSGKGFIARDLTFENTAGPSKHQAVALRCDSDLSVFYRCGFEGYQDTLYAHSLRHFYRDCRVTGTVDFVFGNAAAVFQNCSLLPRRPLPDQKNSVTAQGRLDANMTTGFAFQFCNVSAHPELLLNNATAAAAAAPPTQTQTYLGRPWKQYSRVVFMQSYIGDLVRPEGWLAWDGDFALDTLYYGEYSNTGPGAGVAARVKWPGFHVMTSAAEAGNFTVAQFIEGNMWLPPTGVKYTAGLTS

SEQ ID NO: 18860 - DNA, 1881 bp, Sorghum bicolor
  misc_feature: Ceres ANNOT ID no. 8713349
  misc_feature: Encodes the peptide sequence at SEQ ID NO 18861
atgtcgacggccttctccgacttcggtccgctcacggagcggcggcgcgtcgagaggcagcggcagcagcgtaggcgcgtcatgctcgccgccggcgccgcgtcgatcgtgcttatcctcattgtcatgggcggcgccgccgtcgcgtacaacgccagcgtccaagacgagtcgtcctcgtcatcctcgtccccttcctcctcctcctcctccggcggcggcggcggcggctcgggttctaagtcgaaccttatcagcgcgtccaagagcgtcaagatgatgtgctcgcagacagactacaaggacgcctgcgagaagagcctgtccaaggcggcggcggcggcgaacgccagcgcgtcgtcgcccaaggacatggtccgagccgccgtggcggtgatcggcgacgccctggcggacgcgttcaaccggtcggaggtgatcaagagcgacgacccgcgcgtgaaggccgccgtcgcggactgcaaggagatctaccagaacgccaaggacgacctcgggcgcacgctccacggcatcgacgccggcggcatgaacggggtcgccaagcacaactacgagctccgcgtcttgctcagcgccgtgatcgcgcacatggagacgtgcatcgacggcttccccgacggcgggcacctcaagaagcagatgactgccacgatggagtccggcaaggagctgaccagcaacgcgctggccatcatcgagaaggcctcgtcggttctcgtcgcgctccacatcccagggttcaccgcccaccggaggttacttggcgacaacgacgaagcagaaaacatggagaatcaacctgaagtgaaacactcgggtatgtccctgggcgagctcgaagacgaagccatggcagccgacaagcggaggctgctcaagggcaacaacttccaggccaaactcaggcccaacgtggtggtggccaaggacggcagcggcaagttcaagaccatcaacgacgcgctcaatgccatgcccaagcagtacaccggaaggtacctgatctacgtgaagcaaggggtgtaccaggagtacgtgaccatcaccagggcgatggagaacgtgaccatgtacggcgacggcgccatgaagaccgtcatcaccggcagccggaacttcgccgacggcctcaccacctacaaaaccgcaaccttcaacgtgcaaggcgacgggttcatcgccatcgcgctggggttccggaacacggcgggcgcggcgaagcaccaggcggtggcgctgctggtgcagtcggacaggtccatcttcctcaactgccgcatggacgcgtaccaggacacgctgtacgcgcactccaaggcgcaattctaccgcaactgcgtcatctccgggaccatcgacttcgtcttcggcgacgcggcggcggtgttccagaactgcatcctgctcctccggcggccgctggacagtcagcagaacatcgcgacggcgcagggccgcgccgacggccgcgagagcacgggcttcgtcttccagtactgccgcttcgccgccgaggcggggctcagggacgcgtcccgcccgcccatccggagctacctcgcccggccatggcgggagttctcgcgcacgctcatcatggagtcggagatcccggccttcatcgacaaggcagggtacctgccgtggaacggcgacttcgggctcaagacgctgtggtacgccgagtacggcaacaggggccccggcgccgacaccgccggccgcgtcgcctggcctgggtacaagaaggtgatcagcaaggaggaggccgacaagttcaccgtgcagaacttcttgcacgccgagccgtggctcaagcccacggggacgccggtgaagtacggcttctgggcgtga

SEQ ID NO: 18861 - protein, 626 aa, Sorghum bicolor
  misc_feature: Useful for making plants with altered cell wall content and/or composition
  misc_feature: Functional homolog of the protein sequence given in SEQ ID NO 14312
  misc_feature: Ceres ANNOT ID no. 8713349
  misc_feature (290)..(613): SWISSPROT Homolog: EC 3.1.1.11 Pectinesterase
  misc_feature (312)..(610): Pfam ID: Pectinesterase Pfam Description: Pectinesterase
  misc_feature (85)..(239): Pfam ID: PMEI Pfam Description: Plant invertase/pectin methylesterase inhibitor
MSTAFSDFGPLTERRRVERQRQQRRRVMLAAGAASIVLILIVMGGAAVAYNASVQDESSSSSSSPSSSSSSGGGGGGSGSKSNLISASKSVKMMCSQTDYKDACEKSLSKAAAAANASASSPKDMVRAAVAVIGDALADAFNRSEVIKSDDPRVKAAVADCKEIYQNAKDDLGRTLHGIDAGGMNGVAKHNYELRVLLSAVIAHMETCIDGFPDGGHLKKQMTATMESGKELTSNALAIIEKASSVLVALHIPGFTAHRRLLGDNDEAENMENQPEVKHSGMSLGELEDEAMAADKRRLLKGNNFQAKLRPNVVVAKDGSGKFKTINDALNAMPKQYTGRYLIYVKQGVYQEYVTITRAMENVTMYGDGAMKTVITGSRNFADGLTTYKTATFNVQGDGFIAIALGFRNTAGAAKHQAVALLVQSDRSIFLNCRMDAYQDTLYAHSKAQFYRNCVISGTIDFVFGDAAAVFQNCILLLRRPLDSQQNIATAQGRADGRESTGFVFQYCRFAAEAGLRDASRPPIRSYLARPWREFSRTLIMESEIPAFIDKAGYLPWNGDFGLKTLWYAEYGNRGPGADTAGRVAWPGYKKVISKEEADKFTVQNFLHAEPWLKPTGTPVKYGFWA

SEQ ID NO: 18862 - DNA, 1548 bp, Sorghum bicolor
  misc_feature: Ceres ANNOT ID no. 8713405
  misc_feature: Encodes the peptide sequence at SEQ ID NO 18863
atggagctaccagtaccaccactgttactcacctgccttgccatggtgctcgccatcgtgatcctccgccgcacactgaaaggcaagccccgccgtgtttaccgcctcccgccgggtccaagaccatggcctatcatcggcaacttcaacctgatcggcgcgctcccacaccgctccatccacgagctctccaaaaagtacggcgagctcatgcacctccgcttcggctcctactccgtcgtcgtcggctcgtcggccgacatggcgaagctgttcctcaagacccatgacctgctcttcctggaccgccccaagacggccgccggcaagcacaccacctacaactacggcgacatcacgtggtcgccctacggcgcgtactggcgccacgcgcgacgcatctgcgccacccagctgttcagccctggccgcctcgcgtcgttcgagcacatccgcgccgacgaggtgcgctcgctcgtgcgcggcctcttcgcggcgtcggcgtcggcgtcggggtcgggttgcgccgtgcggctcaacaaggaccacctgtacacgctcagcatgaacgtgatcacacggatggtgctgggcaagcggctcttcgacggcggcggagacgacgacgacgacgtggcggaggggccggtctcgtcgctggccgacttcaagtggatgatggacgagctgctgctggtgaacggcgtgctcaacatcggcgactggattccatggctggactggctcgacttgcaaggctacatgcggaggatgaagaggatcggaaagaggttcagcgagttcatagactacatcctcgacgagcacgacgatcgtcggcgacgcgagggcgagagcttcgtggcgcgggacatggtggacgtgctgatgcagctcgcagacgatcccaccttcgacgtccagatcggccgcgttggtgtgaaggcgttcacgcaggacctcatcgttggtggctctgaaagcacggccgtcaccgtggagtgggccatctcggagctcctcaggaagccctccctctttgccatggccaccgaggagctcgaccgtgtcgtcggccatggtcgctgggtcactgagaaggacatagctcatctcccctacctccagtccattgtaaaggaaaccatgcgcttgcaccccatcgtgccgctgctcattccacgcgttactcgtgaggacgcttccattgccggctacgacattcctaagggcacatgcgttcttatcaacgtgtggactatgacccggccggagaggttcgtcgggagcaagatcgacgtgaaagggcaggatttcgagctgctgccgttcgggtccggccgacggatgtgccctggttacaaccttgggctgaaggagatacaactgaccttggccaaccttctccatgggtttacttggagtctgccggagggtatggcgaaggaggatctgagcatggacgaagtcttcgggctatcgaccacgcgcaagctcccgctcgaggttatcgtccaaccaaggctccctgctgaactctacgcatga

SEQ ID NO: 18863 - protein, 515 aa, Sorghum bicolor
  misc_feature: Useful for making plants with altered carbohydrate content
  misc_feature: Functional homolog of the protein sequence given in SEQ ID NO 14183
  misc_feature: Ceres ANNOT ID no. 8713405
  misc_feature (8)..(514): SWISSPROT Homolog: EC 1.14.13.21 Flavonoid 3'-monooxygenase
  misc_feature (37)..(505): Pfam ID: p450 Pfam Description: Cytochrome P450
MELPVPPLLLTCLAMVLAIVILRRTLKGKPRRVYRLPPGPRPWPIIGNFNLIGALPHRSIHELSKKYGELMHLRFGSYSVVVGSSADMAKLFLKTHDLLFLDRPKTAAGKHTTYNYGDITWSPYGAYWRHARRICATQLFSPGRLASFEHIRADEVRSLVRGLFAASASASGSGCAVRLNKDHLYTLSMNVITRMVLGKRLFDGGGDDDDDVAEGPVSSLADFKWMMDELLLVNGVLNIGDWIPWLDWLDLQGYMRRMKRIGKRFSEFIDYILDEHDDRRRREGESFVARDMVDVLMQLADDPTFDVQIGRVGVKAFTQDLIVGGSESTAVTVEWAISELLRKPSLFAMATEELDRVVGHGRWVTEKDIAHLPYLQSIVKETMRLHPIVPLLIPRVTREDASIAGYDIPKGTCVLINVWTMTRPERFVGSKIDVKGQDFELLPFGSGRRMCPGYNLGLKEIQLTLANLLHGFTWSLPEGMAKEDLSMDEVFGLSTTRKLPLEVIVQPRLPAELYA

SEQ ID NO: 18864 - DNA, 1593 bp, Sorghum bicolor
  misc_feature: Ceres ANNOT ID no. 8713407
  misc_feature: Encodes the peptide sequence at SEQ ID NO 18865
atggagctaccaccaccactgttactcaccagctttgccatggtgctcgccatcgtgattttcggccgcagactgaaaggcaggccgtcccgtcgtgtctatcgccttccgccgggtccgagcccatggcctgtgatcggcaacttcaacctgatcggcgcgctcccgcatcgctccatccacgagctttccaagaagtacggcgagctcatgcacctccgcttcggctcctacaccgtcgtcgtcgcctcgtcggccgagatggccaagctgttccttaagacccatgacctgctcttcctggaccgccccaggacggccgccggcaggcacaccacctacaactacggcgacatcacgtggtcgccctacggcgcgtactggcgccacgcgcgccgcatctgcgccacccagctgttcatccccggccgcctcgcgtcgttcgagcacatccgcgccgacgaggtgcgctcgctcgtgcgcggcctcttcgcggcgtcggcgtcgggccgcgccgtgcgcctcggcaaggaccacctgtccacgtttagcatgaacgtgatcacgcggatggtgctgggcaagcggctcttcgacgccgccggcggggagaacgcggcggcggaggggccggtgtcgtcgctgcccgagttcatgtggatgatggatgagctgatgctgctcaacggcgtgctcaacatcggcgactggatcccatggctggacaggctcgacctgcaagggtacgtgcggaggatgaagagggtcgcggagaggtttgacgcgttcttagagcacgtcctcgacgcgcacagccagcaccagcagcggcggcacgagcgcgacggcgagagcttcgtggcgcgggacatggacatggtggacgtgctgatgcagctcgcggatgaccccaccttcgacgtccagatcggccgcgtaggtgtgaaggcgttcacgcaggacctcatcgtcggtggctctgaaagcacggccgtcaccgtggagtgggccatgtcggagctcctgaggaacccgtctgtcctcgccatggccgccgaggagctggacagagtcgtcggccgcggccgctgggtgacggagaaggacgtagcccatgatctcccctacctccaagctgttatcaaggagaccatgcgcgtgcaccccgtcgcgcctctcctgcccccgcacgtcgcccgcgaggacgcttccattgccggctacgacattcccaagggcacacacgtcctcatcaacgtgtggacaatcggcagggacccggctgtgtgggacgcgccggaggagttcaggccggagaggttcgtcgggagcaaggtcgacgtgaaagggcaggatttcgagctgctgccgttcgggtccggccggcggatgtgccctggttacaacctggggctgaaggagatacagctgagcttggctaacttactccacgggtttacttggaggctgccggagggtatggtgaaggaggaggatctgagcatggacgagttgttcgggctatccaccacgcgcaagttcccgctcgaggtcatcgtccagcccaggctcccttctgaactctatgcatga

SEQ ID NO: 18865 - protein, 530 aa, Sorghum bicolor
  misc_feature: Useful for making plants with altered carbohydrate content
  misc_feature: Functional homolog of the protein sequence given in SEQ ID NO 14183
  misc_feature: Ceres ANNOT ID no. 8713407
  misc_feature (36)..(529): SWISSPROT Homolog: EC 1.14.13.21 Flavonoid 3'-monooxygenase
  misc_feature (37)..(518): Pfam ID: p450 Pfam Description: Cytochrome P450
MELPPPLLLTSFAMVLAIVIFGRRLKGRPSRRVYRLPPGPSPWPVIGNFNLIGALPHRSIHELSKKYGELMHLRFGSYTVVVASSAEMAKLFLKTHDLLFLDRPRTAAGRHTTYNYGDITWSPYGAYWRHARRICATQLFIPGRLASFEHIRADEVRSLVRGLFAASASGRAVRLGKDHLSTFSMNVITRMVLGKRLFDAAGGENAAAEGPVSSLPEFMWMMDELMLLNGVLNIGDWIPWLDRLDLQGYVRRMKRVAERFDAFLEHVLDAHSQHQQRRHERDGESFVARDMDMVDVLMQLADDPTFDVQIGRVGVKAFTQDLIVGGSESTAVTVEWAMSELLRNPSVLAMAAEELDRVVGRGRWVTEKDVAHDLPYLQAVIKETMRVHPVAPLLPPHVAREDASIAGYDIPKGTHVLINVWTIGRDPAVWDAPEEFRPERFVGSKVDVKGQDFELLPFGSGRRMCPGYNLGLKEIQLSLANLLHGFTWRLPEGMVKEEDLSMDELFGLSTTRKFPLEVIVQPRLPSELYA

SEQ ID NO: 18866 - DNA, 456 bp, Sorghum bicolor
  misc_feature: Ceres ANNOT ID no. 8713419
  misc_feature: Encodes the peptide sequence at SEQ ID NO 18867
atggcgcccaaggccgagaagaaacccgcggcgaagaagctggcggaggaggagcccgcggccgagaaggcgccggccgggaagaagcccaaagcggagaagcgtctgcccgctggcaagtccgccggcaaggagggcggcggcgagggcaagcggggccggaagaagggcaagaagagcgtggagacgtacaagatctacatcttcaaggtgctgaagcaggtgcacccggacatcggcatctcctccaaggccatgtccatcatgaactccttcatcaacgacatcttcgagaagctcgccgccgaggccgccaagctcgcgcggtacaacaagaagcccaccatcacctcccgcgagatccagacctccgtccgcctcgtcctccccggggagctcgcgaagcacgccgtctctgagggcaccaaggccgtcaccaagttcacctcgtcctag

SEQ ID NO: 18867 - protein, 151 aa, Sorghum bicolor
  misc_feature: Useful for biocontainment applications
  misc_feature: Useful for making plants with modulated flowering time
  misc_feature: Functional homolog of the protein sequence given in SEQ ID NO 13102
  misc_feature: Ceres ANNOT ID no. 8713419
  misc_feature (58)..(128): Pfam ID: Histone Pfam Description: Core histone H2A/H2B/H3/H4
MAPKAEKKPAAKKLAEEEPAAEKAPAGKKPKAEKRLPAGKSAGKEGGGEGKRGRKKGKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 18868 - DNA, 1437 bp, Sorghum bicolor
  misc_feature: Ceres ANNOT ID no. 8713431
  misc_feature: Encodes the peptide sequence at SEQ ID NO 18869
atgtctgcgacgacgacgcagccgtggaggtcgctgctctgctgcgtgagcggcgcggtctcgggcgacgacgacgggccgtcgccgagtcgtcggagaggcagccgcaggagcaggagggaccggggcgagcgcctccttctgctgccgtcgtcatcagcgtcgcgggtgtcgctgtcgagcctcagctcatcgggaacgctcaccccggaggacctgtccctcaccttgtccggctccaacctgcacgccttcacgtacgccgagctcagggccgtcaccgcggggttctcccgcgccaactacctgggatccggcgggttcggccccgtctacaggggccgcgtcgacgccggcctccgcaaagggctggacgcgcagcaggtggccgtcaagtacctcgacctcgactgcggcacgcagggacaccgcgagtggctcgccgaggtcttcttccttggccagctccgccacgacaacctcgtcaagctcgtcggctactgctacgaggacgaccaccggatgctcgtgtacgagtacatgagcaaccagagcctcgagaagcatctcttcagaagtctcgacggctccatgccatggatgaggaggatgaagatcgccgtcggcgcggccaagggcctcgctttcctccacgacgctgacacgccggtgatctaccgggacttcaaggcctccaacatcctgcttgacgaggactacaacaccaagttgtcggactttgggcttgccaaggatgggcctcagggcgacgcgacccatgtcacaacacgcgtgatggggacgaacggatacgcggcgccggagtacatcatgacaggccacctgactgccaagagcgacgtctacagcttcggggtagtgctcctggagctcctgacaggtcggcggtccgttgatcgggctcggcggcccagggagcagagcctggtggactgggccaggccctacctcaagaagcccgacaagctctaccgtgtcatggacccggccatggagtgtcagtactcgtgccaaggggccgaacgcgctgccatggtggcgtacaagtgcctgagccagaaccccaagtctagacccaccatgagggaggtggtccaggccctggagcccgttctcaacatgaatgactacctccaagttggcccgtttgtgttcaccgtcatactggaagatggcaacggtgaaggcaaggttgttgacgggaagaaggtcgacgtcacgatagagacgactgtggaggagaaacaccaccaccagagccaccaagaccggcaccgacagaagttccccaactcggcgatccacgctgacgtggtgctgcaccgggaccgggacggcggcgagctcgggacgcacattagcgcgctacggcggcaccggaggacatccagctacgtcaaggacagaggggcgtag

SEQ ID NO: 18869 - protein, 478 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8713431
  misc_feature (77)..(383): SWISSPROT Homolog: EC 2.7.11.1 Non-specific serine/threonine protein kinase
  misc_feature (97)..(375): Pfam ID: Pkinase Pfam Description: Protein kinase domain
MSATTTQPWRSLLCCVSGAVSGDDDGPSPSRRRGSRRSRRDRGERLLLLPSSSASRVSLSSLSSSGTLTPEDLSLTLSGSNLHAFTYAELRAVTAGFSRANYLGSGGFGPVYRGRVDAGLRKGLDAQQVAVKYLDLDCGTQGHREWLAEVFFLGQLRHDNLVKLVGYCYEDDHRMLVYEYMSNQSLEKHLFRSLDGSMPWMRRMKIAVGAAKGLAFLHDADTPVIYRDFKASNILLDEDYNTKLSDFGLAKDGPQGDATHVTTRVMGTNGYAAPEYIMTGHLTAKSDVYSFGVVLLELLTGRRSVDRARRPREQSLVDWARPYLKKPDKLYRVMDPAMECQYSCQGAERAAMVAYKCLSQNPKSRPTMREVVQALEPVLNMNDYLQVGPFVFTVILEDGNGEGKVVDGKKVDVTIETTVEEKHHHQSHQDRHRQKFPNSAIHADVVLHRDRDGGELGTHISALRRHRRTSSYVKDRGA

SEQ ID NO: 18870 - DNA, 1470 bp, Sorghum bicolor
  misc_feature: Ceres ANNOT ID no. 8713429
  misc_feature: Encodes the peptide sequence at SEQ ID NO 18871
atgtctgcgacgacgcggcagccgtggaggtcgctgctctgctgcgtgagcggcggcggcgcggtttcgggcgacgacgacgtgccgtcgccgagtcagcagcggcgaaggagcaccaaccgcaggaggagggaccggggggagcgtctcctgctgcttccgtcctcgacgtcggcgtcgcgggtgtcgctgtcgagcctcagctcatcggggacgctcaccccggaggacctgtccctgacgctgtccggctccaacctgcacgccttcacgtacgccgagctcagggccgtcacggcgggcttctcccgcgccaactacctgggatccggcgggttcggccccgtctaccggggccgcgtcgacgccggcctccgcaaggggctggacgcgcagcaggtggccgtcaagtacctcgacctcgactgcggcacgcagggacaccgcgagtggctcgccgaggtcttcttccttggccagctccgccacgacaacctcgtcaagctcgtcgggtactgctacgaggacgaccaccggatgctcgtgtacgagtacatgagcaaccagagcctcgagaaacatctcttcagaagtctcgacggctccatgccatggatgaggaggatgaagatcgccgtcggcgcggccaagggcctcgccttcctccacgacgctgacacgccggtgatctaccgggacttcaaggcctccaacatcctgcttgacgaggactacaacaccaagttgtcggactttgggctggccaaggacgggcctcagggcgacgcgacccatgtcacgacacgtgtcatgggcaccaacggatatgcggcgccggagtacatcatgacgggccacttgacggccaagagtgacgtctacagcttcggggtggtgcttctagagctcttgacgggtcgtcggtctgtcgaccgggctcggcggccaagggagcaaagcctggtggactgggccaggccctacctcaagaagctcgacaagctctaccgggtcatggacccagccatggagtgccagtactcgtgccgaggcgccgaacgcgctgcgatggtggcgtacaagtgcctgagccagaaccctaagtctagacccaccttgagggaggtggtccaggccctggagcccgtgctagacatggatgactacctccagattggcccatttgttttcaccgtcgtagtggaagacaacggcgacaggagcaaggagagcggaggcaaggttgttgacagagagaaggtcgacatgacgatagagacgacggtggaggagaaaaagcagcaccagatgagccataaggaccggcgctggcagaagttcccaaactcgacggtccacgctgacatggtgcttcaccgggaccgggacgacggcgaacttgggccgcacattagggcgctgcggcggcaccggaggacgtccagctacgtcaaggaaagaggggcgtag

SEQ ID NO: 18871 - protein, 489 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8713429
  misc_feature (82)..(388): SWISSPROT Homolog: EC 2.7.11.1 Non-specific serine/threonine protein kinase
  misc_feature (102)..(380): Pfam ID: Pkinase Pfam Description: Protein kinase domain
MSATTRQPWRSLLCCVSGGGAVSGDDDVPSPSQQRRRSTNRRRRDRGERLLLLPSSTSASRVSLSSLSSSGTLTPEDLSLTLSGSNLHAFTYAELRAVTAGFSRANYLGSGGFGPVYRGRVDAGLRKGLDAQQVAVKYLDLDCGTQGHREWLAEVFFLGQLRHDNLVKLVGYCYEDDHRMLVYEYMSNQSLEKHLFRSLDGSMPWMRRMKIAVGAAKGLAFLHDADTPVIYRDFKASNILLDEDYNTKLSDFGLAKDGPQGDATHVTTRVMGTNGYAAPEYIMTGHLTAKSDVYSFGVVLLELLTGRRSVDRARRPREQSLVDWARPYLKKLDKLYRVMDPAMECQYSCRGAERAAMVAYKCLSQNPKSRPTLREVVQALEPVLDMDDYLQIGPFVFTVVVEDNGDRSKESGGKVVDREKVDMTIETTVEEKKQHQMSHKDRRWQKFPNSTVHADMVLHRDRDDGELGPHIRALRRHRRTSSYVKERGA

SEQ ID NO: 18872 - DNA, 657 bp, Sorghum bicolor
  misc_feature: Ceres ANNOT ID no. 8713464
  misc_feature: Encodes the peptide sequence at SEQ ID NO 18873
atggccatggccgtgctcctgctcctagcccttgttgcgcccttggtttccctgcttccatcctcctccggcgccctgaaccaggacttctgcatcgccgacctggcccgcggcgacacgccggccgggtatccgtgcaagccccagacgggcgtcaccgccgacgacttctactaccgcggcctcaacagcacgggcccgaccatcaaccccttcaacatcggcctgtcgtcggcgttcgtcacccggttccccggcgtgaacgggctgggcatctcggcggcgcgcgtggacttcgccccgggcggcgtcgtgcctctgcactcgcacccgggcggcaccgagctcctgttcgtcatcgagggcgccatgtccgccggattcatcagctccctgaccaaccaggtgttcgtcaagacgctgtacaagggcgacctcatggtgttcccgcagggcctgctgcacttccagtacaacctggccggcaacgacacggcggtggccctgtcttcctacagcagcgccaaccccgggctgatgatcctggacttcgcgctcttcgccaacaacctgccgtcggacgtcgtgagcaaggtcaccgtcgtggacgaattggaggtcaggaagctcaaggcactcttcggcgggagcggctag

SEQ ID NO: 18873 - protein, 218 aa, Sorghum bicolor
  misc_feature: Useful for making plants with modulated nitrogen use efficiency
  misc_feature: Functional homolog of the protein sequence given in SEQ ID NO 14675
  misc_feature: Ceres ANNOT ID no. 8713464
  misc_feature (28)..(214): SWISSPROT Homolog: EC 1.15.1.1 Superoxide dismutase
  misc_feature (60)..(208): Pfam ID: Cupin_1 Pfam Description: Cupin
MAMAVLLLLALVAPLVSLLPSSSGALNQDFCIADLARGDTPAGYPCKPQTGVTADDFYYRGLNSTGPTINPFNIGLSSAFVTRFPGVNGLGISAARVDFAPGGVVPLHSHPGGTELLFVIEGAMSAGFISSLTNQVFVKTLYKGDLMVFPQGLLHFQYNLAGNDTAVALSSYSSANPGLMILDFALFANNLPSDVVSKVTVVDELEVRKLKALFGGSG

SEQ ID NO: 18874 - DNA, 1209 bp, Sorghum bicolor
  misc_feature: Ceres ANNOT ID no. 8713459
  misc_feature: Encodes the peptide sequence at SEQ ID NO 18875
atggcgtccacggatcgctccacgccggcggaggaccagcagcagcagcagccgcagcgcccgtccctcttctcgccgtaccagatgccccgcttccgtctcgctcaccgggtggtgctggcgccgatgaccaggtgcagggcgcccgacgcgatcccgggccccgcgctcgcggagtactacgcgcagcggtccacggaaggcggcttgctcatctccgagggcaccatcatctcgccctccggccctgggttccctcgtgtccctgggatatacaatcaagagcagactgatgcatggagaaaggtggttgatgctgttcatgccaagggagctatttttttctgccaactatggcatgtagggagagcttctcaccaagtatatcagccgggtggtgctgctccaatatcctcaactgataagccaatatcatcaagatggaggatactgatgcccgatggatcctatggcaagtatccaactccgacgcgcctagccacatccgagataccagaaattgttgaacagtatcggcaagctgccataaacgccatcaaagcaggtttcgatggcattgagatccacggcgcccatggctatctcatcgatcagttcctcaaggacggtatcaacgagcggactgacgagtacggtggctcactctccaaccgttgccggttcctcctggaggtgacccgagccgtggtctctgccataggtgcagaccgcgtcgcggtccgcgtgtccccggccatcgaccatctcgacgcctacgactccaaccccctgcagctcggcttggccgtggtggaccgtctcaacgctctccagcaggaggtggggcggctgctggcctacttccacgtgacgcagccacggtacacggcgtacgggcagacggagtccggccagcacgggagtgccgaggaggagagccggctgatgcgtgccctgcggggtgcctaccgtggcacgttcatgtgcagcggcgggtacacgcgggagctcggcgtggaggccgtcgagtccggggacgccgacctggtgtcgtacgggcggctgttcatcgcgaacccggacctggtggagcggtttcggcgcgacgccccgctgaacaaatacgtgcgcaagacgttctacaccccggaccccgtcgtcggttacacggactacccattcctcggccagcctaaggcgcgcatgtga

SEQ ID NO: 18875 - protein, 402 aa, Sorghum bicolor
  misc_feature: Useful for making plants with modulated water use efficiency
  misc_feature: Functional homolog of the protein sequence given in SEQ ID NO 13609
  misc_feature: Ceres ANNOT ID no. 8713459
  misc_feature: Up-regulated in root tissues in response to aminocyclopropane carboxylic treatment
  misc_feature: Up-regulated in root tissues in response to methyl jasmonate treatment
  misc_feature: Up-regulated in shoot tissues in response to aminocyclopropane carboxylic treatment
  misc_feature: Up-regulated in shoot tissues in response to methyl jasmonate treatment
  misc_feature: Up-regulated in shoot tissues in response to salicylic acid treatment
  misc_feature (23)..(395): SWISSPROT Homolog: EC 1.3.1.42 12-oxophytodienoate reductase
  misc_feature (22)..(373): Pfam ID: Oxidored_FMN Pfam Description: NADH:flavin oxidoreductase / NADH oxidase family
MASTDRSTPAEDQQQQQPQRPSLFSPYQMPRFRLAHRVVLAPMTRCRAPDAIPGPALAEYYAQRSTEGGLLISEGTIISPSGPGFPRVPGIYNQEQTDAWRKVVDAVHAKGAIFFCQLWHVGRASHQVYQPGGAAPISSTDKPISSRWRILMPDGSYGKYPTPTRLATSEIPEIVEQYRQAAINAIKAGFDGIEIHGAHGYLIDQFLKDGINERTDEYGGSLSNRCRFLLEVTRAVVSAIGADRVAVRVSPAIDHLDAYDSNPLQLGLAVVDRLNALQQEVGRLLAYFHVTQPRYTAYGQTESGQHGSAEEESRLMRALRGAYRGTFMCSGGYTRELGVEAVESGDADLVSYGRLFIANPDLVERFRRDAPLNKYVRKTFYTPDPVVGYTDYPFLGQPKARM

SEQ ID NO: 18876 - DNA, 462 bp, Sorghum bicolor
  misc_feature: Ceres ANNOT ID no. 8713496
  misc_feature: Up-regulated in root tissues in response to aminocyclopropane carboxylic treatment
  misc_feature: Up-regulated in root tissues in response to methyl jasmonate treatment
  misc_feature: Up-regulated in shoot tissues in response to aminocyclopropane carboxylic treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 18877
atggtggttagcgtggccgcgacggggcccggcacggacgccgagccggtgagctccaccaccttcgcgtcccgctacgtccgcgacccactcccacggtaccggatgccggagcggtcgatcccgcgggaggcggcgtaccagatcatcagcgacgagctgatgctggacggcaacccgaggctgaacctggcgtccttcgtcaccacgtggatggagcccgagtgcgacaagctcatcatggactccgtcaacaagaactacgtcgacatggacgagtaccccgtcaccaccgagctccagttatacatggcaaggttctgtcggtcttttgctgccgcgtccatcctatttccatatgaagtcatggatatgtccaaatggagcctcaaaactcagaagtgcccagtacttgccaggaatggaaagggtctgaccaccccaagtccccacgcattttag

SEQ ID NO: 18877 - protein, 153 aa, Sorghum bicolor
  misc_feature: Useful for making plants with modulated nitrogen use efficiency
  misc_feature: Functional homolog of the protein sequence given in SEQ ID NO 14115
  misc_feature: Ceres ANNOT ID no. 8713496
  misc_feature (20)..(101): SWISSPROT Homolog: EC 4.1.1.15 Glutamate decarboxylase
MVVSVAATGPGTDAEPVSSTTFASRYVRDPLPRYRMPERSIPREAAYQIISDELMLDGNPRLNLASFVTTWMEPECDKLIMDSVNKNYVDMDEYPVTTELQLYMARFCRSFAAASILFPYEVMDMSKWSLKTQKCPVLARNGKGLTTPSPHAF

SEQ ID NO: 18878 - DNA, 1149 bp, Sorghum bicolor
  misc_feature: Ceres ANNOT ID no. 8713486
  misc_feature: Encodes the peptide sequence at SEQ ID NO 18879
atggagctgcggctgagcctgggcgaggcggcagtgccggacgcagggagggcggcggtgccggagctgggccttgggcttggggtcgggattggagccagcgccgccgccggaagcggaaggcgtgaggagggcgggacggggaacagggcagcgccggggacggggacgggaacgggaacgaggtggtgggcggcgccggccacgcctgagccggcggcggtgcggctcagcctcgtgtccagcagcctcggccttcagtggccgccttccgacgccggcatctgtcatgcagggcgtgccgaggcgccggcggcgcgcgggttcgacgtgaaccggccggcgccgtcgtcgtcggcggtggcggcgagcgctctgctggcgctggaggacgacgaggacgacccgggcgcggcggcggcgctgtcgtcgtcgcccaacgacagcgcgggctccttcccgctggacctgggtggtggcccgcatgcccatcacgccgagggcggcgccgcggcgcaggccgccggcggcggcggcgagcggtcgtcgtctcgcgcgagcgatgaggacgacggcgcgtccgcgcgcaagaagctgcgactctccaaggagcagtccgcgttcctggaggagagcttcaaggagcacagcaccctcaaccctaagcagaaggcggcgctggcgaagcagctcaacctccggccgcgacaggtggaagtctggttccagaaccgccgagccaggacgaagctgaagcagacggaggtggactgcgagtacctgaagcgctgctgcgagacgctgacggaggagaaccggcggctgcacaaggagctggcggagctgcgcgcgctcaaggcggcgccgcccttcttcatgcggctcccggccaccaccctgtccatgtgcccctcctgcgagcgcgtcgcctccgggcccaaccctgctgcctccacctcggcacctgtgtcactgtcatcatcctcgccgcctgccacagccaccgccaccgccgtcgccgcacccgtcgtgcgaggcgagcaccggccgccctcgtcattcgccgcgctgttcgcggccacacgcagcttcacgctggcatcccagcctcggccgccggcgccggcaccggccagcaactgcttgtaa

SEQ ID NO: 18879 - protein, 382 aa, Sorghum bicolor
  misc_feature: The sequence is a functional homolog of SEQ ID NO 254 in the 10/412,699 US patent application
  misc_feature: The sequence is a functional homolog of SEQ ID NO 550 in the 11/479,226 US patent application
  misc_feature: The sequence is a functional homolog of SEQ ID NO 1674 in the 10/374,780 US patent application
  misc_feature: Ceres ANNOT ID no. 8713486
  misc_feature (252)..(296): Pfam ID: HALZ Pfam Description: Homeobox associated leucine zipper
  misc_feature (197)..(251): Pfam ID: Homeobox Pfam Description: Homeobox domain
MELRLSLGEAAVPDAGRAAVPELGLGLGVGIGASAAAGSGRREEGGTGNRAAPGTGTGTGTRWWAAPATPEPAAVRLSLVSSSLGLQWPPSDAGICHAGRAEAPAARGFDVNRPAPSSSAVAASALLALEDDEDDPGAAAALSSSPNDSAGSFPLDLGGGPHAHHAEGGAAAQAAGGGGERSSSRASDEDDGASARKKLRLSKEQSAFLEESFKEHSTLNPKQKAALAKQLNLRPRQVEVWFQNRRARTKLKQTEVDCEYLKRCCETLTEENRRLHKELAELRALKAAPPFFMRLPATTLSMCPSCERVASGPNPAASTSAPVSLSSSSPPATATATAVAAPVVRGEHRPPSSFAALFAATRSFTLASQPRPPAPAPASNCL

SEQ ID NO: 18880 - DNA, 1485 bp, Sorghum bicolor
  misc_feature: Ceres ANNOT ID no. 8713508
  misc_feature: Encodes the peptide sequence at SEQ ID NO 18881
atggacatggatggagctgcagacccggacgcggaggtggtgtcgctgtcgccgcggacgctgctggagtcggaccggtacgtgtgcgagatctgcgggcaggggttccagcgcgaccagaacctgcagatgcaccggcggcggcacaaggtgccgtggaagctgctgaagcgggaggccggcgaggcggcgcggaagcgcgtgttcgtgtgcccggagccgagctgcctccaccacgacccgtcccacgcgctgggcgacctcgtcggcatcaagaagcacttccggcggaagcacagcggccaccggcagtgggcctgcgcccgctgctccaaggcctacgccgtccactccgactacaaggcccacctcaagacctgcggcacccgcggccatacctgcgactgcggccgcgtcttctcccgggtggagagctttatcgagcaccaggacacgtgcaacgccggccggccgcgggccgagacgtcgtcgtcgccggctagtggcggcggcggtggcggtggcggtgccgggttcggcatggcggcagcaggcggtgcctccacgtcccagcagcagcgtcagctgcacgccgccgccgccgcggcagcgttgtcacggacggcgtccagcgcgagcccatcaagcggtggcgagttcggggtgagccagcagcaggtcgcctgctggccagctggaccggcaattgcgagccccacggccgccgcgacgttccacaggttcgacccggcgctgtcgtcgcctccgacgccgcagtacgagcgccctggtggtggtggtggtggcgtccaccacaacctggagctgcagctcatgccgccgcgcggcagcggcagctactacgacgccggaggcacgactccggcagcagccgtcgccaccaggtgctacgccttctcgccgcattcgcctgcggtgggcctgggcgccgacccgatgcggctgcagctgtcgatggggttcggcggtggcgacaacgacgacgacagcgagacgtcggcgccggcagcgacggcggcggccaggctcaaggaggaggcccgggagcagatgcggctggcgatggcggagaaggcggcggccgacgacgcccgggcgcaggcgcggcggcaggcggagctggccgagcaggagctcgcgaccgcccgccgcatgcggcagcaggcgcaggcggagctgggccgcgcgcacgcgctccgggaccacgccgtgcgccaggtggacgccacgctgctgcaggtcacctgctacagctgccgctgcaagttccgggcgcgggcggcgaccgggaccggcggcgccatgagctccgaggtggccagctacgtctcctccgtcgtcaccgagggcggcgacgccgaggtggacgacgacccgtaccgccaccaccaccaccaccgccaccggcagctcaacgccgacgacgacgcgccgagccacgctaggatgatggacatcaactag

SEQ ID NO: 18881 - protein, 494 aa, Sorghum bicolor
  misc_feature: The sequence is a functional homolog of SEQ ID NO 1087 in the 10/666,642 US patent application
  misc_feature: Useful for making plants with altered lignin content
  misc_feature: Functional homolog of the protein sequence given in SEQ ID NO 13275
  misc_feature: Ceres ANNOT ID no. 8713508
  misc_feature (27)..(49): Pfam ID: zf-C2H2 Pfam Description: Zinc finger, C2H2 type
MDMDGAADPDAEVVSLSPRTLLESDRYVCEICGQGFQRDQNLQMHRRRHKVPWKLLKREAGEAARKRVFVCPEPSCLHHDPSHALGDLVGIKKHFRRKHSGHRQWACARCSKAYAVHSDYKAHLKTCGTRGHTCDCGRVFSRVESFIEHQDTCNAGRPRAETSSSPASGGGGGGGGAGFGMAAAGGASTSQQQRQLHAAAAAAALSRTASSASPSSGGEFGVSQQQVACWPAGPAIASPTAAATFHRFDPALSSPPTPQYERPGGGGGGVHHNLELQLMPPRGSGSYYDAGGTTPAAAVATRCYAFSPHSPAVGLGADPMRLQLSMGFGGGDNDDDSETSAPAATAAARLKEEAREQMRLAMAEKAAADDARAQARRQAELAEQELATARRMRQQAQAELGRAHALRDHAVRQVDATLLQVTCYSCRCKFRARAATGTGGAMSSEVASYVSSVVTEGGDAEVDDDPYRHHHHHRHRQLNADDDAPSHARMMDIN

SEQ ID NO: 18882 - DNA, 867 bp, Sorghum bicolor
  misc_feature: Ceres ANNOT ID no. 8713599
  misc_feature: Encodes the peptide sequence at SEQ ID NO 18883
atggcagcgagccaccaatcatcctacatgatccgattcgacggcgcccactccgacgacccgtcgccgagctccgccggcgccgagccgccgggccccgcgcagccgcagccgcagccgcagccaccgttcgcggggcggaggatgatctcccccgagcaggagcaccaagtcattgtcgccgccctgctccacgtcgtctccgggtacaccacgccgccgccggaggtcttcccgcctccaccgccgccgacagcggcgtgctgccagctgtgcgggatggagcggtgcctcggctgcgagttcttcgccgccgccggggagggctgcttattaccagcgacgaccgcattggacggcgcggggaaggcagtggccgcggcgacaagcgcggcgccggggcagaggaggcggaggaagaagaagaacaagtaccgcggcgtgcggcagcggccgtgggggaagtgggcggcggagatccgcgacccgcgccgcgccgtgcgcaagtggctgggcacgttcgacaccgccgaggaggccgccagggcgtacgaccaggccgccatcgagttccgcggcccgcgcgccaagctcaacttcccgttccccgagcagctggcgacgggcacgggccacgacgaggccagcgcggccgccaccaccaagtcgtcggacaacacgctgtcgctgtcgccgtcgctctgcagcgacgagcgggagcgggagcgggggcagccggagtggctgccgagcgccgggctcggagggcaggaaacaggggagcagctctgggaaggcctgcaggacttgatgaagctggacgaaggcgagctctggttcccgccaacctcgagcgcttggaattga

SEQ ID NO: 18883 - protein, 288 aa, Sorghum bicolor
  misc_feature: Useful for making plants with modulated biomass
  misc_feature: Functional homolog of the protein sequence given in SEQ ID NO 13051
  misc_feature: Ceres ANNOT ID no. 8713599
  misc_feature (143)..(194): Pfam ID: AP2 Pfam Description: AP2 domain
MAASHQSSYMIRFDGAHSDDPSPSSAGAEPPGPAQPQPQPQPPFAGRRMISPEQEHQVIVAALLHVVSGYTTPPPEVFPPPPPPTAACCQLCGMERCLGCEFFAAAGEGCLLPATTALDGAGKAVAAATSAAPGQRRRRKKKNKYRGVRQRPWGKWAAEIRDPRRAVRKWLGTFDTAEEAARAYDQAAIEFRGPRAKLNFPFPEQLATGTGHDEASAAATTKSSDNTLSLSPSLCSDERERERGQPEWLPSAGLGGQETGEQLWEGLQDLMKLDEGELWFPPTSSAWN

SEQ ID NO: 18884 - DNA, 1308 bp, Sorghum bicolor
  misc_feature: Ceres ANNOT ID no. 8713642
  misc_feature: Encodes the peptide sequence at SEQ ID NO 18885
atggcgcccgtgtatactggagcggtccacggcaccaacggcggctccggcctgaccctgaacccggccgtggtggcgcagcgggcgctcagcctcggcggcgcgtccacgccgttgtcgtcgtccacgccgccggcctacgggaacatcgtcaccgtgctgagcatcgatggcggcggcgtgcgcgggatcattcccggcaccatcctcggcttcctcgaggagaagctgcaggagtttgatgagcgaccggaggcgaggctggcggactacttcgacgtgatcgccgggacgagcaccggcgggctggtgaccgccatgctcacggcgccgaacaaggagggccggccgctctttgccgccaaggacatcaacgacttctacctcaagaactgccccaagatcttcccaccaaacagcagcggcggtcctctagggttgttcaagaagttgtcggggcccaagtacgacggcaagtacctccactccctcgtccgggagctcctcggcgagacgaaggtcagccaggcgctccagaacatcgtcatcccgaccttcgacatcaagctcatgcagcccaccgtgttctccaaatacgatgccattaacgatgtctccaaggacgctctgctctcggacgtgtgcatcagcacgtccgccgcgccgacgtacctcccaggacaccagttcgagaccaaggacaaggatggcaagccccgggccttcaacctcatcgacggaggcgtcgctgcaaacaatcctacgctgctggcgatgacggacgtgagcaagcagatcctgctgggcaaccaggacttcttcccgatcaagccagcggactacggcaagttcatggtgctgtcgctgggcaccggcaccgccaaggcggaggagaagttcgacgccgtgcagtccagcaagtggggtcttctggggtggctcagcaacaaggacaccacgccgatcatcgacagcttcagccaggccagcgccgacctcgtcgacatccacgcctccgtgctcttccaggcgctgcactcggagaggcagtacctccggatccaggacgacgagctcaccggagaaacgtcgtccgtcgacgtgtccaccatggagaacctgaaccgcctcgtcgacgtcggcaaggggctgctgaagaagccggcgtgcaaggtgaacatcgagacaggcaagaacgagcccgacgtcaaaaggggcaccaatgaggatgaactcatccgtttcgccaagatgctggtacgcgagcgccgggctaggatccagagaaagggtgacaacacaatctaa

SEQ ID NO: 18885 - protein, 435 aa, Sorghum bicolor
  misc_feature: Useful for making plants with modulated heat sensitivity
  misc_feature: Functional homolog of the protein sequence given in SEQ ID NO 13256
  misc_feature: Ceres ANNOT ID no. 8713642
  misc_feature (90)..(292): SWISSPROT Homolog: EC 3.1.1.4 Phospholipase A(2)
  misc_feature (54)..(259): Pfam ID: Patatin Pfam Description: Patatin-like phospholipase
MAPVYTGAVHGTNGGSGLTLNPAVVAQRALSLGGASTPLSSSTPPAYGNIVTVLSIDGGGVRGIIPGTILGFLEEKLQEFDERPEARLADYFDVIAGTSTGGLVTAMLTAPNKEGRPLFAAKDINDFYLKNCPKIFPPNSSGGPLGLFKKLSGPKYDGKYLHSLVRELLGETKVSQALQNIVIPTFDIKLMQPTVFSKYDAINDVSKDALLSDVCISTSAAPTYLPGHQFETKDKDGKPRAFNLIDGGVAANNPTLLAMTDVSKQILLGNQDFFPIKPADYGKFMVLSLGTGTAKAEEKFDAVQSSKWGLLGWLSNKDTTPIIDSFSQASADLVDIHASVLFQALHSERQYLRIQDDELTGETSSVDVSTMENLNRLVDVGKGLLKKPACKVNIETGKNEPDVKRGTNEDELIRFAKMLVRERRARIQRKGDNTI

SEQ ID NO: 18886 - DNA, 936 bp, Sorghum bicolor
  misc_feature: Ceres ANNOT ID no. 8713691
  misc_feature: Encodes the peptide sequence at SEQ ID NO 18887
atggacttcgacgagcacgacgacggcgacgaggagatgacgccgatgcccgtcagctcgagctacgacgcgccgatgcagccggccgggctggtggcgggactgggaggcggcggcggcggcgggaccccgaagcccggggattctggaggcgggagcttcaggacgccgggcggcgtcgtggtgggaggtggcgtaggcggtggcgcggggggtgggggcaccaggtatcgggagtgcctcaagaaccacgcggtcggcatcggcgggcacgcggtggacggctgcggcgagttcatggccgcgggcgaggacggctccatcgacgcgctccgctgcgcggcctgcggctgccaccgcaacttccaccgcaaggagtccgactcgcccacgggcggcggcggggccgatcccgccgccgccgccgccctttcccctgctgccatcaccgcctacggtgccgccgcggcgcaccaccaccaccaccagttctcgccctactaccgcacccctgccgggtacctcctccaccagcaccagcagctggcggccgcggcggccgggcacatgcagatgcagcgcccgctcgcgctcccgtccacctcccactcggggcgcgtcgacgagggcgacgacatgtccgggctgatcggcccgttggtggtggcgcccatggtgggcatgtccctgggcggctcagggggcggcggcccgtcagggtccggcggctccggctccggcaagaagcggttccgcaccaagttcacgcaggagcagaaggaccggatgctggcgttcgcggagcgcctcgggtggcggatccagaagcacgacgaggccgccgtccagcagttctgcgaggaggtctgcgtcaagcgccacgtgctcaaggtgtggatgcacaacaacaagcacaccctcggcaagaagccatga

SEQ ID NO: 18887 - protein, 311 aa, Sorghum bicolor
  misc_feature: The sequence is a functional homolog of SEQ ID NO 110 in the 10/714,887 US patent application
  misc_feature: The sequence is a functional homolog of SEQ ID NO 110 in the 11/435,388 US patent application
  misc_feature: The sequence is a functional homolog of SEQ ID NO 108 in the 10/714,887 US patent application
  misc_feature: The sequence is a functional homolog of SEQ ID NO 108 in the 11/435,388 US patent application
  misc_feature: Useful for making plants with modulated low light sensitivity
  misc_feature: Functional homolog of the protein sequence given in SEQ ID NO 13756
  misc_feature: Ceres ANNOT ID no. 8713691
  misc_feature (72)..(131): Pfam ID: ZF-HD_dimer Pfam Description: ZF-HD protein dimerisation region
MDFDEHDDGDEEMTPMPVSSSYDAPMQPAGLVAGLGGGGGGGTPKPGDSGGGSFRTPGGVVVGGGVGGGAGGGGTRYRECLKNHAVGIGGHAVDGCGEFMAAGEDGSIDALRCAACGCHRNFHRKESDSPTGGGGADPAAAAALSPAAITAYGAAAAHHHHHQFSPYYRTPAGYLLHQHQQLAAAAAGHMQMQRPLALPSTSHSGRVDEGDDMSGLIGPLVVAPMVGMSLGGSGGGGPSGSGGSGSGKKRFRTKFTQEQKDRMLAFAERLGWRIQKHDEAAVQQFCEEVCVKRHVLKVWMHNNKHTLGKKP

SEQ ID NO: 18888 - DNA, 1650 bp, Sorghum bicolor
  misc_feature: Ceres ANNOT ID no. 8713714
  misc_feature: Encodes the peptide sequence at SEQ ID NO 18889
atgcagctctcggcggcggacagcaggaagaagaagcggcggcggcggcggcggcggagggagctgccactgccagcgtcatgctcctcgagatctgctgccggcgccgctcaaggtcagtgccagtgctgctgctctagccccgacggcggcggcggcggcctcgtggcgacaacaatgccaccgcgcgcattctctcgctgctccaccggcggcgcctcctgcgcgccggcaccggccgtccgtctcggcacccagcagcacaagctgacgatgctcctcgttgcactcgcgctcctcctcgtcctccctcctcctcatctagtggcagcggtctcggtgtcggtgtcgccccggaggatggcgaggatccagagccatctcgacaggatcaacaagacccccgttcgctccatccagagcgtggacggcgacaccatcgactgcgtggcggcgaacgagcagcacggcctggaccatccgctgctcaggacgcacaccgtccagacggagccgcccgaggcgcccatgtggaggggccgcggcggcggattcgtcgtcgtccccgccgcggctggcggtggtggcgctgcgaccgcgactgcgactgcgacgaacggcagcagcagcagcaggaacaacgacaggcgccaaggcgcgtggcagacgtggcaccacggcgggcactgccccagaggcacggtggccatccggcggaccaccgccgacgacgtgctgcgcgccaggtccatctcccgcttcggacgcaagaggaggcacaggaggaacgcggccgtcgccgccgcacgcgccgccaacgcgcccgacgtcatcaccggcaatggacacgagcacgcgatcgcgtacacggcgccttcgcagcagcaggtgtacggggccaaggccaccatcaacgtgtgggatccggccatcgaggaatccaacggcttcagcctctcccagctctggatcctctccggctccttcaacggctccgacctcaacagcatcgaagcaggatggcaggtcagccctgagctgtacggggacagcaggccgaggctcttcacgtactggacaagcgacgcgtacgaggctactggttgctacaacgcgctgtgcccggggttcgtgcagacgagctcccgcatcgccatcggcgcgtcgatctcgccggtgtcgtcggccggcggcgcgcagtacgacatgacgctgctgatctggaaggacccgaagctgggcaactggtggctcagctacggggaccagctggtggggtactggccggcgcagctgttcacgcacctgtcggaccacgccaccatggtggagtggggcggcgaggtggtggacaccaggcccgccggcgtgcacaccgccacgcagatggggtccggccgcttcgccggcgaggggttcggccgcgccagctacttccgcaacctcgagacggtggacgccgacaacagcctcgccgaggtggcgctcgacgccatccagacgctggccgagaaccccgcctgctacgacatacgcaaggcctacgacgaagacgacgacggcggcggcggcggccagcactccgcccgcggaggatggggaacccacttctactacggtggcccgggacacaacccggcgtgcccctga

SEQ ID NO: 18889 - protein, 549 aa, Sorghum bicolor
  misc_feature: Useful for biocontainment applications
  misc_feature: Functional homolog of the protein sequence given in SEQ ID NO 14085
  misc_feature: Ceres ANNOT ID no. 8713714
MQLSAADSRKKKRRRRRRRRELPLPASCSSRSAAGAAQGQCQCCCSSPDGGGGGLVATTMPPRAFSRCSTGGASCAPAPAVRLGTQQHKLTMLLVALALLLVLPPPHLVAAVSVSVSPRRMARIQSHLDRINKTPVRSIQSVDGDTIDCVAANEQHGLDHPLLRTHTVQTEPPEAPMWRGRGGGFVVVPAAAGGGGAATATATATNGSSSSRNNDRRQGAWQTWHHGGHCPRGTVAIRRTTADDVLRARSISRFGRKRRHRRNAAVAAARAANAPDVITGNGHEHAIAYTAPSQQQVYGAKATINVWDPAIEESNGFSLSQLWILSGSFNGSDLNSIEAGWQVSPELYGDSRPRLFTYWTSDAYEATGCYNALCPGFVQTSSRIAIGASISPVSSAGGAQYDMTLLIWKDPKLGNWWLSYGDQLVGYWPAQLFTHLSDHATMVEWGGEVVDTRPAGVHTATQMGSGRFAGEGFGRASYFRNLETVDADNSLAEVALDAIQTLAENPACYDIRKAYDEDDDGGGGGQHSARGGWGTHFYYGGPGHNPACP

SEQ ID NO: 18890 - DNA, 1167 bp, Sorghum bicolor
  misc_feature: Ceres ANNOT ID no. 8713723
  misc_feature: Encodes the peptide sequence at SEQ ID NO 18891
atggaggtggcggagatgcagcgacagcgacagcagttcgtccaccacctgcaggtccaccaccagcagcaaggtactacgcaccaccagccgctgctgtcgtcgccgccgccgcaccaccagcagcagcagaacagcggcagcagcagcagggccggcggcggcgggcgcaggtgctgcccgctgcggcggtcgcggaaagggtgcatgaagggcaagggcgggccggacaaccagcagtgcccgtaccggggcgtgcggcagcggacgtggggcaagtgggtggccgagatccgcgagcccaaccgcggcgcgcgcctctggctcggcaccttcggcagcgcgctcgaggccgcgcgcgcctacgacaacgcggccaggcagctctacggcgactgcgcgcgcctcaacctgcagcagatgccagtgccgcctccgtcggcggcggcggcaggcggaggaggaggaggaggaggaggaggagcggcggcggtcgtggtgtcgtcggctccgtcccctgacgccgtggctgctgcgggccctggtggtggtggtggtggtgggcacaaccgccaccaccagtacctgcagcagcagcagcagcagcaggcagccatggcgtcgtcggcgcctataatgatgatgcagtactccgcctccagctactccgccgacgcgtcgtcatccaactccgactccttctccaactcgtactccagctcgtcgccggtgaccatggcgccctcacccaccaccaacaactacaaccaccaccagacgttccagatgacgccgccgccgtcgtcatgcggcgtggtgatggcgcccgccgccgcgccgcaggcgcagcagggctgccacgtcgacgacaccaccaccacgacgctggcgatgcagcatcagcagatgatccgcgagctggcggcggtgcctctgcaccaggaggccgacgacgacttcgaggacttcatgacgcggctgcccaaggcggaggacttcggcctgcagggcttccaggaggtgccgcccgaggtgttcgacgaagccgccggcatctgggaccacaccgccgccgcctggtcgacccccgccaccatgatgacgatcgactccgccgccggcgccgcccatcagcaccagcagcaggtcgtcgtccctctcagctga

SEQ ID NO: 18891 - protein, 388 aa, Sorghum bicolor
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 166 in the 10/714,887 US patent application
  misc_feature: The sequence is a functional homolog of SEQ ID NO 166 in the 11/435,388 US patent application
  misc_feature: The sequence is a functional homolog of SEQ ID NO 34 in the 10/903,236 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: Ceres ANNOT ID no. 8713723
  misc_feature (81)..(132): Pfam ID: AP2 Pfam Description: AP2 domain
MEVAEMQRQRQQFVHHLQVHHQQQGTTHHQPLLSSPPPHHQQQQNSGSSSRAGGGGRRCCPLRRSRKGCMKGKGGPDNQQCPYRGVRQRTWGKWVAEIREPNRGARLWLGTFGSALEAARAYDNAARQLYGDCARLNLQQMPVPPPSAAAAGGGGGGGGGGAAAVVVSSAPSPDAVAAAGPGGGGGGGHNRHHQYLQQQQQQQAAMASSAPIMMMQYSASSYSADASSSNSDSFSNSYSSSSPVTMAPSPTTNNYNHHQTFQMTPPPSSCGVVMAPAAAPQAQQGCHVDDTTTTTLAMQHQQMIRELAAVPLHQEADDDFEDFMTRLPKAEDFGLQGFQEVPPEVFDEAAGIWDHTAAAWSTPATMMTIDSAAGAAHQHQQQVVVPLS

SEQ ID NO: 18892 - DNA, 1626 bp, Sorghum bicolor
  misc_feature: Ceres ANNOT ID no. 8713770
  misc_feature: Encodes the peptide sequence at SEQ ID NO 18893
atggccgccggcgaccttcaggtgctcaccgcgctcgacaccgccaagacgcaatggtaccacttcaccgccatcgtggtcgccggcatgggcttcttcaccgacgcctacgacctcttctgcatctccctcgtgaccaagctcctcggccgcatctactaccacgtcgagggctccgcgacgcccggcaccctcccgccgcacgtgtccgcggccgtcaacggcgtggccttcgtcggcacgctctcagggcagctcttcttcggctggctgggcgacaagctcggccgtaagaaggtctatggcatgacgctcatgctcatggtcctctgctccgtggcgtcgggcctctccttcggccacaccccggcgtccgtcatggcgacgctgtgcttcttccgcttctggctcgggttcggcatcggcggcgactacccgctgtcggccaccatcatgtccgagtacgccagcaagaagacgcgcggcgcgttcatcgccgcggtcttcgcgatgcagggcttcggcatcatggccggcggcctcgtcgccatcgtcgtgtccgccgcgttcaaggcccggttccccgccccgccctacgccgtcgaccccgccgcgtccacgccgccgcaggccgacttcgtgtggcggatcatcctcatgctgggcgccttgcccgccgcgctcacctactactggcgcaccaagatgcccgagacggcgcgctacacggcgctggtggccaagaacgccaagcaggccgcggcggacatgtccaaggttctgcaggtggagatcgacgagcttgccgcgccggacaacaacagcaacagcaacagcagcggcagggcctcttcggcggcggcgtccttcgggctgttctccggtgagttcctccgccgtcacgggctgcacctcctgggcacgtcggcgacgtggttcctgctggacatcgccttctactcgcagaacctgttccagaaggacatcttcagcgcggtgggatggatcccgaaggcggcgacgatgagcgcgctggaggagctgttccgcatcgcgcgtgcgcagtctctgatcgcgctgtgcggcacggtgccgggctactggttcacggtggcgctgatcgacgtggtggggcggttcgccatccaggcgacggggttcctgatgatgacggtgttcatgctgggcctcgccgtgccgtaccaccactgggcggggaaccaccacatcgtcggcttcgtcgtcatgtacgggctcaccttcttcttcgccaacttcgggcccaacgccaccacgttcatcgtgcccgccgagatcttcccggcgaggctgcggtcgacgtgccacggcatctcggcggcgtcggggaagctgggcgccatcgtggggtccttcgggttcctgtacctggcgcagagccgggacccgggcaagacggagcacgggtaccccgcgggcatcggcgtgcgcaactcgctattcctcctggccggctgcaacctgctcggcttggtgttcacgttcctggtgccggagtccaagggcaagtccctggaggagatgtccggcgagaacgacgagccggccggcgccgccgcgagctccaaccgcacggtgcccgtgtag

SEQ ID NO: 18893 - protein, 541 aa, Sorghum bicolor
  misc_feature: Useful for making plants with modulated phosphate use efficiency
  misc_feature: Functional homolog of the protein sequence given in SEQ ID NO 14600
  misc_feature: Useful for making plants with modulated carbohydrate content
  misc_feature: Functional homolog of the protein sequence given in SEQ ID NO 13407
  misc_feature: Ceres ANNOT ID no. 8713770
  misc_feature (28)..(464): Pfam ID: MFS_1 Pfam Description: Major Facilitator Superfamily
MAAGDLQVLTALDTAKTQWYHFTAIVVAGMGFFTDAYDLFCISLVTKLLGRIYYHVEGSATPGTLPPHVSAAVNGVAFVGTLSGQLFFGWLGDKLGRKKVYGMTLMLMVLCSVASGLSFGHTPASVMATLCFFRFWLGFGIGGDYPLSATIMSEYASKKTRGAFIAAVFAMQGFGIMAGGLVAIVVSAAFKARFPAPPYAVDPAASTPPQADFVWRIILMLGALPAALTYYWRTKMPETARYTALVAKNAKQAAADMSKVLQVEIDELAAPDNNSNSNSSGRASSAAASFGLFSGEFLRRHGLHLLGTSATWFLLDIAFYSQNLFQKDIFSAVGWIPKAATMSALEELFRIARAQSLIALCGTVPGYWFTVALIDVVGRFAIQATGFLMMTVFMLGLAVPYHHWAGNHHIVGFVVMYGLTFFFANFGPNATTFIVPAEIFPARLRSTCHGISAASGKLGAIVGSFGFLYLAQSRDPGKTEHGYPAGIGVRNSLFLLAGCNLLGLVFTFLVPESKGKSLEEMSGENDEPAGAAASSNRTVPV

SEQ ID NO: 18894 - DNA, 5052 bp, Sorghum bicolor
  misc_feature: Ceres ANNOT ID no. 8713748
  misc_feature: Encodes the peptide sequence at SEQ ID NO 18895
atgtctaccaacgacccggacgagatcagggcgcgcgtcgtcgtcctcggcgcccctcatgccgacgacgacgccggcgacgagtgggcccgccccgagctcgaggccttccacctcccctctcccgcccaccagcctcctggcttccacctagccgctgggcaccaaccggaagctgcagcagagcaacccaccacgctccctgctgcccgccgcaccagcgacacatccactgctgctggtgctgctcctccttctccttcgccgcctccgccgccggctcctttggagatggaccagccgcccaatgccaagccggcctcctcctccgccgccgccgccggcgccaatgacaacaagaagcccaccccgcccgccgcgctgcgcgacctcttccgcttcgccgacggcctcgactgcgcgctcatgctcgtcggcacgctcggcgcgctcgtccacggctgctcgctccccgtcttcctccgcttcttcgccgacctcgtcgactccttcggctcccacgccaacgacccggacaccatggtccgcctcgtcgtcaagtacgccttctacttcctcgtcgtcggagccgcaatctgggcgtcctcatgggcagagatctcctgctggatgtggaccggcgagcggcagtcgacgcggatgcggatccggtacctggacgcggcgctgcggcaggacgtgtccttcttcgacaccgacgtgcgcgcctcggacgtcatctacgccatcaacgcggacgccgtggtggtgcaggacgccatcagcgagaagctgggcaacctcatccactacatggccaccttcgtggcgggcttcgtcgtgggcttcaccgccgcctggcagctggcgctcgtcacgctcgccgtcgtgccgctcatcgccgtcatcggggggctcagcgccgccgcgctcgccaagctctcctccaggagccaggacgcgctgtcgggcgccagcggcatcgcggagcaggcgctcgcgcagatacggatcgtgcaggccttcgtcggcgaggagcgcgaaatgcgggcgtactcggcggcgctggccgtcgcgcagaagatcggctaccgcagcggcttcgccaaggggctcggcctcggcggcacctacttcaccgtcttctgctgctacggcctcctgctctggtacggcggacacctcgtccgcggcaaccacaccaacggagggctcgccatcgccaccatgttctccgtcatgatcggcgggctggccctcgggcagtcggcgccgagcatggccgcgttcgccaaggcgcgcgtggcggccgccaagatcttccgcatcatcgaccacaggccgggcatctcctcgcgggacggcgaggacggcggcggcgtggagctggagtcggtgacggggcgggtggagatgaggggcgtggacttcgcgtacccgtcgcggccggacgtccccatcctgcgcggcttctcgctcagcgtgcccgccggcaagaccatcgcgctggtgggcagctccggctccgggaagagcacggtggtgtcgctcctcgagaggttctacgaccccagcgcagggcaaatcttgctggacgggcatgatctcaagtcgctgaagctccggtggctccggcagcagattggtctggtgagccaggagccgacgctgttcgcgacgagcatcaaggagaacctgctgctggggcgggacagtcagagtgcgacgcaggccgagatggaggaggccgccagggtggccaacgcgcactccttcatcgtcaagctccccgacggctacgacacgcaggttggggagcgcggcctgcagctctccggcgggcagaagcagcgcatcgccatcgcccgcgccatgctcaagaaccctgccatcctgctgctggacgaggctaccagcgcgctcgactccgagtcggagaagctcgtgcaggaggcgctggaccgcttcatgatcgggcgcaccaccctggtgatcgcgcacaggctgtccaccatccgcaaggccgacgtcgtggccgtgctgcagggcggcgccgtctccgagatgggcacccacgacgagctcatggccaagggcgagaacggcacctacgccaagctgatccgcatgcaggagcaggcgcacgaggcggcgctcgtcaacgcccgccgcagcagcgccaggccctccagcgcccgcaactccgtcagctcgcccatcatgacgcgcaactcctcctacggccgctccccctactcccgccgcctctccgacttctccacctccgacttcaccctctccatccacgacccgcaccaccaccaccggacgatggccgacaagcagctcgcgttccgcgccggcgccagctccttcctccgcctcgccaggatgaactcgcccgagtgggcctacgcgctcgtcggctccctgggctccatggtctgcggctccttcagcgccatcttcgcctacatcctcagcgccgtgctcagcgtctactacgcgccggaccctcgctacatgaagcgcgagatcgccaagtactgctacctgctcatcggcatgtcctccgcggcgctgctgttcaacacggtgcagcacgtgttctgggacacggtcggcgagaacctcacgaagcgtgtgcgcgagaagatgttcgccgccgtgctccgcaacgagatcgcctggttcgacgccgacgagaacgccagcgcgcgcgtcgccgccaggctcgcgctcgacgcccagaacgtgcgctccgccatcggggaccgtatctccgtcatcgtccagaactcggcgctcatgctcgtcgcctgcaccgcgggcttcgtcctccagtggcgcctcgcgctcgtgctcctcgccgtcttcccgctcgtcgtcggcgccaccgtcctgcagaagatgttcatgaagggcttctcgggggacctggaggccgcgcacgccagggccacgcagatcgcgggcgaggccgtcgccaacctgcgcaccgtggcggcgttcaacgcggagcgcaagatcacggggctcttcgaggccaaccttcgcggcccgctccggcgctgcttctggaaggggcagatcgccgggagcggctacggcgtggcgcagttcctgctgtacgcgtcctacgcgctggggctctggtacgccgcgtggctagtgaagcacggcgtctccgacttctcgcgcaccatccgcgtgttcatggtgctcatggtgtccgccaacggcgccgccgagacgctgacgctggcgccggactttgtcaagggcgggcgcgcgatgcggtccgtgttcgagaccatcgaccggaaaacggaggtggagcccgacgacgtggacgcggcgccggtgccggagcggcccaagggcgaggtggagctgaagcacgtggacttctcgtacccgtcgcggccggacatccaggtgttccgcgacctgagcctccgggcgcgcgccgggaagacgctggcgctggtgggtccgagcgggtgcggcaagagctcggtgctggcgctggtgcagcggttctacgagcccacgtccgggcgcgtgctcctggacggcaaggacgtgcgcaagtacaacctgcgggcgctgcggcgcgtggtggcggtggtgccgcaggagccgttcctgttcgcggcgagcatccacgacaacatcgcgtacgggcgcgagggcgcgacggaggcggaggtggtggaggcggcgacgcaggcgaacgcgcaccggttcatctcggcgctgccggagggctacgggacgcaggtgggcgagcgcggggtgcagctgtcgggcgggcagcggcagcggatcgcgatcgcgcgcgcgctggtgaagcaggcggccatcatgctgctggacgaggcgaccagcgcgctggacgccgagtcggagcggtggctcttcgaggccaaccttcgcggcccgctccggcgctgcttctggaaggggcagatcgccgggagcggctacggcgtggcgcagttcctgctgtacgcgtcctacgcgctggggctctggtacgccgcgtggctagtgaagcacggcgtctccgacttctcgcgcaccatccgcgtgttcatggtgctcatggtgtccgccaacggcgccgccgagacgctgacgctggcgccggactttgtcaagggcgggcgcgcgatgcggtccgtgttcgagaccatcgaccggaaaacggaggtggagcccgacgacgtggacgcggcgccggtgccggagcggcccaagggcgaggtggagctgaagcacgtggacttctcgtacccgtcgcggccggacatccaggtgttccgcgacctgagcctccgggcgcgcgccgggaagacgctggcgctggtgggtccgagcgggtgcggcaagagctcggtgctggcgctggtgcagcggttctacgagcccacgtccgggcgcgtgctcctggacggcaaggacgtgcgcaagtacaacctgcgggcgctgcggcgcgtggtggcggtggtgccgcaggagccgttcctgttcgcggcgagcatccacgacaacatcgcgtacgggcgcgagggcgcgacggaggcggaggtggtggaggcggcgacgcaggcgaacgcgcaccggttcatctcggcgctgccggagggctacgggacgcaggtgggcgagcgcggggtgcagctgtcgggcgggcagcggcagcggatcgcgatcgcgcgcgcgctggtgaagcaggcggccatcatgctgctggacgaggcgaccagcgcgctggacgccgagtcggagcggtgcgtgcaggaggcgctggagcgcgccgggaacggccgcaccaccatcgtggtggcgcaccggctggccacggtgcggaacgcgcacaccatcgccgtgatcgacgacggcaaggtggtggagcaagggtcgcactcgcacctgctcaagcaccatcccgacgggtgctacgcgcggatgctgcagctgcagcggctgacaggcggtgccgcgcccgggccgccgccgtcgtcgtccaacggggccgccgcgtag

SEQ ID NO: 18895 - protein, 1683 aa, Sorghum bicolor
  misc_feature: The sequence is a functional homolog of SEQ ID NO 3 in US patent 7041874
  misc_feature: Ceres ANNOT ID no. 8713748
  misc_feature (124)..(1310): SWISSPROT Homolog: EC 3.6.3.44 Xenobiotic-transporting ATPase
  misc_feature (1438)..(1649): SWISSPROT Homolog: EC 3.6.3.30 Fe(3+)-transporting ATPase
  misc_feature (498)..(684): Pfam ID: ABC_tran Pfam Description: ABC transporter
  misc_feature (1452)..(1636): Pfam ID: ABC_tran Pfam Description: ABC transporter
  misc_feature (1158)..(1355): Pfam ID: ABC_tran Pfam Description: ABC transporter
  misc_feature (143)..(420): Pfam ID: ABC_membrane Pfam Description: ABC transporter transmembrane region
  misc_feature (803)..(1083): Pfam ID: ABC_membrane Pfam Description: ABC transporter transmembrane region
MSTNDPDEIRARVVVLGAPHADDDAGDEWARPELEAFHLPSPAHQPPGFHLAAGHQPEAAAEQPTTLPAARRTSDTSTAAGAAPPSPSPPPPPAPLEMDQPPNAKPASSSAAAAGANDNKKPTPPAALRDLFRFADGLDCALMLVGTLGALVHGCSLPVFLRFFADLVDSFGSHANDPDTMVRLVVKYAFYFLVVGAAIWASSWAEISCWMWTGERQSTRMRIRYLDAALRQDVSFFDTDVRASDVIYAINADAVVVQDAISEKLGNLIHYMATFVAGFVVGFTAAWQLALVTLAVVPLIAVIGGLSAAALAKLSSRSQDALSGASGIAEQALAQIRIVQAFVGEEREMRAYSAALAVAQKIGYRSGFAKGLGLGGTYFTVFCCYGLLLWYGGHLVRGNHTNGGLAIATMFSVMIGGLALGQSAPSMAAFAKARVAAAKIFRIIDHRPGISSRDGEDGGGVELESVTGRVEMRGVDFAYPSRPDVPILRGFSLSVPAGKTIALVGSSGSGKSTVVSLLERFYDPSAGQILLDGHDLKSLKLRWLRQQIGLVSQEPTLFATSIKENLLLGRDSQSATQAEMEEAARVANAHSFIVKLPDGYDTQVGERGLQLSGGQKQRIAIARAMLKNPAILLLDEATSALDSESEKLVQEALDRFMIGRTTLVIAHRLSTIRKADVVAVLQGGAVSEMGTHDELMAKGENGTYAKLIRMQEQAHEAALVNARRSSARPSSARNSVSSPIMTRNSSYGRSPYSRRLSDFSTSDFTLSIHDPHHHHRTMADKQLAFRAGASSFLRLARMNSPEWAYALVGSLGSMVCGSFSAIFAYILSAVLSVYYAPDPRYMKREIAKYCYLLIGMSSAALLFNTVQHVFWDTVGENLTKRVREKMFAAVLRNEIAWFDADENASARVAARLALDAQNVRSAIGDRISVIVQNSALMLVACTAGFVLQWRLALVLLAVFPLVVGATVLQKMFMKGFSGDLEAAHARATQIAGEAVANLRTVAAFNAERKITGLFEANLRGPLRRCFWKGQIAGSGYGVAQFLLYASYALGLWYAAWLVKHGVSDFSRTIRVFMVLMVSANGAAETLTLAPDFVKGGRAMRSVFETIDRKTEVEPDDVDAAPVPERPKGEVELKHVDFSYPSRPDIQVFRDLSLRARAGKTLALVGPSGCGKSSVLALVQRFYEPTSGRVLLDGKDVRKYNLRALRRVVAVVPQEPFLFAASIHDNIAYGREGATEAEVVEAATQANAHRFISALPEGYGTQVGERGVQLSGGQRQRIAIARALVKQAAIMLLDEATSALDAESERWLFEANLRGPLRRCFWKGQIAGSGYGVAQFLLYASYALGLWYAAWLVKHGVSDFSRTIRVFMVLMVSANGAAETLTLAPDFVKGGRAMRSVFETIDRKTEVEPDDVDAAPVPERPKGEVELKHVDFSYPSRPDIQVFRDLSLRARAGKTLALVGPSGCGKSSVLALVQRFYEPTSGRVLLDGKDVRKYNLRALRRVVAVVPQEPFLFAASIHDNIAYGREGATEAEVVEAATQANAHRFISALPEGYGTQVGERGVQLSGGQRQRIAIARALVKQAAIMLLDEATSALDAESERCVQEALERAGNGRTTIVVAHRLATVRNAHTIAVIDDGKVVEQGSHSHLLKHHPDGCYARMLQLQRLTGGAAPGPPPSSSNGAAA

SEQ ID NO: 18896 - DNA, 396 bp, Sorghum bicolor
  misc_feature: Ceres ANNOT ID no. 8713775
  misc_feature: Encodes the peptide sequence at SEQ ID NO 18897
atggacgacggcggcgagccaaccaagtaccgcggcgtgcggcgccggccgtcgggcaagttcgccgccgagatccgcgactccagccggcagagcgtgcgcgtgtggctcggcaccttcgacaccgctgaggaggccgcgagggcctacgaccgcgcggcgtacgccatgcgcggccacctcgccgtgctcaacttccccgccgaggcgcgcaactacgtgcgcggtggcgggtcgtcgtcgtcttcccgccagcagcatcagcagcagcagcagcagggaggaggaggaggaggaggaggaagcggcggcggccggcaggtgatcgagctggagtacctggacgaccaggtgctgcaggagatgctcaagggtggcgacgggaaaaataattag

SEQ ID NO: 18897 - protein, 131 aa, Sorghum bicolor
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
  misc_feature: The sequence is a functional homolog of SEQ ID NO 10 in the 10/903,236 US patent application
  misc_feature: The sequence is a functional homolog of SEQ ID NO 1735 in the 10/374,780 US patent application
  misc_feature: The sequence is a functional homolog of SEQ ID NO 2125 in the 10/666,642 US patent application
  misc_feature: The sequence is a functional homolog of SEQ ID NO 690 in the 10/666,642 US patent application
  misc_feature: The sequence is a functional homolog of SEQ ID NO 70 in the 10/714,887 US patent application
  misc_feature: The sequence is a functional homolog of SEQ ID NO 70 in the 11/435,388 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: Useful for making plants with altered lutein content
  misc_feature: Useful for making plants with modulated biomass
  misc_feature: Useful for making plants with modulated flowering time
  misc_feature: Functional homolog of the protein sequence given in SEQ ID NO 13470
  misc_feature: The sequence is a functional homolog of SEQ ID NO 1356 in the 10/666,642 US patent application
  misc_feature: The sequence is a functional homolog of SEQ ID NO 1726 in the 10/412,699 US patent application
  misc_feature: The sequence is a functional homolog of SEQ ID NO 191 in the 11/479,226 US patent application
  misc_feature: The sequence is a functional homolog of SEQ ID NO 2230 in the 10/374,780 US patent application
  misc_feature: The sequence is a functional homolog of SEQ ID NO 50 in the 10/412,699 US patent application
  misc_feature: The sequence is a functional homolog of SEQ ID NO 788 in the 10/225,066 US patent application
  misc_feature: The sequence is a functional homolog of SEQ ID NO 1157 in the 10/374,780 US patent application
  misc_feature: The sequence is a functional homolog of SEQ ID NO 1360 in the 10/412,699 US patent application
  misc_feature: The sequence is a functional homolog of SEQ ID NO 1756 in the 10/374,780 US patent application
  misc_feature: Useful for making plants with altered cell wall content and/or composition
  misc_feature: Useful for making plants with altered lignin content
  misc_feature: Useful for making plants with altered terpenoid content
  misc_feature: Functional homolog of the protein sequence given in SEQ ID NO 13240
  misc_feature: The sequence is a functional homolog of SEQ ID NO 1769 in the 10/374,780 US patent application
  misc_feature: Ceres ANNOT ID no. 8713775
  misc_feature (8)..(60): Pfam ID: AP2 Pfam Description: AP2 domain
MDDGGEPTKYRGVRRRPSGKFAAEIRDSSRQSVRVWLGTFDTAEEAARAYDRAAYAMRGHLAVLNFPAEARNYVRGGGSSSSSRQQHQQQQQQGGGGGGGGSGGGRQVIELEYLDDQVLQEMLKGGDGKNN

SEQ ID NO: 18898 - DNA, 813 bp, Sorghum bicolor
  misc_feature: Ceres ANNOT ID no. 8713780
  misc_feature: Encodes the peptide sequence at SEQ ID NO 18899
atggcactttcctccaaggacggcggcgccacggagcagccgacgagcggcgggagcggcgacgaccgggagaacggcacgggcgagcccaaggaaggcgccgtggtgacgggcaaccggcggccccgcgggcggccgccggggtccaagaacaagcccaagccccccatcttcgtgacacgtgacagccccaacgcgctgcgcagccacgtgatggaggtggccggcggggccgacgtggccgagtccatcgcccacttcgcgcgccgcaggcagcgcggcgtgtgcgtgctcagcggcgcgggcaccgtcaccgacgtcgcgctccgccagccggccgcgccgggcgccgtggtggccctccgcggccgcttcgagatcctctccctcaccggcacgttcctgccgggccccgcgccgccgggatccacggggctcaccgtgtacctcgcgggcgggcaggggcaggtcgtcggcggcagcgtcgtcggcacgctcacggcggcggggcccgtcatggtgatggcgtccacgttcgccaacgccacctacgagaggctcccgctggacgacgccgaggaggagcccgccgggcaggcgccgccgccgcagctgcctcctggcccgggcggagggccgcctctgataatgggcgggatggccgatccctcggcggcgatgccaatgttcggcggtagcgtcggcggcgtgccgccaagcctcatgccagggggcggcgccgcctccggtgcgggcctgcagctcgggcacgaggggcttgcatgggctcatgcacggccaccgccgtactag

SEQ ID NO: 18899 - protein, 270 aa, Sorghum bicolor
  misc_feature: The sequence is a functional homolog of SEQ ID NO 1402 in the 10/374,780 US patent application
  misc_feature: The sequence is a functional homolog of SEQ ID NO 1410 in the 10/374,780 US patent application
  misc_feature: The sequence is a functional homolog of SEQ ID NO 344 in the 11/435,388 US patent application
  misc_feature: The sequence is a functional homolog of SEQ ID NO 346 in the 10/714,887 US patent application
  misc_feature: The sequence is a functional homolog of SEQ ID NO 38 in the 10/669,824 US patent application
  misc_feature: The sequence is a functional homolog of SEQ ID NO 38 in the 10/870,198 US patent application
  misc_feature: The sequence is a functional homolog of SEQ ID NO 1395 in the 10/374,780 US patent application
  misc_feature: The sequence is a functional homolog of SEQ ID NO 1507 in the 10/412,699 US patent application
  misc_feature: The sequence is a functional homolog of SEQ ID NO 22 in the 10/669,824 US patent application
  misc_feature: The sequence is a functional homolog of SEQ ID NO 22 in the 10/870,198 US patent application
  misc_feature: The sequence is a functional homolog of SEQ ID NO 346 in the 11/435,388 US patent application
  misc_feature: The sequence is a functional homolog of SEQ ID NO 348 in the 10/714,887 US patent application
  misc_feature: The sequence is a functional homolog of SEQ ID NO 222 in the 10/374,780 US patent application
  misc_feature: The sequence is a functional homolog of SEQ ID NO 240 in the 10/714,887 US patent application
  misc_feature: The sequence is a functional homolog of SEQ ID NO 240 in the 11/435,388 US patent application
  misc_feature: The sequence is a functional homolog of SEQ ID NO 254 in the 10/225,066 US patent application
  misc_feature: The sequence is a functional homolog of SEQ ID NO 42 in the 10/669,824 US patent application
  misc_feature: The sequence is a functional homolog of SEQ ID NO 42 in the 10/870,198 US patent application
  misc_feature: The sequence is a functional homolog of SEQ ID NO 64 in the 10/225,068 US patent application
  misc_feature: The sequence is a functional homolog of SEQ ID NO 722 in the 10/412,699 US patent application
  misc_feature: The sequence is a functional homolog of SEQ ID NO 94 in the 11/375,241 US patent application
  misc_feature: The sequence is a functional homolog of SEQ ID NO 14 in the 10/669,824 US patent application
  misc_feature: The sequence is a functional homolog of SEQ ID NO 14 in the 10/870,198 US patent application
  misc_feature: The sequence is a functional homolog of SEQ ID NO 384 in the 11/435,388 US patent application
  misc_feature: The sequence is a functional homolog of SEQ ID NO 386 in the 10/714,887 US patent application
  misc_feature: The sequence is a functional homolog of SEQ ID NO 1413 in the 10/374,780 US patent application
  misc_feature: The sequence is a functional homolog of SEQ ID NO 66 in the 10/669,824 US patent application
  misc_feature: The sequence is a functional homolog of SEQ ID NO 66 in the 10/870,198 US patent application
  misc_feature: Useful for making plants with modulated biomass
  misc_feature: Useful for making plants with modulated flowering time
  misc_feature: Functional homolog of the protein sequence given in SEQ ID NO 14219
  misc_feature: The sequence is a functional homolog of SEQ ID NO 1408 in the 10/374,780 US patent application
  misc_feature: The sequence is a functional homolog of SEQ ID NO 28 in the 10/669,824 US patent application
  misc_feature: The sequence is a functional homolog of SEQ ID NO 28 in the 10/870,198 US patent application
  misc_feature: The sequence is a functional homolog of SEQ ID NO 350 in the 11/435,388 US patent application
  misc_feature: The sequence is a functional homolog of SEQ ID NO 352 in the 10/714,887 US patent application
  misc_feature: The sequence is a functional homolog of SEQ ID NO 1412 in the 10/374,780 US patent application
  misc_feature: The sequence is a functional homolog of SEQ ID NO 1409 in the 10/374,780 US patent application
  misc_feature: The sequence is a functional homolog of SEQ ID NO 40 in the 10/669,824 US patent application
  misc_feature: The sequence is a functional homolog of SEQ ID NO 40 in the 10/870,198 US patent application
  misc_feature: The sequence is a functional homolog of SEQ ID NO 412 in the 11/435,388 US patent application
  misc_feature: The sequence is a functional homolog of SEQ ID NO 414 in the 10/714,887 US patent application
  misc_feature: The sequence is a functional homolog of SEQ ID NO 1400 in the 10/374,780 US patent application
  misc_feature: The sequence is a functional homolog of SEQ ID NO 1510 in the 10/412,699 US patent application
  misc_feature: The sequence is a functional homolog of SEQ ID NO 10 in the 10/669,824 US patent application
  misc_feature: The sequence is a functional homolog of SEQ ID NO 10 in the 10/870,198 US patent application
  misc_feature: The sequence is a functional homolog of SEQ ID NO 1399 in the 10/374,780 US patent application
  misc_feature: The sequence is a functional homolog of SEQ ID NO 1509 in the 10/412,699 US patent application
  misc_feature: The sequence is a functional homolog of SEQ ID NO 340 in the 11/435,388 US patent application
  misc_feature: The sequence is a functional homolog of SEQ ID NO 342 in the 10/714,887 US patent application
  misc_feature: The sequence is a functional homolog of SEQ ID NO 1415 in the 10/374,780 US patent application
  misc_feature: The sequence is a functional homolog of SEQ ID NO 24 in the 10/669,824 US patent application
  misc_feature: The sequence is a functional homolog of SEQ ID NO 24 in the 10/870,198 US patent application
  misc_feature: The sequence is a functional homolog of SEQ ID NO 386 in the 11/435,388 US patent application
  misc_feature: The sequence is a functional homolog of SEQ ID NO 388 in the 10/714,887 US patent application
  misc_feature: The sequence is a functional homolog of SEQ ID NO 1411 in the 10/374,780 US patent application
  misc_feature: The sequence is a functional homolog of SEQ ID NO 36 in the 10/669,824 US patent application
  misc_feature: The sequence is a functional homolog of SEQ ID NO 36 in the 10/870,198 US patent application
  misc_feature: The sequence is a functional homolog of SEQ ID NO 392 in the 11/435,388 US patent application
  misc_feature: The sequence is a functional homolog of SEQ ID NO 394 in the 10/714,887 US patent application
  misc_feature: The sequence is a functional homolog of SEQ ID NO 1515 in the 11/479,226 US patent application
  misc_feature: The sequence is a functional homolog of SEQ ID NO 226 in the 10/374,780 US patent application
  misc_feature: The sequence is a functional homolog of SEQ ID NO 302 in the 11/435,388 US patent application
  misc_feature: The sequence is a functional homolog of SEQ ID NO 304 in the 10/714,887 US patent application
  misc_feature: The sequence is a functional homolog of SEQ ID NO 52 in the 10/669,824 US patent application
  misc_feature: The sequence is a functional homolog of SEQ ID NO 52 in the 10/870,198 US patent application
  misc_feature: The sequence is a functional homolog of SEQ ID NO 56 in the 10/225,066 US patent application
  misc_feature: The sequence is a functional homolog of SEQ ID NO 726 in the 10/412,699 US patent application
  misc_feature: The sequence is a functional homolog of SEQ ID NO 2528 in the 10/374,780 US patent application
  misc_feature: The sequence is a functional homolog of SEQ ID NO 256 in the 10/225,066 US patent application
  misc_feature: The sequence is a functional homolog of SEQ ID NO 298 in the 11/435,388 US patent application
  misc_feature: The sequence is a functional homolog of SEQ ID NO 300 in the 10/714,887 US patent application
  misc_feature: The sequence is a functional homolog of SEQ ID NO 48 in the 10/669,824 US patent application
  misc_feature: The sequence is a functional homolog of SEQ ID NO 48 in the 10/870,198 US patent application
  misc_feature: The sequence is a functional homolog of SEQ ID NO 1840 in the 10/412,699 US patent application
  misc_feature: The sequence is a functional homolog of SEQ ID NO 2080 in the 10/374,780 US patent application
  misc_feature: The sequence is a functional homolog of SEQ ID NO 258 in the 10/225,066 US patent application
  misc_feature: The sequence is a functional homolog of SEQ ID NO 304 in the 11/435,388 US patent application
  misc_feature: The sequence is a functional homolog of SEQ ID NO 306 in the 10/714,887 US patent application
  misc_feature: The sequence is a functional homolog of SEQ ID NO 54 in the 10/669,824 US patent application
  misc_feature: The sequence is a functional homolog of SEQ ID NO 54 in the 10/870,198 US patent application
  misc_feature: The sequence is a functional homolog of SEQ ID NO 728 in the 10/412,699 US patent application
  misc_feature: The sequence is a functional homolog of SEQ ID NO 2038 in the 10/374,780 US patent application
  misc_feature: The sequence is a functional homolog of SEQ ID NO 2370 in the 10/374,780 US patent application
  misc_feature: The sequence is a functional homolog of SEQ ID NO 264 in the 10/714,887 US patent application
  misc_feature: The sequence is a functional homolog of SEQ ID NO 264 in the 11/435,388 US patent application
  misc_feature: The sequence is a functional homolog of SEQ ID NO 536 in the 10/225,066 US patent application
  misc_feature: The sequence is a functional homolog of SEQ ID NO 322 in the 11/435,388 US patent application
  misc_feature: The sequence is a functional homolog of SEQ ID NO 324 in the 10/714,887 US patent application
  misc_feature: The sequence is a functional homolog of SEQ ID NO 50 in the 10/669,824 US patent application
  misc_feature: The sequence is a functional homolog of SEQ ID NO 50 in the 10/870,198 US patent application
  misc_feature: The sequence is a functional homolog of SEQ ID NO 1401 in the 10/374,780 US patent application
  misc_feature: The sequence is a functional homolog of SEQ ID NO 30 in the 10/669,824 US patent application
  misc_feature: The sequence is a functional homolog of SEQ ID NO 30 in the 10/870,198 US patent application
  misc_feature: The sequence is a functional homolog of SEQ ID NO 342 in the 11/435,388 US patent application
  misc_feature: The sequence is a functional homolog of SEQ ID NO 344 in the 10/714,887 US patent application
  misc_feature: The sequence is a functional homolog of SEQ ID NO 248 in the 10/714,887 US patent application
  misc_feature: The sequence is a functional homolog of SEQ ID NO 248 in the 11/435,388 US patent application
  misc_feature: The sequence is a functional homolog of SEQ ID NO 456 in the 10/374,780 US patent application
  misc_feature: The sequence is a functional homolog of SEQ ID NO 498 in the 10/225,066 US patent application
  misc_feature: The sequence is a functional homolog of SEQ ID NO 84 in the 10/870,198 US patent application
  misc_feature: The sequence is a functional homolog of SEQ ID NO 92 in the 10/225,068 US patent application
  misc_feature: The sequence is a functional homolog of SEQ ID NO 150 in the 10/225,066 US patent application
  misc_feature: The sequence is a functional homolog of SEQ ID NO 1511 in the 11/479,226 US patent application
  misc_feature: The sequence is a functional homolog of SEQ ID NO 2 in the 10/669,824 US patent application
  misc_feature: The sequence is a functional homolog of SEQ ID NO 2 in the 10/870,198 US patent application
  misc_feature: The sequence is a functional homolog of SEQ ID NO 224 in the 10/374,780 US patent application
  misc_feature: The sequence is a functional homolog of SEQ ID NO 300 in the 11/435,388 US patent application
  misc_feature: The sequence is a functional homolog of SEQ ID NO 302 in the 10/714,887 US patent application
  misc_feature: The sequence is a functional homolog of SEQ ID NO 724 in the 10/412,699 US patent application
  misc_feature: The sequence is a functional homolog of SEQ ID NO 64 in the 10/669,824 US patent application
  misc_feature: The sequence is a functional homolog of SEQ ID NO 64 in the 10/870,198 US patent application
  misc_feature: Useful for making plants with modulated light quality response
  misc_feature: Functional homolog of the protein sequence given in SEQ ID NO 14220
  misc_feature: The sequence is a functional homolog of SEQ ID NO 1495 in the 11/479,226 US patent application
  misc_feature: The sequence is a functional homolog of SEQ ID NO 1838 in the 10/412,699 US patent application
  misc_feature: The sequence is a functional homolog of SEQ ID NO 2078 in the 10/374,780 US patent application
  misc_feature: The sequence is a functional homolog of SEQ ID NO 296 in the 11/435,388 US patent application
  misc_feature: The sequence is a functional homolog of SEQ ID NO 298 in the 10/714,887 US patent application
  misc_feature: The sequence is a functional homolog of SEQ ID NO 4 in the 10/669,824 US patent application
  misc_feature: The sequence is a functional homolog of SEQ ID NO 4 in the 10/870,198 US patent application
  misc_feature: The sequence is a functional homolog of SEQ ID NO 54 in the 10/225,066 US patent application
  misc_feature: The sequence is a functional homolog of SEQ ID NO 718 in the 10/412,699 US patent application
  misc_feature: The sequence is a functional homolog of SEQ ID NO 1928 in the 11/479,226 US patent application
  misc_feature: The sequence is a functional homolog of SEQ ID NO 86 in the 10/870,198 US patent application
  misc_feature: The sequence is a functional homolog of SEQ ID NO 1418 in the 10/374,780 US patent application
  misc_feature: The sequence is a functional homolog of SEQ ID NO 92 in the 10/669,824 US patent application
  misc_feature: The sequence is a functional homolog of SEQ ID NO 88 in the 10/669,824 US patent application
  misc_feature: The sequence is a functional homolog of SEQ ID NO 90 in the 10/669,824 US patent application
  misc_feature: The sequence is a functional homolog of SEQ ID NO 86 in the 10/669,824 US patent application
  misc_feature: The sequence is a functional homolog of SEQ ID NO 89 in the 10/669,824 US patent application
  misc_feature: Ceres ANNOT ID no. 8713780
MALSSKDGGATEQPTSGGSGDDRENGTGEPKEGAVVTGNRRPRGRPPGSKNKPKPPIFVTRDSPNALRSHVMEVAGGADVAESIAHFARRRQRGVCVLSGAGTVTDVALRQPAAPGAVVALRGRFEILSLTGTFLPGPAPPGSTGLTVYLAGGQGQVVGGSVVGTLTAAGPVMVMASTFANATYERLPLDDAEEEPAGQAPPPQLPPGPGGGPPLIMGGMADPSAAMPMFGGSVGGVPPSLMPGGGAASGAGLQLGHEGLAWAHARPPPY

SEQ ID NO: 18900 - DNA, 2298 bp, Sorghum bicolor
  misc_feature: Ceres ANNOT ID no. 8713802
  misc_feature: Encodes the peptide sequence at SEQ ID NO 18901
atggccaggccaagccgcggggtcacccactgccactggacactgggccagctgcgctggaaagagaaaacaaacaggatcagtattttaatccttggattttgctctgtttaccatggtattccgaaaacgcccctggcctttcttatagcccaagccacccccttcttcctcctctcatctccctcgaaactttccccaatcctctccaatccaatcccctgtctgtccccctctcccaaccctagcccgcgccgccggccagtctgctcgggtggcgcgtacatgacccacccttcctcgtcgtcgtcctccgctcccccgcccccgccgctgccgccgcccggggcggcggcgggggcggccgaggccacctccctcgcgccgggcttccgcttccaccccaccgacgaggagctcgtctcctactacctcaagcgcaaggtcctcggccgcccgctcaaggtcgacgccatcgcagaggtcgacctctacaaggtcgagccctgggacctgcccgcccgctcccgcctccgctcccgcgactcccagtggtacttcttcagccgcctcgaccgcaagcacgccaaccgcgcccgcaccaaccgcgccacgtcgagtgggtactggaagaccacggggaaggacagggaggtgcgccatgggcccagggtcgtcgggatgaagaagacgctcgtcttccatgccggacgcgctcccaagggcgagcgcaccaactgggtcatgcacgagtaccgcctcgagggcgacgacgctgcggggataccgcaggactcatttgtggtgtgccggatcttccagaaagctggcccaggtcctcagaatggggcacagtatggagcgccctttgttgaggaggaatgggaggaggaagacgcagatgtcggtttgcttccagtggagggtgatgctgctgttgaccctgaggttccccgcgctcctgtggagatacctggtgccctggagagaggctatcttcagatgagtgatctcattcagggtttgggtgatcaaaatggaaatggtacacctagtttgccagtttctgatacttcaaataatagcaaccattctgaagatgtagatggaaattctggggacattttaagtgacccaaaccttggctctaattttcttcagtatgaacctggggagcaaaatagcttaatgcttaatggaagtatcatatcaaatgcaaatgctggagatttttttacgaattccagccccagtgatgggttcctagagctgaaggattttgcagatgctgcaaatgtggatttccctctgggcaatggatcaaccatctgtccttcagatggttgggcatggaaaacacccgactcagcagaagctgtaaatggagctaacaatgagattcctccagtccctgatgaccagactttccagccagatgagctggaacaactgctgcagtcaatacaacaagattcccatttcggctcaagtatcattgacccccggcattcttctatgacaaattcagttcttcctgaggatgattctttgatgttctatgatgcacccttcgattccaccatgtgtgatgatgggtttggacagaatggaattcttggctccgcagcaaccaatctatctggcattggcatggtggacgatggtatgcaatacttcgatgcaatggatgaaaatttatttaatgatattctgggctccatacagcagccagctggtaacagttcccacgcttttaatggcccagtccttacccaagaggtcaacaataccatgtatacatatagtccaactcaaaaggttttagaacctaattttgtagttggtgccccgtcatctgctaggttacctgaagctggtagtcagttaaattgtgttgttttaccagatggtcaggctaagagtagtgctatcggaaagggatttgtaaagattttggattcgatctccgctcccccagcttttgcaggagaattcccagctaaccaccgcaaatccttggctcatatttctggagcgcgccccaacacactccatgtttctgctgaagtgatccgcataggaagtttagctgttccttctggcgcagacaagtgggctctgcaaaaggatcaaggcatggagctgctcttctctgcagattttgagcctgatacccgtatacactgtggctgcaacaccattaccgcggtgctgcgtggtggcttctgccttttcttcgtttcggcaataatgctcttagtgagctacgaggtgggcatgtgcatctatggcaagtag

SEQ ID NO: 18901 - protein, 765 aa, Sorghum bicolor
  misc_feature: The sequence is a functional homolog of SEQ ID NO 854 in the 11/435,388 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with altered lignin content
  misc_feature: Functional homolog of the protein sequence given in SEQ ID NO 13250
  misc_feature: Useful for making plants with altered carbohydrate content
  misc_feature: Functional homolog of the protein sequence given in SEQ ID NO 13622
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 891 in the 10/374,780 US patent application
  misc_feature: The sequence is a functional homolog of SEQ ID NO 344 in the 10/666,642 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Ceres ANNOT ID no. 8713802
  misc_feature (127)..(255): Pfam ID: NAM Pfam Description: No apical meristem (NAM) protein
MARPSRGVTHCHWTLGQLRWKEKTNRISILILGFCSVYHGIPKTPLAFLIAQATPFFLLSSPSKLSPILSNPIPCLSPSPNPSPRRRPVCSGGAYMTHPSSSSSSAPPPPPLPPPGAAAGAAEATSLAPGFRFHPTDEELVSYYLKRKVLGRPLKVDAIAEVDLYKVEPWDLPARSRLRSRDSQWYFFSRLDRKHANRARTNRATSSGYWKTTGKDREVRHGPRVVGMKKTLVFHAGRAPKGERTNWVMHEYRLEGDDAAGIPQDSFVVCRIFQKAGPGPQNGAQYGAPFVEEEWEEEDADVGLLPVEGDAAVDPEVPRAPVEIPGALERGYLQMSDLIQGLGDQNGNGTPSLPVSDTSNNSNHSEDVDGNSGDILSDPNLGSNFLQYEPGEQNSLMLNGSIISNANAGDFFTNSSPSDGFLELKDFADAANVDFPLGNGSTICPSDGWAWKTPDSAEAVNGANNEIPPVPDDQTFQPDELEQLLQSIQQDSHFGSSIIDPRHSSMTNSVLPEDDSLMFYDAPFDSTMCDDGFGQNGILGSAATNLSGIGMVDDGMQYFDAMDENLFNDILGSIQQPAGNSSHAFNGPVLTQEVNNTMYTYSPTQKVLEPNFVVGAPSSARLPEAGSQLNCVVLPDGQAKSSAIGKGFVKILDSISAPPAFAGEFPANHRKSLAHISGARPNTLHVSAEVIRIGSLAVPSGADKWALQKDQGMELLFSADFEPDTRIHCGCNTITAVLRGGFCLFFVSAIMLLVSYEVGMCIYGK

SEQ ID NO: 18902 - DNA, 636 bp, Sorghum bicolor
  misc_feature: Ceres ANNOT ID no. 8713818
  misc_feature: Encodes the peptide sequence at SEQ ID NO 18903
atgatgctgcagcggcgcgtggcgtcggcgccggtgcccgactggctggaggcgctgctggccacgcgcttcttcctcgcctgcgccgcgcacccggcgtccccgcgcaacgagtgcaacatgttctgcctcgactgcaggggcgcaccgccgccggccttctgctactactgccgcgcccaccgacactcgtcccaccgcgtcatccagatacggcggtcctcctaccacgacgtggtccgcgtgtccgaggtggaggacgtcctcgacatctccggcgtgcagacctacgtcatcaacagcgccagggtgctcttcctcaacgagcgtccccagccgcgcggcgccggcgccgccgcgggcaaggccgccgcttccccctacaactgcgagatctgcggccgcgcgctgctcgaccccttccgcttctgctccctcggatgcaagttggtggacaccaagaggagcaacggccactctgcggcggcggcggcggacaccgacggcggcggcgcggccaatggcaatgacgaggcggcggaggccgccggcgggagcaagaacggcggcccggcggcgcggccgcagggacgccggcggaaggggaccccacaccgcgcgccgttctggtcctga

SEQ ID NO: 18903 - protein, 211 aa, Sorghum bicolor
  misc_feature: The sequence is a functional homolog of SEQ ID NO 668 in the 10/666,642 US patent application
  misc_feature: The sequence is a functional homolog of SEQ ID NO 664 in the 10/666,642 US patent application
  misc_feature: Ceres ANNOT ID no. 8713818
  misc_feature (28)..(150): Pfam ID: PLATZ Pfam Description: PLATZ transcription factor
MMLQRRVASAPVPDWLEALLATRFFLACAAHPASPRNECNMFCLDCRGAPPPAFCYYCRAHRHSSHRVIQIRRSSYHDVVRVSEVEDVLDISGVQTYVINSARVLFLNERPQPRGAGAAAGKAAASPYNCEICGRALLDPFRFCSLGCKLVDTKRSNGHSAAAAADTDGGGAANGNDEAAEAAGGSKNGGPAARPQGRRRKGTPHRAPFWS

SEQ ID NO: 18904 - DNA, 1710 bp, Sorghum bicolor
  misc_feature: Ceres ANNOT ID no. 8713860
  misc_feature: Encodes the peptide sequence at SEQ ID NO 18905
atggccgcctgcaaactccccacgctttgcactgcccctacaccatacttatatgcctctcgccgctccgccggccaaaccatcatcagcacggcagcggcatcggcatgtcatcgttgccgcgccagtcgtcgtcgaattcaagccgctggagattgcacaaagcattctgcttggaccagcatccgacacgaacggtgggaaggtgacttggccatagaaggacacatccctgcttggctgaacggcacgtacctaaggaacgggccaggtgtgtgggaggtaggcgaccacgcgttggatcacgtcttcgacggctacgccacactggtccgtgtctacttccagggcgctcgtggccgtgctaccggcgcgcacaggcagatcgagtccgacgcatacaaggccgccgccagggcgcacggccgccgccgtccgctcatgcgcatgcgcgagttctcccagctgtgccctagcgagccgggcaccctcctcgaccgcctccggcacgtcgtcgggctcgtcaccggcgccggcatgtccgacaacgccaacaccgcggtgctcccactcggggatggccgggtggtgtgcctcgccgacgtcaccaagagctcggtgctcgtcgacccggagacactcgagacggtcggcaagctccggtacgcggacaggctgtggtgcccggtgcagtgcacgcacccggtggtgacgacgacgacgacgacgacgacccgcgccgccgccgccgccgaggtcttgatgctgcacccggactttgcccggcggggctacctcgtggccaggatgatggcagctggtgggactgggagcaacgacaggcgggaggtggtcgggagggtgcggtgccggggaggcacgacgccggcgtgggtgcactcgttcgccgtcacggcgaagtacatcgtcgtgccggagatgccgctccggtactcggtcgcctgcttgctcatgtccgagctcaccccgttttacataatggactggctaccacactccgggagctacatgcacgtcatatgcagatccactggaaacactgtggcgagcgtcgaggtgcctcctttcgtggcatttcacttcatcaacgcatacgaggagaatggtgatgatgacgacggtgtccggcccaacgccatcatcgccgactgctgcgagtactacgctgatcctgctatcatccaggcacttgctctccacaggcttagatcgccggagacggccaaggacttccctgattccagggttgcacggttcagaatacccctggacggcagcgccgccatgggcgagctggagacagtgctggaccctgaagagcacggccggggtgtggagttgagcaccatcaacccagactacgtcggcaaggagtaccgctacttgtacgcctgcaccgcgcgccggccatgcaatttcttcaacgcgctcaccaagatggacctggtggagaaggagaccacgagctggcatgaggagggcacggtgccatcggagcccttctttgtggccaggccgggagcaaccaatgaagatgatggggttgtcatatctactgcaagcaccatggacggtgacggctacgtgctgctgctggacgcggcgacgttcaaagagattgcccgcttgcggttaccttacggcctacccttcggcttccacggctgctggatcccagacaacaactga

SEQ ID NO: 18905 - protein, 569 aa, Sorghum bicolor
  misc_feature: Useful for making plants with modulated biomass
  misc_feature: Functional homolog of the protein sequence given in SEQ ID NO 14452
  misc_feature: Ceres ANNOT ID no. 8713860
  misc_feature (295)..(567): SWISSPROT Homolog: EC 1.14.99.36 Beta-carotene 15,15'-monooxygenase
  misc_feature (47)..(567): Pfam ID: RPE65 Pfam Description: Retinal pigment epithelial membrane protein
MAACKLPTLCTAPTPYLYASRRSAGQTIISTAAASACHRCRASRRRIQAAGDCTKHSAWTSIRHERWEGDLAIEGHIPAWLNGTYLRNGPGVWEVGDHALDHVFDGYATLVRVYFQGARGRATGAHRQIESDAYKAAARAHGRRRPLMRMREFSQLCPSEPGTLLDRLRHVVGLVTGAGMSDNANTAVLPLGDGRVVCLADVTKSSVLVDPETLETVGKLRYADRLWCPVQCTHPVVTTTTTTTTRAAAAAEVLMLHPDFARRGYLVARMMAAGGTGSNDRREVVGRVRCRGGTTPAWVHSFAVTAKYIVVPEMPLRYSVACLLMSELTPFYIMDWLPHSGSYMHVICRSTGNTVASVEVPPFVAFHFINAYEENGDDDDGVRPNAIIADCCEYYADPAIIQALALHRLRSPETAKDFPDSRVARFRIPLDGSAAMGELETVLDPEEHGRGVELSTINPDYVGKEYRYLYACTARRPCNFFNALTKMDLVEKETTSWHEEGTVPSEPFFVARPGATNEDDGVVISTASTMDGDGYVLLLDAATFKEIARLRLPYGLPFGFHGCWIPDNN

SEQ ID NO: 18906 - DNA, 1221 bp, Sorghum bicolor
  misc_feature: Ceres ANNOT ID no. 8713862
  misc_feature: Encodes the peptide sequence at SEQ ID NO 18907
atgatcagagctcagggcgccgcaatgcatgagagtcggagcatgcagcacagtgaaggccctgccgcggtgcttgccatcgccacagcgaacccgtcgggcaccatcctgtcccaggatgaattcgccgaccagttcttccgcatagccaagagcgatcagcttattggcctcaaggaaaagctaaaaaaaatatgcatagagaagcggcacttccacctgaacgaagaaatcctccgtgcccacccggagttcctcgacagagctcttccatccctcgatgctcgcatcgacatcgtcgcaaccgaggtccccaagctcgcagagtccgcgtcggtgaaggccatcgccgagtggggacgtccagccaccgacatcacccacctcgtcttcagcacctactccggctaccgtgctccgagcgctgacctccggctagcctccctcctcggcctccgcacttccgtctgccgcaccatactcagcctccatggctgctacggcggcgccagggcgcttcacttggcaaaggagctcgccgagaacaaccgcggcgcgcgcgtcctcgtcgcctgctccgaaatcaccctcgtctgcttcaccggtcctgacgggagcaacctcgtcggccatgctctattcggtgacggcgccggcgccgtcatcgtcggcgctgggcccttggccgccggcgaacgcccagtgttcgagatggtttccgccacgcagacgacgataccggagacggagtacgcgctgggcatgcaagtctcagaaggcggcttagatttccacctcgccatccaggtgccgatgctgctcggacagaacgtcgagcagtgtctgcgcgacgcattcaggtcggcggcggcgctggtgggagacgacgacgacggcgacgtcgaggtgacatggaacgacctcttctgggctgtgcatccgggtggccgcccaatcttggacaagatagaggatgtgcttcagctggagcctgggaagctggaggccagccggcaagttctgcgggagtacggaaacatgagcggcgcaacgatagtcttcgtgctagatgagctacgacgacgccggcggcggcgtagggaggaggaaggcgaccatgaccaccagctaccggagttgggggtgatgatggccttcgggccgggaatcacaatcgagacgatggtgctgcgcatcccgagcgacccaaaggggaattag

SEQ ID NO: 18907 - protein, 406 aa, Sorghum bicolor
  misc_feature: The sequence is a functional homolog of SEQ ID NO 2 in US patent 7202397
  misc_feature: Ceres ANNOT ID no. 8713862
  misc_feature (8)..(400): SWISSPROT Homolog: EC 2.3.1.74 Naringenin-chalcone synthase
  misc_feature (7)..(227): Pfam ID: Chal_sti_synt_N Pfam Description: Chalcone and stilbene synthases, N-terminal domain
  misc_feature (237)..(400): Pfam ID: Chal_sti_synt_C Pfam Description: Chalcone and stilbene synthases, C-terminal domain
MIRAQGAAMHESRSMQHSEGPAAVLAIATANPSGTILSQDEFADQFFRIAKSDQLIGLKEKLKKICIEKRHFHLNEEILRAHPEFLDRALPSLDARIDIVATEVPKLAESASVKAIAEWGRPATDITHLVFSTYSGYRAPSADLRLASLLGLRTSVCRTILSLHGCYGGARALHLAKELAENNRGARVLVACSEITLVCFTGPDGSNLVGHALFGDGAGAVIVGAGPLAAGERPVFEMVSATQTTIPETEYALGMQVSEGGLDFHLAIQVPMLLGQNVEQCLRDAFRSAAALVGDDDDGDVEVTWNDLFWAVHPGGRPILDKIEDVLQLEPGKLEASRQVLREYGNMSGATIVFVLDELRRRRRRRREEEGDHDHQLPELGVMMAFGPGITIETMVLRIPSDPKGN

SEQ ID NO: 18908 - DNA, 1956 bp, Sorghum bicolor
  misc_feature: Ceres ANNOT ID no. 8713914
  misc_feature: Encodes the peptide sequence at SEQ ID NO 18909
atgggccctccgcgggcggcctcgccggccggcgcggccgtcgacgccaccgccggcgtcacggtcaaggtcaccgacagatatgtcgagataaaaaatggcatctttgagctgacgctgtccaacccggacggcatcgtcaccggcgtgcgctacaatggtgtggataatctcatggagattcttaacaaggaagacaacagagggtactgggaccttgtttggaacccaccaggacagaaaactggcatctttgatgtgatcaaaggcacagaattccgcatcatataccaagatgaaaaccaggctgaggtatccttcaccaggaattgggatccttcccttgaaggaaaagctgtccccttgaacatcgataagaggttcatcgttctccgtggttcatccgggttctacacctatggaatctatgagcataaggaaggatggcctgatttcggcttgggagagacaagggtggctttcaagctgcggaaagacaagtttcattacatggcactggctgacgacaggcagagaattatgccaatgcctgacgaccgattgcctccccgaggccaaccattagcataccctgaggctgtgctccttgtggacccaataaatcctgatctcagaggggaggttgacgacaagtaccagtactcttgcgaagaccagtacaacaatgtccatgggtggatgtcattcgatcctccaattggcttctggcagatcactccgagtgatgagttcaggacaggaggacccctgaagcaaaatttgacttctcatgttggccccactatgctggctatgtttcttagtgcacattatgcgggggatgacctctcaccaaagtttacgaatggagaatactggaaaaaggtccatggaccggtattcatgtatcttaattctagttgggatggaagtgacccaactatgctatgggaagatgcaaaagttcagatgatgattgagaaagaaaactggccatactgttttgcactttcagaggattttcagaagacagagcaaaggggttgcgtctctggtagattactagtccgagacaggtatcgtcaaggactaccactttccagtcttcacagagcctatgtaggcttggcgctaccaggagaagctggatcctggcaaagagagtgcaagggataccaattctggtgtagagcagatgtagatgggagcttctacataaggaacattgtaactgggaagtacaacctgtatgcgtgggttccgggttttataggggactacagattagatgctacactgaccatatcttcaggggatgatatttatttgggtgaccttgtgtatgaaccgccaagagacgggccgactatgtgggagattggagtacctgatcgatctgccgctgagttttatgttcctgatcctaaccccaactatgtcaatagattgtacatcaaccatcctgcagatagatttagacaatatggactttgggaacgatatgctgaactataccctaacagtgacctggtatacacagttggccaaagtgactataccaccgattggttctatgctcaagttaacagaaaacttgatgacaacacttaccagccaacaacatggcaaataaagttcaaccttgacagtgtcagtccaagcagcacctacaagttcagagtggctctcgcgtcttctgcactcgctgagctgcaggttttcttcaacgatcaggacaaggctcgtcctcacttcgccactgggctgatcggcagggagaacgcgatagcaaggcacgggatccacggtctctactggctgttcaatatcgatgtggctagtgcttggcttgtgcaaggggtgaacaccatctacctgaagcagcccaggagccagagcccgtttcagggattgatgtacgactacttgcgtttggaggggccgtgtggctgctaa

SEQ ID NO: 18909 - protein, 651 aa, Sorghum bicolor
  misc_feature: Useful for making plants with altered carbohydrate content
  misc_feature: Functional homolog of the protein sequence given in SEQ ID NO 14593
  misc_feature: Useful for making plants with altered cell wall content and/or composition
  misc_feature: Functional homolog of the protein sequence given in SEQ ID NO 14592
  misc_feature: Ceres ANNOT ID no. 8713914
  misc_feature (1)..(215): Pfam ID: Rhamnogal_lyase Pfam Description: Rhamnogalacturonate lyase family
MGPPRAASPAGAAVDATAGVTVKVTDRYVEIKNGIFELTLSNPDGIVTGVRYNGVDNLMEILNKEDNRGYWDLVWNPPGQKTGIFDVIKGTEFRIIYQDENQAEVSFTRNWDPSLEGKAVPLNIDKRFIVLRGSSGFYTYGIYEHKEGWPDFGLGETRVAFKLRKDKFHYMALADDRQRIMPMPDDRLPPRGQPLAYPEAVLLVDPINPDLRGEVDDKYQYSCEDQYNNVHGWMSFDPPIGFWQITPSDEFRTGGPLKQNLTSHVGPTMLAMFLSAHYAGDDLSPKFTNGEYWKKVHGPVFMYLNSSWDGSDPTMLWEDAKVQMMIEKENWPYCFALSEDFQKTEQRGCVSGRLLVRDRYRQGLPLSSLHRAYVGLALPGEAGSWQRECKGYQFWCRADVDGSFYIRNIVTGKYNLYAWVPGFIGDYRLDATLTISSGDDIYLGDLVYEPPRDGPTMWEIGVPDRSAAEFYVPDPNPNYVNRLYINHPADRFRQYGLWERYAELYPNSDLVYTVGQSDYTTDWFYAQVNRKLDDNTYQPTTWQIKFNLDSVSPSSTYKFRVALASSALAELQVFFNDQDKARPHFATGLIGRENAIARHGIHGLYWLFNIDVASAWLVQGVNTIYLKQPRSQSPFQGLMYDYLRLEGPCGC

SEQ ID NO: 18910 - DNA, 1653 bp, Sorghum bicolor
  misc_feature: Ceres ANNOT ID no. 8713909
  misc_feature: Encodes the peptide sequence at SEQ ID NO 18911
atggcagctgcctcgtcgtctgcccacctgttcggactcggcgacgcgcagatgcagatgcagcagccgccgccgccgcaacagcaccagcaccagcaccagcaggcggcggcgcctcctcctccgaacccggccgcgccggcgcccaagaagaagcggaatcagcccgcagacccagacgcggaggtgatcgcgctgtcgccgaagacgctgctggcgacgaaccggttcgtgtgcgaggtgtgcaacaagggtttccagcgggagcagaacctgcagctgcaccggcgaggccacaacctgccgtggaagctgaagcagaagaaccccaaggacgtgcggcggcgggtgtacctgtgcccggagccgacgtgcgtgcaccacgacccgtcgcgggcgctgggcgacctcacggggatcaagaagcactactgccgcaagcacggcgagaagaagtggaagtgcgacaagtgcaacaagcgctacgccgtgcagtccgactggaaggcgcactccaagacctgcggcacacgggagtaccgctgcgactgcggcacactcttctccaggagggacagcttcatcacccaccgtgcgttctgcgatgcactggcgcaggagagcgcgcgggtgccgcccatcggcgctggcatgtacggcaccggcggcatggccctcggcctctccgggatggccgcctcccatcagttgcagtccttccaagaccaggcccactcctcggccaccaccaccatcggcagcaatccggcggcgcagttcgagcacctcatgcagccgtccaccggctcccccgcgttccgcggcgcgcaaccgacatcgtcgtcttcctcgccgttctacctcggcggcgccgaggacggccaccagagccaacctagccactcctctctgctccacggcaacaagcaggtctaccacggtctgatgcagctgccggagcagcatcagccggggagtaacaacggcctcctcaacctggggttcttctcgggcgggagcggcggacaggacgcccgcctcgtgttcccggaccagttcaacggcgccatgggcgggaacgtccgcggcgacggcagagagcacggtaacagcggcgccaacactgagtcagcggccatcttctccgggaacctaatgggaaaccaaatggcaagcagcgccggcttttcttcttccttgtacaactcgtccgagaccgtcgcgccgccgcagatgtcggcgacggcgctgctgcagaaggccgctcagatgggcgcgacgacgagcagcggcaacgtgaactctctgctcagggggcttggtaacggcggcggcaccttgaacgggaggcctgccgccggagcagctaggttcatggccggggagagctcctcgtcgaggagcacttctcaggccgagaacgagagccagttccgggacctgatgaacacgctcgcagcgtccgggagcggggctggcacagcgttcagcggtgggttcccgggcatggacggcagcaagctgagcacgagagacttcctcggcgtcggcggcggcggcgtcatgcggagcatgggtggcgcggcggggctgccgctgcggcacggtgccgcgggcattggcatgggctcattggacccagaaatgaagtag

SEQ ID NO: 18911 - protein, 550 aa, Sorghum bicolor
  misc_feature: The sequence is a functional homolog of SEQ ID NO 650 in the 10/666,642 US patent application
  misc_feature: Useful for making plants with altered lignin content
  misc_feature: Functional homolog of the protein sequence given in SEQ ID NO 13275
  misc_feature: The sequence is a functional homolog of SEQ ID NO 1087 in the 10/666,642 US patent application
  misc_feature: Ceres ANNOT ID no. 8713909
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature (77)..(99): Pfam ID: zf-C2H2 Pfam Description: Zinc finger, C2H2 type
MAAASSSAHLFGLGDAQMQMQQPPPPQQHQHQHQQAAAPPPPNPAAPAPKKKRNQPADPDAEVIALSPKTLLATNRFVCEVCNKGFQREQNLQLHRRGHNLPWKLKQKNPKDVRRRVYLCPEPTCVHHDPSRALGDLTGIKKHYCRKHGEKKWKCDKCNKRYAVQSDWKAHSKTCGTREYRCDCGTLFSRRDSFITHRAFCDALAQESARVPPIGAGMYGTGGMALGLSGMAASHQLQSFQDQAHSSATTTIGSNPAAQFEHLMQPSTGSPAFRGAQPTSSSSSPFYLGGAEDGHQSQPSHSSLLHGNKQVYHGLMQLPEQHQPGSNNGLLNLGFFSGGSGGQDARLVFPDQFNGAMGGNVRGDGREHGNSGANTESAAIFSGNLMGNQMASSAGFSSSLYNSSETVAPPQMSATALLQKAAQMGATTSSGNVNSLLRGLGNGGGTLNGRPAAGAARFMAGESSSSRSTSQAENESQFRDLMNTLAASGSGAGTAFSGGFPGMDGSKLSTRDFLGVGGGGVMRSMGGAAGLPLRHGAAGIGMGSLDPEMK

SEQ ID NO: 18912 - DNA, 1653 bp, Sorghum bicolor; identical to SEQ ID NO: 18910
  misc_feature: Ceres ANNOT ID no. 8713912
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 18913

SEQ ID NO: 18913 - protein, 550 aa, Sorghum bicolor; identical to SEQ ID NO: 18911
  misc_feature: The sequence is a functional homolog of SEQ ID NO 650 in the 10/666,642 US patent application
  misc_feature: Useful for making plants with altered lignin content
  misc_feature: Functional homolog of the protein sequence given in SEQ ID NO 13275
  misc_feature: The sequence is a functional homolog of SEQ ID NO 1087 in the 10/666,642 US patent application
  misc_feature: Ceres ANNOT ID no. 8713912
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature (77)..(99): Pfam ID: zf-C2H2 Pfam Description: Zinc finger, C2H2 type

SEQ ID NO: 18914 - DNA, 2535 bp, Sorghum bicolor
  misc_feature: Ceres ANNOT ID no. 8713968
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 18915
atgtcccaccgcgtccggctcgccgcggcgctcgtcgtggtcgccgcgctggcggcggcgctcgcccccggcgccgcggcggcgtggcagctgaccaagaacggcaccgtgatcagctacgaccggcgctcgctcatggtcgacggccgccgggagatcttcttctccgggtccatccactacccgcggagcccgccggacatgtggccggagctcatcgccaaggccaaggagggcgggctcaacaccatcgagacctacgtcttctggaacatccacgagcccgagaagggacagttcaactttgaggggcggtacgacatggtgaagttcttcaagctgatccaggagcacgacatgttcgccatggtccggctcgggcccttcatccaggcagaatggaaccatggagggctgccctattggctaagggagatccctgacattgtgttccggacgaacaacgagccatacaagatgcacatggagacgtttgtgaagatcgtaataaaaaggcttaaggatgccaaccttttcgcctcacaaggagggcccatcattctagcacagatcgagaatgagtatcagcatttggaagcggcgttcaaagaggagggcaccaagtacatccactgggctgcgcagatggccatcggcaccaacatcggcataccatggatcatgtgcaagcagaccaaagctcctggtgatgtgattcctacctgcaatgggagaaactgtggagatacatggccaggtccaatgaacaagaccatgcccctcttgtggactgagaactggacagcacagtacagagtattcggtgacccaccatcccagcgttctgctgaggacattgcgttcgccgtggcgcgcttcttctctgtgggcggtactatgacaaactattacatgtaccatggtggaacaaactttggaaggacagctgctgcatttgtgatgccaaaatactacgacgaggcacctctcgatgaattcggtctgtacaaggagcctaaatggggccatctgagggacctgcacctggcgctgaagctgtgcaagaaggccctgctctggggtaagccgtcgacggagaagctgggcaagcagctcgaggcgagggtgtttgagataccggagcagaaggtgtgcgtggcgttcctttccaaccacaacaccaaggacgacgtgacgctgacgttccggggccagccctacttcgtgccgcgccactccatcagcatcctcgccgactgcaagacggtcgtcttcggcacccagcacgtgaacgcgcagcacaaccagaggacgttccacttcgcggaccagacgaatcagaacaacgtgtggcagatgttcgacgaggagaaggtgcccaagtacaagcaggccaagatcaggacgcgcaaggctgccgatctctacaacctcaccaaggacaagaccgactacgtctggtacacctccagcttcaagttggagccggacgacatgccgatccgccgtgacatcaagacggtggtcgaggtcaacagccatgggcacgccagcgtggcgtttgttaacaacaaattcgcaggatgtgggcacgggaccaagatgaacaaggcgttcacgctggagaagcccatggagctgaaaaagggcgtgaatcacgtcgccgtcttggcatcgtcgatgggaatgatggacagtggcgcttacctggagcaccgtctggccggcgtcgacagggtgcagatcacgggcctgaacgcgggcacgctggacctgacgaataacggctggggccacatcgtcggcctcgtcggcgagcagaaggagatctacaccgagaagggcatggccagcgtcacctggaagccggccgtcaacgacaagccgctcacctggtataagaggcacttcgacatgccgtcgggagaggacccgatcgtgctggatatgagcacgatgggcaagggcatgatgtatgtcaatggccagggcatcggtcgctactggatgtcctacaagcacgccctcggccggccatcgcagcagctgtaccacatcccccggtccttcttgcggccgaaggacaacgtgctggtgctgttcgaggaggagttcgggcggccggacgcgatcatgatcctgacggtgaagcgcgacaacatctgcacctacatctcggagcggaatccggcgcacatcaagtcgtgggagcgcaaggacagccagatcacggcgaccgccgacgacctcaaggcccgggcgacgctgacgtgcccgcccaagaagctcatccagcaggtggtgttcgcgagctacggcaaccccgtgggcatctgcggcaactacaccatcggcagctgccacacgccgcgcgccaaggaggtggtggagaagtcctgcctcggcaagcgcacctgcacgctgcccgtgtccgccgacgtctacggcggcgacgtcaactgccccggcaccaccgccacgctcgccgtgcaggccaagtgctccaagagggcgcccagtgcctccgcgcagtaa

SEQ ID NO: 18915 - protein, 844 aa, Sorghum bicolor
  misc_feature: Useful for making plants with altered cell wall content and/or composition
  misc_feature: Functional homolog of the protein sequence given in SEQ ID NO 14346
  misc_feature: Ceres ANNOT ID no. 8713968
  misc_feature (29)..(843): SWISSPROT Homolog: EC 3.2.1.23 Beta-galactosidase
  misc_feature (44)..(351): Pfam ID: Glyco_hydro_35 Pfam Description: Glycosyl hydrolases family 35
  misc_feature (756)..(834): Pfam ID: Gal_Lectin Pfam Description: Galactose binding lectin domain
MSHRVRLAAALVVVAALAAALAPGAAAAWQLTKNGTVISYDRRSLMVDGRREIFFSGSIHYPRSPPDMWPELIAKAKEGGLNTIETYVFWNIHEPEKGQFNFEGRYDMVKFFKLIQEHDMFAMVRLGPFIQAEWNHGGLPYWLREIPDIVFRTNNEPYKMHMETFVKIVIKRLKDANLFASQGGPIILAQIENEYQHLEAAFKEEGTKYIHWAAQMAIGTNIGIPWIMCKQTKAPGDVIPTCNGRNCGDTWPGPMNKTMPLLWTENWTAQYRVFGDPPSQRSAEDIAFAVARFFSVGGTMTNYYMYHGGTNFGRTAAAFVMPKYYDEAPLDEFGLYKEPKWGHLRDLHLALKLCKKALLWGKPSTEKLGKQLEARVFEIPEQKVCVAFLSNHNTKDDVTLTFRGQPYFVPRHSISILADCKTVVFGTQHVNAQHNQRTFHFADQTNQNNVWQMFDEEKVPKYKQAKIRTRKAADLYNLTKDKTDYVWYTSSFKLEPDDMPIRRDIKTVVEVNSHGHASVAFVNNKFAGCGHGTKMNKAFTLEKPMELKKGVNHVAVLASSMGMMDSGAYLEHRLAGVDRVQITGLNAGTLDLTNNGWGHIVGLVGEQKEIYTEKGMASVTWKPAVNDKPLTWYKRHFDMPSGEDPIVLDMSTMGKGMMYVNGQGIGRYWMSYKHALGRPSQQLYHIPRSFLRPKDNVLVLFEEEFGRPDAIMILTVKRDNICTYISERNPAHIKSWERKDSQITATADDLKARATLTCPPKKLIQQVVFASYGNPVGICGNYTIGSCHTPRAKEVVEKSCLGKRTCTLPVSADVYGGDVNCPGTTATLAVQAKCSKRAPSASAQ

SEQ ID NO: 18916 - DNA, 1590 bp, Sorghum bicolor
  misc_feature: Ceres ANNOT ID no. 8713984
  misc_feature: Encodes the peptide sequence at SEQ ID NO 18917
atggacgccgccgccgccgccgccgcagcctccaccacgctcctctacggcgcgctcctccttgcagcgttcctcttcgtggccgccgccgtgcgcggccgcgggagcaagagcaacgccaacggaaacggcggcggcagcctcccgccgggccccacgggcctgccgctggtgggcagcctgccgtcgctggaccctcagctgcacgtgtacttcgcgcgcctcgcggacaggtacggccccatcttctccatccgcctgggctccaagctgggcgtggtggtcacctccccgtccctggcgcgcgaggtgctccgcgagcaggacctcgtcttctccggccgcgacgtccccgacgcggcgcgctccatctcctacggcggcgggcagaacatcgtgtggaaccccgtgggccccacgtggcggctgctccggcgggtgtgcgtccgggagatgctcagccccgcggggctggacaacgtgcacgggctccgggcgcgcgagttcagggccacgctcgcgcacctccacgcccaggccgtcgccgccgcgcccgtcgacgtcggcgcgcagatgttcctcaccgtcatgaacgtcatcacgggcacgctgtggggagggaacgtcggcagcgacagcgagcgcgccgcggtcgggaaggacttcaggcacctcgtcgccgagatcaccgacatgctcggcgcgcccaacgtgtccgacttcttcccggcgctcgcgcgcttcgacctgcagggcatccggaggaagtccgacgtgctcaaggagcgcttcaaccagatgttcgccaggatcatagagcagaggatcagcgccgagcgcgccggcggcgagccccccgcgcccgacttcttggagtacatgctcaagctcgagaaggaaggcggcgacggcaagacatccttcaccatgaccaacgtcaaggcactgctcatggacatggtggtcggaggtacagaaaccacgtcgaacactgtggagtgggcgatggcggagctgatgcagaagccggagctgatggcaaaggtgcggcaggagctggacgcggtggtgggcagggacgcggtagtggaggagtcgcacctcccgcagctgcactacctgcacgcggtgctcaaggagacgctgcggctgcacccggcgctgccgctgatggtgccgcactgccccagcgccgacgccacggtgggcggctaccgcgtcccggcggggtgccgcgtgttcgtcaacgtgtgggcgatcatgagggaccccgccgtgtggaaggacccgcaggagttcatcccggagaggttcctgggcggcggcgaagggcgcaagtgggacttcaacggcagcgagatggactacctcccgttcgggtccgggcgcaggatctgcgctgggatcgccatggccgaccggatgacggcctactcgctggccatgctgctgcaggcgttcgactgggagctgccggccggcgcgaggctggagctggacgagaagttcgcgatcgtcatgaagaaggccacgccgctggtggccgtgccgacgccgaggctgtccaagcctgagctctactccgcctag

SEQ ID NO: 18917 - protein, 529 aa, Sorghum bicolor
  misc_feature: Useful for making plants with modulated cold sensitivity
  misc_feature: Functional homolog of the protein sequence given in SEQ ID NO 14676
  misc_feature: Ceres ANNOT ID no. 8713984
  misc_feature (69)..(527): SWISSPROT Homolog: EC 1.14.13.21 Flavonoid 3'-monooxygenase
  misc_feature (49)..(516): Pfam ID: p450 Pfam Description: Cytochrome P450
MDAAAAAAAASTTLLYGALLLAAFLFVAAAVRGRGSKSNANGNGGGSLPPGPTGLPLVGSLPSLDPQLHVYFARLADRYGPIFSIRLGSKLGVVVTSPSLAREVLREQDLVFSGRDVPDAARSISYGGGQNIVWNPVGPTWRLLRRVCVREMLSPAGLDNVHGLRAREFRATLAHLHAQAVAAAPVDVGAQMFLTVMNVITGTLWGGNVGSDSERAAVGKDFRHLVAEITDMLGAPNVSDFFPALARFDLQGIRRKSDVLKERFNQMFARIIEQRISAERAGGEPPAPDFLEYMLKLEKEGGDGKTSFTMTNVKALLMDMVVGGTETTSNTVEWAMAELMQKPELMAKVRQELDAVVGRDAVVEESHLPQLHYLHAVLKETLRLHPALPLMVPHCPSADATVGGYRVPAGCRVFVNVWAIMRDPAVWKDPQEFIPERFLGGGEGRKWDFNGSEMDYLPFGSGRRICAGIAMADRMTAYSLAMLLQAFDWELPAGARLELDEKFAIVMKKATPLVAVPTPRLSKPELYSA

SEQ ID NO: 18918 - DNA, 1599 bp, Sorghum bicolor
  misc_feature: Ceres ANNOT ID no. 8714016
  misc_feature: Encodes the peptide sequence at SEQ ID NO 18919
atgtgccactgccactgctccgagccgacacaatgccaccaccaggtcctgctcccgccaaccaaggcctgccccgcgctgggtgaccgcccgaggccggcgcggcgcggcgacggcggcgcgcccaccgaggtcatcgcgtccatcctgcgcctcgccgtgcccatggtcggcgccggcctgctcatgtacatgcgctccctcgtgtccatgctcttcctcggcacgctcggccgcctgcccctcgccggaggctccctcgcgctcggcttcgccaacatcaccggctactccgtgctctccggcctcgccgccgggatggaccccgtgtgcggccaggcgttcggcgccggccgcacctccgtcctcaccgccgcgctccgccgcaccgtcgtcctgctcctggccgcgtccgtgcccatcaccctgctctggctcgccatgcaccgcgcgctcgtcgccacgggccaggaccccgacattgccgccgccgcgtacgacttcatcctgtgctcgctgcccgacctcgtcgtgcagtccttcctccacccgctgcgcgtgtacctccgcgcgcagtccgtcacgctcccgctcacgtacgccgccgccgccgcgctactgctccacgtccccgtcaactgcctcctcgtgcacagcctccggctagggatacgcggcgtcgcgctcggcgccgtttgcaccaacctcaacttcctgctgttcctcgtggcctacgtctaccttaccggactaatgcggcacggcgatgacggcggtaatggcaaggccgacgcgctgatgtgcgcgacgccgccgccggccgaggacgtcgagtgggggtgcctgctgaggctgtcgctgcacagctgcatgtcggtgtgcctggagtggtggtggtacgagatcatggtgctgctctgcggcgtgctggccgaccccaaggcggcggtggccgccatggggatactgatacagaccacgtcgctgctctacatcttcccgcactccctcagctgcgccgtgtccacgcgcgtcgggcacgagctcggcgcggggcggccggagcgcgcgcgcctcgtggcacgcgtcgggctctgctgcggcgcggcgctggggctcctggcgtgcgccttcgcggcgtccgtgagaggggtgtgggcgcggatgttcaccaccgacgccgccatcctgcggctagcgtccgcggcgctgcccatactcggcgcagccgagctgggaaactgcccgcagacggccggatgcggcgtgctgcgcggcagcgcgcggccggggaaggcggcgaggatcaacgtctccgccttctacggcgtcggcatgccggcggcgctcgcgctggcgttctggcccgcgcggctcgacttcgccggcatgtgggccggcatgctcgccgcgcagctcgtgtgcgcggcgctgatgctgcacgcggtgctgcgcacggactgggacgagcaggccgtccgcgcgagcgtgctaaccggcggcggcatagtcgtcgtcgccgatgtcaaaagcggccatgcagacgctgccaaagtaaaggcgaacaacggcatgctcgtcgtgaccgtgctaacttga

SEQ ID NO: 18919 - protein, 532 aa, Sorghum bicolor
  misc_feature: Useful for biocontainment applications
  misc_feature: Useful for making plants with modulated biomass
  misc_feature: Functional homolog of the protein sequence given in SEQ ID NO 14422
  misc_feature: Ceres ANNOT ID no. 8714016
  misc_feature (289)..(451): Pfam ID: MatE Pfam Description: MatE
  misc_feature (55)..(215): Pfam ID: MatE Pfam Description: MatE
MCHCHCSEPTQCHHQVLLPPTKACPALGDRPRPARRGDGGAPTEVIASILRLAVPMVGAGLLMYMRSLVSMLFLGTLGRLPLAGGSLALGFANITGYSVLSGLAAGMDPVCGQAFGAGRTSVLTAALRRTVVLLLAASVPITLLWLAMHRALVATGQDPDIAAAAYDFILCSLPDLVVQSFLHPLRVYLRAQSVTLPLTYAAAAALLLHVPVNCLLVHSLRLGIRGVALGAVCTNLNFLLFLVAYVYLTGLMRHGDDGGNGKADALMCATPPPAEDVEWGCLLRLSLHSCMSVCLEWWWYEIMVLLCGVLADPKAAVAAMGILIQTTSLLYIFPHSLSCAVSTRVGHELGAGRPERARLVARVGLCCGAALGLLACAFAASVRGVWARMFTTDAAILRLASAALPILGAAELGNCPQTAGCGVLRGSARPGKAARINVSAFYGVGMPAALALAFWPARLDFAGMWAGMLAAQLVCAALMLHAVLRTDWDEQAVRASVLTGGGIVVVADVKSGHADAAKVKANNGMLVVTVLT

SEQ ID NO: 18920 - DNA, 204 bp, Sorghum bicolor
  misc_feature: Ceres ANNOT ID no. 8714037
  misc_feature: Encodes the peptide sequence at SEQ ID NO 18921
atggaaagcatggataaggaattgagaccaaggttagcagagcaggtaaacaaacactgtgctgcaattgctattcctcaaggcctttattgccttttgttgcgtttaactgatgaatactcctcaatgcccttgcaagggaacaactacgaccctgagttggtgccttgtcttatggacaactcctattgctatttgttttag

SEQ ID NO: 18921 - protein, 67 aa, Sorghum bicolor
  misc_feature: Useful for making plants with altered carbohydrate content
  misc_feature: Functional homolog of the protein sequence given in SEQ ID NO 13981
  misc_feature: Ceres ANNOT ID no. 8714037
MESMDKELRPRLAEQVNKHCAAIAIPQGLYCLLLRLTDEYSSMPLQGNNYDPELVPCLMDNSYCYLF

SEQ ID NO: 18922 - DNA, 1605 bp, Sorghum bicolor
  misc_feature: Ceres ANNOT ID no. 8714085
  misc_feature: Encodes the peptide sequence at SEQ ID NO 18923
atggactcggacgtggagatgaacgccgccagcgacgaggaggtgatggacgacgaggactactacgactactgcgacagcgacatgggcgatgacggcgacggcgggagcgaggaggaagaggagctggtggccggggactacgacgagggcatcgaggccgaggggaccgacgaggtggtgtctaggcgtgagcagacatttgtggttttaaacgaagaagttatatctgagcgtcaagcggaagatgtaagcaagctaacttgtggaatatgttttgaagggtattcttctgatatgatgagctccgctggttgtgctcatttttattgccatgaatgctgggaaggtggtggtccaggatgtttgtcattgagatgccctgatccatcatgtagtgctatggttcttcaagggatgattaataaattagctaaagatgaggataaagaaaaatatgcacgatttctcttacgtgcatatgttgaaggtagcaagaagactaaatggtgtccagctcctgactgtacatgtgctgtggagtttcttggtgatgaaaactatgatgtctcatgcaattgcaagttcagcttttgctggaattgcactgaggaagctcatcgaccagtgaactgcgagactgtttctaagtggatattaaagaacagtgcagaatctgaaaacatgaactggatactggctaattctaagccctgtccgaagtgcaaacggccaatagagaaaaaccagggatgcatgcatatgacatgcacccctccttgcaaattcgaattttgctggttatgtctgggcgcatggtcagatcatggagagagaacaggtggcttttatgcttgcaatcgttatgaatcagcaaagaaagagggagtttatgatgagactgaagcaaggagggaaagagctaagaactctcttgagagatatatgcattactatgaacgctgggcatccaatcagacatcgaggcagaaggcccaagcagatctgctaaaagcggaaaaggatcagcttgcaaatttaactgacatttttgggataccagagacccagcttaagttcataattgaagcttggtcacagattatagaatgcaggcgagtgctgaaatggacatatgcttatggctactatctggatgataaggtcaagagtgaattttttgagtatctgcaaggtgaggctgagtctggcttggaacgtcttcatcagtgcgctgagaaagacttgcaaaaatttttgccttctgtgaaatctgacagcactgaaacgacggcaccaacaccggatgaatttagtgaattccgcgtaaagcttgctgggctcacaagcgttactcgtaattactttgagaaccttgttcaagctttggaagctgggttggaggatgtccgtgccactgcccaggctgctggtacatccagcgctgccaccagctccaagaaaggaggaactaaatccaagaagaagcagcccactaagccatcatctgaccacactgatgatgggtggccctgcgagcgctgcacatttcttaaccctccctcagtggatgcgtgcagcgtctgcgaaaagagtaggtactag

SEQ ID NO: 18923 - protein, 534 aa, Sorghum bicolor
  misc_feature: The sequence is a functional homolog of SEQ ID NO 546 in the 11/435,388 US patent application
  misc_feature: Ceres ANNOT ID no. 8714085
  misc_feature: Up-regulated in shoot tissues in response to salicylic acid treatment
  misc_feature (151)..(212): Pfam ID: IBR Pfam Description: IBR domain
MDSDVEMNAASDEEVMDDEDYYDYCDSDMGDDGDGGSEEEEELVAGDYDEGIEAEGTDEVVSRREQTFVVLNEEVISERQAEDVSKLTCGICFEGYSSDMMSSAGCAHFYCHECWEGGGPGCLSLRCPDPSCSAMVLQGMINKLAKDEDKEKYARFLLRAYVEGSKKTKWCPAPDCTCAVEFLGDENYDVSCNCKFSFCWNCTEEAHRPVNCETVSKWILKNSAESENMNWILANSKPCPKCKRPIEKNQGCMHMTCTPPCKFEFCWLCLGAWSDHGERTGGFYACNRYESAKKEGVYDETEARRERAKNSLERYMHYYERWASNQTSRQKAQADLLKAEKDQLANLTDIFGIPETQLKFIIEAWSQIIECRRVLKWTYAYGYYLDDKVKSEFFEYLQGEAESGLERLHQCAEKDLQKFLPSVKSDSTETTAPTPDEFSEFRVKLAGLTSVTRNYFENLVQALEAGLEDVRATAQAAGTSSAATSSKKGGTKSKKKQPTKPSSDHTDDGWPCERCTFLNPPSVDACSVCEKSRY

SEQ ID NO: 18924 - DNA, 1008 bp, Sorghum bicolor
  misc_feature: Ceres ANNOT ID no. 8714094
  misc_feature: Up-regulated in shoot tissues in response to salicylic acid treatment
  misc_feature: Encodes the peptide sequence at SEQ ID NO 18925
atggcgtcgagtggggatccgcccggatctactgatgagaagaaaactccaaaatctgaaggatcttccgacgaacgtcaaggggttcctccagcaggcttttcaaatccttttgactttgcttctatgcaaagtttgctcaacgatccatctattaaggagatggctgatcaaattgcaaaggatcctgcattcaaccagatggctgagcagctacagaaaagtgctcatagtacaggcgaacaggggatgcccccattggaccctcaacaatacatggaaacaatgcaaaaggtcatggaaaacccccagtttatgacaatggcagagcgtctggggaatgctcttatgcaggatcctgctatgtctagtatgctggaaacctttagcagtccatcacataaggagcagctggaagagcgtatgtctcgcattaaggaagatccagctatgaagtcaattcttgatgagttagagaatggaggtccttctgcaatgatgaagtactggaatgaccctgatactcttcaaaagattggcgaggcaatgggagctagcttcccgtttggtgcaggttcttctgctgaaccttctggtcctgaagaaactgaggaagaaggtggggatgatgatgaatcaatcgtccatcacactgccagcgttggtgatgaagagggtctcaagaaggcactagatggtggagcagacaaggatgaagaagactctgagggaagaagggccttacattttgcatgtgggtacggtgagttgaagtgtgcccagatccttcttgaggctggtgctgcagtggacgctttggacaagaacaagaacaccccgctgcattatgccgctggctatggccgcaaggagtgtgtggatcttcttttgaagcatggcgctgccgtaacgctccaaaacctggatgggaagacacccatcgacgttgccaagctcaacaaccaggacgaggttcttaagttgctcgagaaggacgtcttcctttaa

SEQ ID NO: 18925 - protein, 335 aa, Sorghum bicolor
  misc_feature: The sequence is a functional homolog of SEQ ID NO 1839 in the 10/374,780 US patent application
  misc_feature: Ceres ANNOT ID no. 8714094
  misc_feature (215)..(335): SWISSPROT Homolog: EC 2.4.2.30 NAD(+) ADP-ribosyltransferase
  misc_feature (276)..(308): Pfam ID: Ank Pfam Description: Ankyrin repeat
  misc_feature (243)..(275): Pfam ID: Ank Pfam Description: Ankyrin repeat
MASSGDPPGSTDEKKTPKSEGSSDERQGVPPAGFSNPFDFASMQSLLNDPSIKEMADQIAKDPAFNQMAEQLQKSAHSTGEQGMPPLDPQQYMETMQKVMENPQFMTMAERLGNALMQDPAMSSMLETFSSPSHKEQLEERMSRIKEDPAMKSILDELENGGPSAMMKYWNDPDTLQKIGEAMGASFPFGAGSSAEPSGPEETEEEGGDDDESIVHHTASVGDEEGLKKALDGGADKDEEDSEGRRALHFACGYGELKCAQILLEAGAAVDALDKNKNTPLHYAAGYGRKECVDLLLKHGAAVTLQNLDGKTPIDVAKLNNQDEVLKLLEKDVFL

SEQ ID NO: 18926 - DNA, 1563 bp, Sorghum bicolor
  misc_feature: Ceres ANNOT ID no. 8714084
  misc_feature: Encodes the peptide sequence at SEQ ID NO 18927
atggggggctgctactccgccttcgcctgctcgcggaagctgcgcggccgcatctccttcgtcctccccgtcaccgagcgcgaccgcgacagcgacagcgtcgccagcgccgccgccacgccgtccccgtccccgcgcaagaacgacgccgacgccgggccgctcgtggtgcggaccaccgcggccgagttcgcgcgccgctacgtgctgggccgggagctcgggcgcggcgagttcggcgtcacgcgccgctgcaaggacgccgccacgggcgagagggaggtggccatcatgcggcgcatgtcgtcccgcggcggcgcggccgtggtgcggctccgcgaggcctgctgcgaggactcggcctccggcggcggcggcggcggcggcgcggtccacctggtcatggagctgtgcgagggcggggagctgttcgaccgcatcgtcgcgcgcggccactactcggagcgcgccgcggcgggcgtgttcggcaccatcgtcgacgtcgtgcggctgtgccactccaacggtgtcatccacagggacctcaagcccgagaacttcctgttcgccaacaagtcggaggactccccgctcaaggtcatcgacttcggcctctccgtcttcttcaaccccggcgatcggttcacggaggtggtggggagcgcgtactacatggcgccggaggtgctgaagcggaactacgggccggaggtggacatctggagcgccggcgtgatcctgtacatcctgctctgcggcgtcccgccattctggggagacaacgacgagaagatcgcgcaggcggtcctccgcggcgtcatcgacttcaaccgggagccatggccgagggtgtccgccaacgccaaggacctcatccgccggatgctcgaccccgacccctccacccgcctcacggcgaggcaggtgcttgagcacccgtggctgaagaacgcggacacggcgccgaacgtgtcgctgggcgaggcggtgcgcgcgcggctgcagcagttctcggccatgaacaagttcaagaagaaggcgctgggggtggtggcgcggaacctgccggtggaggagctcgacaagtacgtgcagatgttccacctcatggacaaggaccacaacggcaacctcaccctggaggagctcatggagggcctccacatcaacggccagccggtgccggagtccgagatcaggatgctcctcgaggccgccgacacggacggcaacggcacgctggactgcgacgagttcgtgacggtgtcgctgcacctcaagaagatgagcaacgacgagtacctggcgtcggcgttcaggtacttcgacaaggacgggagcggattcatcgagccggaggagctgagggaggagctgggacccaacgaccaggccatcctcgacatcatccgcgacgtggacacggaccaggacggccgcatcagctaccaggagttcgagctcatgatgaaggccggcaccgactggaggaacggctccagacagtactccagggccaacttcagcagcctcagccggaagctctgcaaggacatgtcgtga

SEQ ID NO: 18927 - protein, 520 aa, Sorghum bicolor
  misc_feature: The sequence is a functional homolog of SEQ ID NO 2 in US patent 7084323
  misc_feature: Ceres ANNOT ID no. 8714084
  misc_feature (55)..(520): SWISSPROT Homolog: EC 2.7.11.1 Non-specific serine/threonine protein kinase
  misc_feature (68)..(315): Pfam ID: Pkinase Pfam Description: Protein kinase domain
  misc_feature (465)..(493): Pfam ID: efhand Pfam Description: EF hand
  misc_feature (398)..(426): Pfam ID: efhand Pfam Description: EF hand
  misc_feature (362)..(390): Pfam ID: efhand Pfam Description: EF hand
MGGCYSAFACSRKLRGRISFVLPVTERDRDSDSVASAAATPSPSPRKNDADAGPLVVRTTAAEFARRYVLGRELGRGEFGVTRRCKDAATGEREVAIMRRMSSRGGAAVVRLREACCEDSASGGGGGGGAVHLVMELCEGGELFDRIVARGHYSERAAAGVFGTIVDVVRLCHSNGVIHRDLKPENFLFANKSEDSPLKVIDFGLSVFFNPGDRFTEVVGSAYYMAPEVLKRNYGPEVDIWSAGVILYILLCGVPPFWGDNDEKIAQAVLRGVIDFNREPWPRVSANAKDLIRRMLDPDPSTRLTARQVLEHPWLKNADTAPNVSLGEAVRARLQQFSAMNKFKKKALGVVARNLPVEELDKYVQMFHLMDKDHNGNLTLEELMEGLHINGQPVPESEIRMLLEAADTDGNGTLDCDEFVTVSLHLKKMSNDEYLASAFRYFDKDGSGFIEPEELREELGPNDQAILDIIRDVDTDQDGRISYQEFELMMKAGTDWRNGSRQYSRANFSSLSRKLCKDMS

SEQ ID NO: 18928 - DNA, 711 bp, Sorghum bicolor
  misc_feature: Ceres ANNOT ID no. 8714137
  misc_feature: Encodes the peptide sequence at SEQ ID NO 18929
atggcaaacgagggcgcccgccgcgacgaggcacaggcggcggcgggaggcagcggtggtgtgtggtggcggcccccgttgcgcgccgaggacgagcacgccgtcatcgtcgcggcgctcgcgcacgtcgtcggcgaagggaggcaggcgcagcagcagcagccgccgcccgtgctcggccacggccagcaagtgatgcaccggactgcgccggcggtggagccgccgcagcagcagcgcctgcggtaccgcggcgtgcggcagcggccgtggggcaagtgggcggcggagatccgggacccggtgaaggcggcgcgcgtgtggctcggcaccttcgacaccgccgaggacgccgcgcgcgcctacgacgccgccgcgctccgcttcaagggcgccaaggccaagctcaacttccccttccagcagccggccaccacggccacggcttcgacgtcggcgacgctggcaccgactccgcggcaggggacgcgccacgccgcagctgcgcctgctggtgcccatcagcaggagttcccggacctcagccggtacgcgcacatcctccagagcggcggcgacctcgacctgcaggccttctccggcgctggcgggctgacgccagggcggtcctcgactaccacggcatcggcgtcgtcatcgtcgccgccggcgccgtcggtggattggtttccatggcgaggtcctgcctaa

SEQ ID NO: 18929 - protein, 236 aa, Sorghum bicolor
  misc_feature: Useful for making plants with altered lignin content
  misc_feature: Functional homolog of the protein sequence given in SEQ ID NO 13219
  misc_feature: Ceres ANNOT ID no. 8714137
  misc_feature (81)..(132): Pfam ID: AP2 Pfam Description: AP2 domain
MANEGARRDEAQAAAGGSGGVWWRPPLRAEDEHAVIVAALAHVVGEGRQAQQQQPPPVLGHGQQVMHRTAPAVEPPQQQRLRYRGVRQRPWGKWAAEIRDPVKAARVWLGTFDTAEDAARAYDAAALRFKGAKAKLNFPFQQPATTATASTSATLAPTPRQGTRHAAAAPAGAHQQEFPDLSRYAHILQSGGDLDLQAFSGAGGLTPGRSSTTTASASSSSPPAPSVDWFPWRGPA

SEQ ID NO: 18930 - DNA, 687 bp, Sorghum bicolor
  misc_feature: Ceres ANNOT ID no. 8714199
  misc_feature: Encodes the peptide sequence at SEQ ID NO 18931
atggagacgccttccgtccgcttccccacacatgtacagctagctgagcgcgcgcgtgagcagcgaagtgaccacgcaacgcaagcgagctcatcgccacttgcgaggctcttctcttctgttggctgcccacccacccagggccttggcaagatcgaaatggaggtgggggcggcggcgaggaggcgggcgcgggcggcgcatcagcaggaggagatcagggagagcaaggcggggaggaggaagcgcggcccggtggagctgcggcggatcgaggaccggacgagccggcaggtgcgcttctccaagcgccggagcgggctgttcaagaaggcctacgagctctccgtgctgtgcgacgcccaggtcgcgctcgtcgtcttctcccccgccggccgcctctacgagttcgcctccgccgactccagcattgaaaaagtattcggtcgatactgggaccttgccaacacagaaattgatctcaatattgaggcacgagagtcaagggtcaactgcaatatacaggttaagcataaatatttgataaaaataatacaaaaatatatatcactgcttttgtacataacgcaactgcacaaagggtcatctcccatggtccgtaaatccccatttttaaacgttagagatttaccgtcaacactttctttcttttcagaattttggtaa

SEQ ID NO: 18931 - protein, 228 aa, Sorghum bicolor
  misc_feature: Useful for making plants with modulated biomass
  misc_feature: Functional homolog of the protein sequence given in SEQ ID NO 13659
  misc_feature: Useful for making plants with modulated flowering time
  misc_feature: Functional homolog of the protein sequence given in SEQ ID NO 13660
  misc_feature: The sequence is a functional homolog of SEQ ID NO 1701 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1949 in the 10/412,699 US patent application
  misc_feature: Ceres ANNOT ID no. 8714199
  misc_feature (89)..(139): Pfam ID: SRF-TF Pfam Description: SRF-type transcription factor (DNA-binding and dimerisation domain)
METPSVRFPTHVQLAERAREQRSDHATQASSSPLARLFSSVGCPPTQGLGKIEMEVGAAARRRARAAHQQEEIRESKAGRRKRGPVELRRIEDRTSRQVRFSKRRSGLFKKAYELSVLCDAQVALVVFSPAGRLYEFASADSSIEKVFGRYWDLANTEIDLNIEARESRVNCNIQVKHKYLIKIIQKYISLLLYITQLHKGSSPMVRKSPFLNVRDLPSTLSFFSEFW

SEQ ID NO: 18932 - DNA, 1371 bp, Sorghum bicolor
  misc_feature: Ceres ANNOT ID no. 8714206
  misc_feature: Encodes the peptide sequence at SEQ ID NO 18933
atggactgggatctcaaggcgccgggcgcgtgggacctggcggagctggagcacgaacaacacgcggctgctacagcggcggcggcggggccgtcgggtggccacgccaatgctggcgtggcgggcacggggacggggtgccgcccgccgccgggggcagggggagcacccgccgagtgctccgtggacctgaagctgggcgggctgggcgagcctggcgcggcgccgccggcgcgcagggagagggaggccgcggcggcggcggctgctgctgcgggaaaggtggcgtcggcgtcgtccggcgccgcggcgggggcgaagcggccgcgccctggggggcagcatcagcaggggcaggggcagcatcagcagcagcagtgcccgtcgtgcgcggtggaagggtgcaaggcggacctgagcaagtgccgcgactaccaccggcggcacaaggtgtgcgaggcgcactccaagacccccgtcgtcgtcgtcgccggccgcgagatgcgcttctgccagcagtgcagcaggtttcacttacttgcggagtttgacgccgacaagcgcagctgtagaaagcgactagatgggcataatcgccgccgcaggaagccacaaccagacaccatggcttctgctagctttatcacaagccaacaaggcacacgattctcaccatttgcacctccaagactggaggcaagctggccgggggtgatcaaaaccgaggagagtccatattacactcaccaaatccctctgggatccagcagcaacaggcagcagcatttcgtgggatccaccacgcctgcttacgccaaagaaggccgtcgcttccctttcctgcaggagggcgagataagctttgccaccggcgtggtgctggagccgccggcgtgccagccgctcctcaagacggtagcagtagcaccacccgagagcagcagcagcagcagcgccggcgggggcaacaagatgttctccgacgggctgactcgcgtgctcgactcggaatgtgctctctctcttctgtcagcgccagccaactcctccggcatcgacgtcagcaggatggtccggccgactgaacacgtccccatggctcagcccgtcgtctcgggcctgcagttcggcagctcgtcgtggttctcgccgcgcccccaggcttccacgggcgtgacggcaggtagcgggttcccctcctgccccgccgtggtggagggcgagcagcagcagctcaacaccgtgctgagcccccacgacaacgaggtgaactacggcgggatgttccacgtcggcggcggcagcggtggtggcggcgagggctcctcggacggcggcacctcttcgtcgatgcccttctcgtggcagtag

SEQ ID NO: 18933 - protein, 456 aa, Sorghum bicolor
  misc_feature: Useful for making plants with altered terpenoid content
  misc_feature: Useful for making plants with modulated flowering time
  misc_feature: Functional homolog of the protein sequence given in SEQ ID NO 13706
  misc_feature: Ceres ANNOT ID no. 8714206
  misc_feature (129)..(207): Pfam ID: SBP Pfam Description: SBP domain
MDWDLKAPGAWDLAELEHEQHAAATAAAAGPSGGHANAGVAGTGTGCRPPPGAGGAPAECSVDLKLGGLGEPGAAPPARREREAAAAAAAAAGKVASASSGAAAGAKRPRPGGQHQQGQGQHQQQQCPSCAVEGCKADLSKCRDYHRRHKVCEAHSKTPVVVVAGREMRFCQQCSRFHLLAEFDADKRSCRKRLDGHNRRRRKPQPDTMASASFITSQQGTRFSPFAPPRLEASWPGVIKTEESPYYTHQIPLGSSSNRQQHFVGSTTPAYAKEGRRFPFLQEGEISFATGVVLEPPACQPLLKTVAVAPPESSSSSSAGGGNKMFSDGLTRVLDSECALSLLSAPANSSGIDVSRMVRPTEHVPMAQPVVSGLQFGSSSWFSPRPQASTGVTAGSGFPSCPAVVEGEQQQLNTVLSPHDNEVNYGGMFHVGGGSGGGGEGSSDGGTSSSMPFSWQ

SEQ ID NO: 18934 - DNA, 1059 bp, Sorghum bicolor
  misc_feature: Ceres ANNOT ID no. 8714218
  misc_feature: Encodes the peptide sequence at SEQ ID NO 18935
atggcggcggcctggaaggtgagaggcgacgccggcaggctcctcccggtcatcaccttcttcctcggcgcggccatgacgggggcgttcgtcttcctcggcgcgactatggacatgagctcgcgcttcgccgcgtggggcaatggcgcacgagcagtggccggagacgaggcgaaaccgtatgcggagctggaggagctgctgaagaacgcatccatggaggacaacacggtgatcgtgacgtccatcaacaaggcgtacgcggcgccgggctccctgctggacctcttcctcgagagcttccgggctggcaagggcacggcggggctgctggaccacctcctcatcgtgtccgtcgaccccggcgcgcacgagacatgccggtcggtgcaccgccactgctacctcctccggccggacaacaacaacgacgacggcggcggcgcggcggcggcggtggacctcagcgccgccaagtacttcatgaccaaggactacgtggccatgatgtgggcgaggaaccggttccagcagaccatcctggagctgggcttcagcttcctcttcacggacgtggacatcctgtggttccggaacccgatgcggcacatcgccgtcacgtcggacgtcgccatcgccagcgactacttcaacggcaacccggacagcctgcacaacctgcccaacggcggcttcctgtacgtcaggtccatgaacaggacggtggagttctaccggcggtggcgggaggcgcgcgccggcttcccgccggggaccaacgagcagagcgtcctggcgagggtgcagctcccgctgacgcgccgcctcggcgtgcggatgcagttcctcgacacggcgcactgcggcggcttctgccagctcaccgacgacctgcgcagggtgtccaccatgcacgccaactgctgcacgggcctcggcaacaaggtgcacgacctcaggaacgtgctccgggactggaggaactacacggcggcgccgagggaggtccgccgccggggaggcttcggatggacaaagcccggcaggtgcatccgttga

SEQ ID NO: 18935 - protein, 352 aa, Sorghum bicolor
  misc_feature: Useful for making plants with altered carbohydrate content
  misc_feature: Functional homolog of the protein sequence given in SEQ ID NO 14482
  misc_feature: Ceres ANNOT ID no. 8714218
MAAAWKVRGDAGRLLPVITFFLGAAMTGAFVFLGATMDMSSRFAAWGNGARAVAGDEAKPYAELEELLKNASMEDNTVIVTSINKAYAAPGSLLDLFLESFRAGKGTAGLLDHLLIVSVDPGAHETCRSVHRHCYLLRPDNNNDDGGGAAAAVDLSAAKYFMTKDYVAMMWARNRFQQTILELGFSFLFTDVDILWFRNPMRHIAVTSDVAIASDYFNGNPDSLHNLPNGGFLYVRSMNRTVEFYRRWREARAGFPPGTNEQSVLARVQLPLTRRLGVRMQFLDTAHCGGFCQLTDDLRRVSTMHANCCTGLGNKVHDLRNVLRDWRNYTAAPREVRRRGGFGWTKPGRCIR

SEQ ID NO: 18936 - DNA, 1611 bp, Sorghum bicolor
  misc_feature: Ceres ANNOT ID no. 8714209
  misc_feature: Encodes the peptide sequence at SEQ ID NO 18937
atggccctcgtgaagtcggacgctgaggaggagtggtccgactccgacttcgatgatgattccgacaacgaggtcggcgaagctctggactggctcgacgcagtggagggccctgacggctcagctcggccctccggcgccttctcggcctccggaggcggggctgcggcgcgcaggcccaacgcacacggcggtgtgctttcccgcccgctccagccgctctctaaccgcacccagaagctggcctcgcacattcgtgctacccccttggaggaatgggaaggtaggatgaatgtggggatgtcaaattccgtcacaactgcaatcagggatagcataagggacacagcgattggaaaaataaggaacactgagaaggctgatcgtgctacagtggaacaggctattgacccaagaacgcgcatggttctatttaagatgttaaaccgtggtgtctttaataacataaatggctgcatttctacagggaaagaggcaaatgtctatcatgcaacaaagacggatggtcaggagcttgcaatcaaagtctacaaaacctctgtccttgtttttaaggatagagaccgatatgttcaaggagattaccgttttagacatggttactgcaagcataatcctcggaaaatggttaagacctgggctgaaaaggaaatgagaaatcttctacgagtgagggcagctggaatccgatgccctgtaccgttactcctgaggcttcatgtattggtgatggaattcatagggaaaggaggttgggctgctcctcgtctcaaggacgctgctttgtcagatgacaagttgcgtgaaagttactttgagataattacaacaatgcggactctctaccaaaaatgcaaactggtccatggtgatttgagtgaatacaacattctatattttgagggccacctgtacattattgatgtttcgcaatccgttgatctagaccacccttcagctttggactttctgaaggaagattgcttgcatgtttctgacttctttaaaaaacgaggtgttcctgtcatgacagtaaccgatttatttaattttgttattgatcaaagcatttctgatgaagatgtcgatgattacctggaaaaggttcagcaaaaaattttggaaaatggaggtgcagttccaaacggtgatgaaattactccaacggtcatggtgcagacgctggattatgtgaagcagtgtgaggcagatattgtcaacatgtcaataatgcaacgctcatcctctggctatgagcctacagcagataagctttatgaccagcctttgttaggatttgtacggactaaaaacacacacgttgaaaaggggcaggagcaaaagcaagaacaatcggcacaaaataaagtggaggcagaggaggaagatagcgaatcttgctcgagttccgatgaagatgattcgtggcacgaggttgatcccaagatgggacccgaggaaaggaaggctgctcggaaggaaaacaagaagaaagtgaaggaagagaagagggaggctcgcaagaccaagatcccaaaggccgagaagaagaaaaggaagaaaatggcgaaggcaaagtgcaagcggtag

SEQ ID NO: 18937 - protein, 536 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 14677
  misc_feature: Ceres ANNOT ID no. 8714209
  misc_feature (73)..(439): SWISSPROT Homolog: EC 2.7.11.1 Non-specific serine/threonine protein kinase
  misc_feature (167)..(355): Pfam ID: RIO1 Pfam Description: RIO1 family
MALVKSDAEEEWSDSDFDDDSDNEVGEALDWLDAVEGPDGSARPSGAFSASGGGAAARRPNAHGGVLSRPLQPLSNRTQKLASHIRATPLEEWEGRMNVGMSNSVTTAIRDSIRDTAIGKIRNTEKADRATVEQAIDPRTRMVLFKMLNRGVFNNINGCISTGKEANVYHATKTDGQELAIKVYKTSVLVFKDRDRYVQGDYRFRHGYCKHNPRKMVKTWAEKEMRNLLRVRAAGIRCPVPLLLRLHVLVMEFIGKGGWAAPRLKDAALSDDKLRESYFEIITTMRTLYQKCKLVHGDLSEYNILYFEGHLYIIDVSQSVDLDHPSALDFLKEDCLHVSDFFKKRGVPVMTVTDLFNFVIDQSISDEDVDDYLEKVQQKILENGGAVPNGDEITPTVMVQTLDYVKQCEADIVNMSIMQRSSSGYEPTADKLYDQPLLGFVRTKNTHVEKGQEQKQEQSAQNKVEAEEEDSESCSSSDEDDSWHEVDPKMGPEERKAARKENKKKVKEEKREARKTKIPKAEKKKRKKMAKAKCKR

SEQ ID NO: 18938 - DNA, 1440 bp, Sorghum bicolor
  misc_feature: Ceres ANNOT ID no. 8714249
  misc_feature: Encodes the peptide sequence at SEQ ID NO 18939
atgccggccggcgtggtggacgcggccgccaagggcgtcaagctggagcggcacgcggtgctgctgcggcgcgcggcgggcgccaagcacctcgtgtcggcgtcgtcgcacctgctcttccgcgccaccgtgctcgccacgctcgcgctcgtcgtcctcttcgccgtgcactacccgtccctgctctcccactccttcaccctctccgcggcgcccgcctccccttcctccacgccgcggtcgcggcactcgcaccggagcctgctgggctcgggggcgtcgtcgtcgtacgggcggggcgccgcgtgggagcgggaggtgcggcgcagcgccacgccgcggcgggacggggcgctgtccgtgctcgtcacgggcgccgcgggcttcgtgggcgcgcactgctcgctggcgctccgcgcgcgcggcgacggcgtggtcggactcgacaacttcaacgcctactacgacccgtccctgaagcgcgcgcggcagcggctgctggcgtcccgcggcgtcgtggtgctggacgccgacatcaacgacgccgcgctcctggagcggctcctctcggccgtgcccttcacgcacgtgctgcacctcgccgcgcaggcgggcgtccgccacgcgatgcgggcgccgcaggcgtacgtggcgtccaacgtcgcgggcctcgtcgcgctcttcgaggccgcggcaaggcacgccgacccgcagccggcggtcgtgtgggcgtcgtcgtcgtcggtgtacgggctcaacaccgaggcgccgttctccgaggaccaccgcacggaccgacccgcgtcgctgtacgcggccaccaagaaggccggcgaggccatcgcgcactcgtacaaccacatctacggcctctccatcaccggcctgcgattcttcaccgtctacgggccgtgggggcgccccgacatggcctacttctccttcgcccgcagcatcgtcgccggcgagcccatcacgctgttccgcaccgccgacggcgccgacgcgcgccgcgacttcacctacattgacgacgtcgtcaggggctgcctcggcgcgctcgacacggccggcaagagcacgggctccaagtccggcaagaagtccgggcccgcgccgctccgcgtgtacaacctcggcaacacctcgccggtacccgtcacccggatggtcgccatcctcgagaagctcctcggcaagaaggcgcacaagcgcgtcgtcacgatgccgagcaacggcgacgtgcccttcacgcacgccaatgtcagccacgccgcgcgcgacttcggctaccgccccgccacctcgctcgaggacggcctccgccatttcgtcgactggttcgtgaggtactacaaggtcaacgtcaggggcggcggcaatgtcctcgccggcaagaccgccaagaggaaatccatgcccatgtccgcagcatcgtga

SEQ ID NO: 18939 - protein, 479 aa, Sorghum bicolor
  misc_feature: Useful for making plants with altered carbohydrate content
  misc_feature: Functional homolog of the protein sequence given in SEQ ID NO 14678
  misc_feature: Useful for making plants with altered cell wall content and/or composition
  misc_feature: Functional homolog of the protein sequence given in SEQ ID NO 14334
  misc_feature: Ceres ANNOT ID no. 8714249
  misc_feature (1)..(457): SWISSPROT Homolog: EC 5.1.3.6 UDP-glucuronate 4-epimerase
  misc_feature (121)..(380): Pfam ID: Epimerase Pfam Description: NAD dependent epimerase/dehydratase family
MPAGVVDAAAKGVKLERHAVLLRRAAGAKHLVSASSHLLFRATVLATLALVVLFAVHYPSLLSHSFTLSAAPASPSSTPRSRHSHRSLLGSGASSSYGRGAAWEREVRRSATPRRDGALSVLVTGAAGFVGAHCSLALRARGDGVVGLDNFNAYYDPSLKRARQRLLASRGVVVLDADINDAALLERLLSAVPFTHVLHLAAQAGVRHAMRAPQAYVASNVAGLVALFEAAARHADPQPAVVWASSSSVYGLNTEAPFSEDHRTDRPASLYAATKKAGEAIAHSYNHIYGLSITGLRFFTVYGPWGRPDMAYFSFARSIVAGEPITLFRTADGADARRDFTYIDDVVRGCLGALDTAGKSTGSKSGKKSGPAPLRVYNLGNTSPVPVTRMVAILEKLLGKKAHKRVVTMPSNGDVPFTHANVSHAARDFGYRPATSLEDGLRHFVDWFVRYYKVNVRGGGNVLAGKTAKRKSMPMSAAS

SEQ ID NO: 18940 - DNA, 1002 bp, Sorghum bicolor
  misc_feature: Ceres ANNOT ID no. 8714230
  misc_feature: Encodes the peptide sequence at SEQ ID NO 18941
atgcccggcgggtcttcaggcgcagatggtgaagtggatgcaggatttgcgaagctccagggggaggatttcgagtactacatgcagacatactccatcatgctgggacgcaacagcaagaaatcgacagtggatgtggatctctcgagcctcggtgggggtatgaacatctcccgccaccacgcccggatattctacgacttccagcgccgcaggttcgcgctcgatgtcattggcaagaacgggtgccttgttgagggtgtcctgcacctcccaggaaaccctcctgtgaagcttgattcgcaggatctgctgcagattggggacaagaagttctactttctactgccaacgcggtccatcttcgcctcagctgctgctgctcggcatgctcctgttattccaccgcagcttcctccaccatcatatgcacatgcacgggggccaggccgccctcgtttgtcagagtttcatgaccgctcctatgaagctgattatggtcgagaggttgatgagattgggaatggtatcagtgaaactgggatgaggggaaagctgataaagagaatcaagaagtcttctgtagacttggatatctatggtgggcatagaatcaatgtggaaccaataggaacactaggtgaagacagtagatcagacataagatcaaggggtgaaagggatattgacaaccaacaagcccttcaagcagaagagaaggatgttgtgtcatctgttgccacagtgttatcggacctctgcggccctggagaatggatgcccatggcaaaactccatacagagtttggcaatgtgtggcaccccagcagggtccgaaagtacttaacacaagacgactggtcaccaacagagacgaagggcaggccttggtttggccttctggcgctgctcagaaagtaccctgagcattttgtcatcaacacaagatcgaaaggtagaatgacctctgagttcgtttcgctggtctccttgctctcctag

SEQ ID NO: 18941 - protein, 333 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 13680
  misc_feature: Ceres ANNOT ID no. 8714230
  misc_feature (33)..(108): Pfam ID: FHA Pfam Description: FHA domain
MPGGSSGADGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPVIPPQLPPPSYAHARGPGRPRLSEFHDRSYEADYGREVDEIGNGISETGMRGKLIKRIKKSSVDLDIYGGHRINVEPIGTLGEDSRSDIRSRGERDIDNQQALQAEEKDVVSSVATVLSDLCGPGEWMPMAKLHTEFGNVWHPSRVRKYLTQDDWSPTETKGRPWFGLLALLRKYPEHFVINTRSKGRMTSEFVSLVSLLS

SEQ ID NO: 18942 - DNA, 1194 bp, Sorghum bicolor
  misc_feature: Ceres ANNOT ID no. 8714263
  misc_feature: Encodes the peptide sequence at SEQ ID NO 18943
atggagggcagcagagccggcgccggcgactacattgccagcctgctgagctcgtcgccgaggctcgacttcggcgtgctcggcgccgccgacggcggcggggaggaggaggactgcctggacaagttctgcggcgacccggggttcgcggcgcgcgcggcgcggctgtccagcttcagcgcgcagcgcttccccggcgccgcgagcctcttcggcctgcccccgccggtgcccgccgcgagcggcggcggcgagttcgctggctcccgggaggcgtcgtcggtgtcggacccggcgtccgcgatgatgaaggacgccaatgccaagaagcggaaggcgcccccggcggccaaaggcaaaggcaaggagtcctctgttcaggcaggggagcagaaggatccagacaccaagaggtgcaagacggagggaggcgaggggaaggagggaagccccgtgaagcccaagccggagcaggccgggagcgacagctccgtcgaggacggtgggcagacccagaagccgccgggcaaggggaagaatgcgaagctggtggagccccccaaggactacgtccatgtccgggccaggagagggcaggctaccgacagccacagcctcgcagagagggtgagaagagagaggatcagccagaggatgaaggttcttcaggacctggtgccaggatgcaacaaggtgattggcaaggcactgatgcttgacgagatcataaactacgtgcaatcgctgcaacgacaagtcgagttcctctccatgaagcttgcaaccgtgaacccacttgacttcagcaacctgcctaccctcctacaaaaagatatgttccaagcctgtggcccttcagcaagctcagtcttctcgctggaaagctccagctcagggtttccgttcagcgaccatggagatgtgttccagtcgttcgttccaaacggcttggagaaccagtgcggcctgaatccgttggacctggctctgtctcatgccaccactgggcagtatggttttcaggacggaacagccggcacaacaaacctgcagcaaagaagctactgggaggaggacctgcaaagcgttttccacatcgacaataacgggcaaagccaggagaacggggtttcagtttcagcacagagctttcacggccagttacaagaaggccacatgaaaatggagttctga

SEQ ID NO: 18943 - protein, 397 aa, Sorghum bicolor
  misc_feature: Useful for making plants with altered lignin content
  misc_feature: Functional homolog of the protein sequence given in SEQ ID NO 13755
  misc_feature: The sequence is a functional homolog of SEQ ID NO 1930 in the 10/374,780 US patent application
  misc_feature: Useful for making plants with modulated biomass
  misc_feature: Functional homolog of the protein sequence given in SEQ ID NO 13025
  misc_feature: Ceres ANNOT ID no. 8714263
  misc_feature (200)..(250): Pfam ID: HLH Pfam Description: Helix-loop-helix DNA-binding domain
MEGSRAGAGDYIASLLSSSPRLDFGVLGAADGGGEEEDCLDKFCGDPGFAARAARLSSFSAQRFPGAASLFGLPPPVPAASGGGEFAGSREASSVSDPASAMMKDANAKKRKAPPAAKGKGKESSVQAGEQKDPDTKRCKTEGGEGKEGSPVKPKPEQAGSDSSVEDGGQTQKPPGKGKNAKLVEPPKDYVHVRARRGQATDSHSLAERVRRERISQRMKVLQDLVPGCNKVIGKALMLDEIINYVQSLQRQVEFLSMKLATVNPLDFSNLPTLLQKDMFQACGPSASSVFSLESSSSGFPFSDHGDVFQSFVPNGLENQCGLNPLDLALSHATTGQYGFQDGTAGTTNLQQRSYWEEDLQSVFHIDNNGQSQENGVSVSAQSFHGQLQEGHMKMEF

SEQ ID NO: 18944 - DNA, 1275 bp, Sorghum bicolor
  misc_feature: Ceres ANNOT ID no. 8714251
  misc_feature: Encodes the peptide sequence at SEQ ID NO 18945
atggcgccgtcctcctcctgccacgccgccgccgtcctcctgctcgccgtcgccaccctagcgtgccatttcagtgtcctcgtcgtagccaccgacgtcgagtgccattgccacggcgcgaacgggaacgggtgccgcggcctcggcatcaactacggcacggtggccgacgacctcccctcggcatcgcgctccgtgcagctcctccgcgcgacgggcgcgggcgccgtgaagatctacgacgccaacgcggacatcctgcgcgcgctggccgggacggggatgccggtgtcgatcatggtgcccaactccgccatcccgtcgctggcctcctcccgcgccgcggcggaggactgggtggcggccaacctcgcgccgcacatcccggcgactcgtgtggcgtacctgctcgtcggcaacgaggtgctctcgaaccgcgccatcgcggggtccacgtggcgcagcgtcgtgccggcgatggcgaacctccaccgcgccctccgcgcgcacgggatccgcaaggtcaagatcgggacgacgctcgccatggacgcgctgtcggcgtcgtacccaccgtccgccggcgcgttccgcgacgacatcgccgaggacgtggtccggccgctgctccggttcctgaacgccaccgggtcctactacttcgtcgacgcgtacccgtacttcgcgtggtcaggcaaccgcaacgccatctccctcgactacgcgctgttccagggcgcggcgagctcgcgctacgtggacccgggcaacgggctcgtctacactaacctgctcgaccagatgctcgacgcggtcgtcgccgccatgggcaggctcgggtacggggacgtgaagctggcggtctcggagaccgggtggccgagcggcggcgacgcgggagaggccggcgccaacgtgcgcaacgccgccacgtacaaccggaacctggccgcgcggatgtccaagaaccccggcacgccggcgcggccgggggccaaggtgccggtgttcctcttctcgctctacaacgaggaccagaagccgggggccggcagcgagcggtgtacgaggtggacctcaccggccggcggtcgtcgtacccgccgctgccgcccgcggacgacacggacagcgcgccggcgtggtgcgtgctcggcagcaaggcggcggcgaacgagacggcggtggcggccgcggtggcgtacgcgtgccagcaggggagcgggacgtgcgccgccatccagcccggcggcgcgtgccacgagccggacatga

SEQ ID NO: 18945 - protein, 424 aa, Sorghum bicolor
  misc_feature: Useful for making plants with altered carbohydrate content
  misc_feature: Functional homolog of the protein sequence given in SEQ ID NO 14072
  misc_feature: Useful for making plants with altered cell wall content and/or composition
  misc_feature: Functional homolog of the protein sequence given in SEQ ID NO 14679
  misc_feature: Ceres ANNOT ID no. 8714251
  misc_feature (48)..(354): SWISSPROT Homolog: EC 3.2.1.39 Glucan endo-1,3-beta-D-glucosidase
  misc_feature (48)..(355): Pfam ID: Glyco_hydro_17 Pfam Description: Glycosyl hydrolases family 17
MAPSSSCHAAAVLLLAVATLACHFSVLVVATDVECHCHGANGNGCRGLGINYGTVADDLPSASRSVQLLRATGAGAVKIYDANADILRALAGTGMPVSIMVPNSAIPSLASSRAAAEDWVAANLAPHIPATRVAYLLVGNEVLSNRAIAGSTWRSVVPAMANLHRALRAHGIRKVKIGTTLAMDALSASYPPSAGAFRDDIAEDVVRPLLRFLNATGSYYFVDAYPYFAWSGNRNAISLDYALFQGAASSRYVDPGNGLVYTNLLDQMLDAVVAAMGRLGYGDVKLAVSETGWPSGGDAGEAGANVRNAATYNRNLAARMSKNPGTPARPGAKVPVFLFSLYNEDQKPGAGSERCTRWTSPAGGRRTRRCRPRTTRTARRRGACSAARRRRTRRRWRPRWRTRASRGAGRAPPSSPAARATSRT

SEQ ID NO: 18946 - DNA, 549 bp, Sorghum bicolor
  misc_feature: Ceres ANNOT ID no. 8714261
  misc_feature: Encodes the peptide sequence at SEQ ID NO 18947
atgggggacgagtcggacggggaggcggaggagtacctgttcaaggtggtgatcatcggggacagcgcggtggggaagagcaacctgctgtcccggtacgcccggaacgagttcagcctccactccaaggccaccatcggggtggagttccagacgcagagcatggacatcgacggtaaggaggtcaaggcccagatctgggacaccgccggccaggagcgcttccgcgccgtcacctccgcatactaccgcggcgccttcggcgcgctcctcgtctacgacatctcccgacgctccaccttcgacaacgtcggccgctggctccaggagctcaacagtggtgattgcgtcaggtgttctttagatggtaagaaagagggcatggcaagtgctaggctagatggatggattgagcgacctggtctgaatctggatctgaatcctgctgcctcgcttgttggggaaagttccatgaatgaatgtgtaggaccacttccgttagaattagtagtgttctgcaagctaggcttcgaattcggaaagtggtaa

SEQ ID NO: 18947 - protein, 182 aa, Sorghum bicolor
  misc_feature: Useful for making plants with altered terpenoid content
  misc_feature: Functional homolog of the protein sequence given in SEQ ID NO 13157
  misc_feature: Useful for making plants with altered alkaloid content
  misc_feature: Functional homolog of the protein sequence given in SEQ ID NO 13220
  misc_feature: Useful for making plants with altered lignin content
  misc_feature: Functional homolog of the protein sequence given in SEQ ID NO 13238
  misc_feature: Ceres ANNOT ID no. 8714261
  misc_feature (15)..(108): SWISSPROT Homolog: EC 2.7.11.1 Non-specific serine/threonine protein kinase
  misc_feature (15)..(159): Pfam ID: Ras Pfam Description: Ras family
MGDESDGEAEEYLFKVVIIGDSAVGKSNLLSRYARNEFSLHSKATIGVEFQTQSMDIDGKEVKAQIWDTAGQERFRAVTSAYYRGAFGALLVYDISRRSTFDNVGRWLQELNSGDCVRCSLDGKKEGMASARLDGWIERPGLNLDLNPAASLVGESSMNECVGPLPLELVVFCKLGFEFGKW

SEQ ID NO: 18948 - DNA, 3288 bp, Sorghum bicolor
  misc_feature: Ceres ANNOT ID no. 8714347
  misc_feature: Encodes the peptide sequence at SEQ ID NO 18949
atggcggcggcggcggcgccggggacgagctccggcggggccggaggcgatgggggcgggggcaccaaggtgaaccaggagctgtggtacgcgtgcgcggggccgctcgtgacgctgccgccggcggggagcctcgtcgtctacttcccccagggacacagcgagcaggtagcagcatctatgcgaaaggatgcagatgccaaaattccgagctatccaaatcttccatctaagcttatatgcatactccgtagtgtcactatgctagctgatcctgacacagatgaggtttatgctcgaatgactctccagccagttagcaatgtgacgcattgtgacaaggagacgttgctggcatcagaccttgcactgaaacaaaccagaccacagacagagttcttttgtaaaacactgactgcaagtgatacaagcactcatggaggtttctctgtgccacggcgtgctgcagagcgaattttcccccatcttgacttctcaatgcagcctcctgctcaggaactgcaggcgagggatttgcacgatgcaatttggacattccgtcatatatatcgaggtcagcctaaaaggcatttgctgactactggctggagcctatttgtcagtggaaagagactccttgctggtgattcagtcctgtttattagggatggaagacagcaactcctcttggggataaggcgggcaaataggcagcctgttaacctctcatcatctgttttgtctagtgacagtatgcatattggaattcttgctgctgcagcccatgcagcagctaataacagtcaattcacagtattctataatccaagggctagtccttcagaatttgttattccttttgccaagtaccagaaggctgtctacagcaaccaactatcacttggcatgcggtttagaatgatgtttgaaactgaagaatctgcaacaagaaggtacatgggaacaataactggtataagtgatatggatcctgtaaggtggaaaaactcccaatggcgcaatattcaggttgcatgggatgaagcagcaccaactgagagacgcaccagggtttccctttgggaggttgaacctgttatagctccattcttcatttatccctcgccattgttcactgcaaaacgtccgagacaacctgggataacagatgatgatagctcagaaatggacactctttttaagcggaccatgccatggtttggtgaggagattggcaagaaagatctgagtactcaaaacagtttagttcctggattaagtttagtccagtggatgaacatgcaacagacctcctctctcaccagcacagttatgcaaccggaattgctaaattcattagctggaaaacctgtacaaactctggctgcagctgatctatctaggcaaattagcttccagccccagttcctgcaacaaaataacatccagttcaacacttcgttgctacctccccaaaaccagcagactgaacagttagcaaatgtaatagctacaccaaaccaattgggaagtgttatagtaccacaaaaggtagttccaaattgcagttctgaacagaaacagaatccggtaactcaaccactgcaagtcagccaaccaatgattagtatggcacagcctcaacttgtccatactcaactccagcagcctcaagtcattctccaggctcagcctcagcaacctcaagtcattgtccaagctcaactacagcaacagcaacctttggttcaaaatcacaccaccatacaaggtggtcttcaacaaatccagcttctgcagcaacagcatcctcatctgcagcagcagcaggttcagcagtcagtgcaggaacaacagcaaataaagatacaaccttttcaggtacctaatgatgcaaacatggtaacacagttatctgatcagatgaaaatacaactattgaaggctctacaaccacagcagcctctggtcatggaccagcagaaaatgatattggatttacagcaacaagcagtaaattctcagtcaactgctcagcagtgctcacaggtagctacccaagtggttggtttgcatagcagtagcactattcagtacccgacgcagcaaaagactcaacctcacaaaacaattcaagattttcctgggaatgctgtttctattgtcaaatcagaaaatgtcacttccatgggtgctcgctctttgcatgtgcctggtggagtgcagtcaatgaagacggatgaagttccctcttcttcaacatcaccatccacaaacaataatcctgttattttgcgatcaactccaagtagctccaagaaccaatgtttatctactgcaacaaaggctcctcaatcatctgttgtattgggttgtacacttgaacagggtatgaaaccttatgagagtacacagcacacaatggcgattcccaagatggctgaagaaaggccagctactggacaagactacatgaacagcactcagatagaatatttggatacgtcctcttcagcgacttcagtttgcctttctcaggctgacggatcactgcaacaaaattttccaccatccttcaatcagcatcaaacattgagagaaactgttccagatagcgagtttgaggttacagatccaggaactaactttctattcggggcaaacatcgatggccatatggagcctcttaatgaagacgctttgcttggaaatacctttgaaactgagaagtacatggatcagatgccaggaaatggcatctctaactacatttcatcaaaggatgctcaacaagagttgtcatcttcagtgatttcacattcatttggtgttgctgatattgcatttaattccatagattcatcaatcaatgatatcccattcttaaatagaaattcccgggctccaggtcctgctcatcaacggatacgaacatacaccaaggtgcacaagcgtggtgctgttggaagatctattgacatcaacagatattctggatatgatgaactgaagcatgatattgcccgtatgtttggtattgaggggcaactcagtgaccaaaatagagtttgctggaagctagtatatgaagatcacgagaaggatgttctattagttggtgatgacccatgggaggactttgtgaactgcgtccggtgcatcaggattctttcgccacaggaagaaaggcaaatgagactggccagtgactacggagacagctttcttggtaaccaagcatgcagcagttcagacggggttcacccgtggagggtcaccggtgactag

SEQ ID NO: 18949 - protein, 1095 aa, Sorghum bicolor
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: Ceres ANNOT ID no. 8714347
  misc_feature (260)..(343): Pfam ID: Auxin_resp Pfam Description: Auxin response factor
  misc_feature (133)..(238): Pfam ID: B3 Pfam Description: B3 DNA binding domain
MAAAAAPGTSSGGAGGDGGGGTKVNQELWYACAGPLVTLPPAGSLVVYFPQGHSEQVAASMRKDADAKIPSYPNLPSKLICILRSVTMLADPDTDEVYARMTLQPVSNVTHCDKETLLASDLALKQTRPQTEFFCKTLTASDTSTHGGFSVPRRAAERIFPHLDFSMQPPAQELQARDLHDAIWTFRHIYRGQPKRHLLTTGWSLFVSGKRLLAGDSVLFIRDGRQQLLLGIRRANRQPVNLSSSVLSSDSMHIGILAAAAHAAANNSQFTVFYNPRASPSEFVIPFAKYQKAVYSNQLSLGMRFRMMFETEESATRRYMGTITGISDMDPVRWKNSQWRNIQVAWDEAAPTERRTRVSLWEVEPVIAPFFIYPSPLFTAKRPRQPGITDDDSSEMDTLFKRTMPWFGEEIGKKDLSTQNSLVPGLSLVQWMNMQQTSSLTSTVMQPELLNSLAGKPVQTLAAADLSRQISFQPQFLQQNNIQFNTSLLPPQNQQTEQLANVIATPNQLGSVIVPQKVVPNCSSEQKQNPVTQPLQVSQPMISMAQPQLVHTQLQQPQVILQAQPQQPQVIVQAQLQQQQPLVQNHTTIQGGLQQIQLLQQQHPHLQQQQVQQSVQEQQQIKIQPFQVPNDANMVTQLSDQMKIQLLKALQPQQPLVMDQQKMILDLQQQAVNSQSTAQQCSQVATQVVGLHSSSTIQYPTQQKTQPHKTIQDFPGNAVSIVKSENVTSMGARSLHVPGGVQSMKTDEVPSSSTSPSTNNNPVILRSTPSSSKNQCLSTATKAPQSSVVLGCTLEQGMKPYESTQHTMAIPKMAEERPATGQDYMNSTQIEYLDTSSSATSVCLSQADGSLQQNFPPSFNQHQTLRETVPDSEFEVTDPGTNFLFGANIDGHMEPLNEDALLGNTFETEKYMDQMPGNGISNYISSKDAQQELSSSVISHSFGVADIAFNSIDSSINDIPFLNRNSRAPGPAHQRIRTYTKVHKRGAVGRSIDINRYSGYDELKHDIARMFGIEGQLSDQNRVCWKLVYEDHEKDVLLVGDDPWEDFVNCVRCIRILSPQEERQMRLASDYGDSFLGNQACSSSDGVHPWRVTGD

SEQ ID NO: 18950 - DNA, 195 bp, Sorghum bicolor
  misc_feature: Ceres ANNOT ID no. 8714370
  misc_feature: Encodes the peptide sequence at SEQ ID NO 18951
atggcggagcagaaggagaggatgttggagttcgctcgacgctttagatggcgcatccacaaggccagcatggaagctatcaacgccttctacttccagattggcgtccccagaactggacgagcaacaatgggcacctcgcctccacgctatgcaagaagaccaagctcacggcggagcagaaggagcggatga

SEQ ID NO: 18951 - protein, 64 aa, Sorghum bicolor
  misc_feature: The sequence is a functional homolog of SEQ ID NO 122 in the 10/714,887 US patent application
  misc_feature: The sequence is a functional homolog of SEQ ID NO 122 in the 11/435,388 US patent application
  misc_feature: The sequence is a functional homolog of SEQ ID NO 126 in the 10/714,887 US patent application
  misc_feature: The sequence is a functional homolog of SEQ ID NO 126 in the 11/435,388 US patent application
  misc_feature: The sequence is a functional homolog of SEQ ID NO 58 in the 10/714,887 US patent application
  misc_feature: The sequence is a functional homolog of SEQ ID NO 58 in the 11/435,388 US patent application
  misc_feature: The sequence is a functional homolog of SEQ ID NO 622 in the 10/666,642 US patent application
  misc_feature: The sequence is a functional homolog of SEQ ID NO 60 in the 10/714,887 US patent application
  misc_feature: The sequence is a functional homolog of SEQ ID NO 60 in the 11/435,388 US patent application
  misc_feature: The sequence is a functional homolog of SEQ ID NO 128 in the 10/714,887 US patent application
  misc_feature: The sequence is a functional homolog of SEQ ID NO 128 in the 11/435,388 US patent application
  misc_feature: Ceres ANNOT ID no. 8714370
MAEQKERMLEFARRFRWRIHKASMEAINAFYFQIGVPRTGRATMGTSPPRYARRPSSRRSRRSG

SEQ ID NO: 18952 - DNA, 831 bp, Sorghum bicolor
  misc_feature: Ceres ANNOT ID no. 8714361
  misc_feature: Encodes the peptide sequence at SEQ ID NO 18953
atggagtccaaagcagaaaattctatgatcagccccattgagaactctgtatctccaccatctgtgaagagacagaaaacattatctgataaagatagtgaccaatgtgatgatgcatctcagcaagtagtcatctataagaatgacaaaagtgataggggaagagatgaacagagtggaagccatctcccaattgtaccagcaaaaccgtcaaagaagcaaaagcgtgcattgggaaagcaaattggagcctttgctgctcaatgtgctaaatgtcagaaatggagacttatttcaacaaaagagaagtacgaagaaattcgagagcaagctctagaggatccttttgtctgtgagaaagcctgtgagtggaagcctgatgtgacatgcgatgacccatcagatgtatctcaggacaacggtatgctttgggcaattgataaacctaacattccacggacccctcaagaatgggaaagattggttaagataagaggtgaaggaagcaccaaatttgctgatgtgtactattggtcccctacaggaacacaactgagatcaagcaaggaagtggagaagtaccttgaagagcatccagaatgtgctgcgcaaggtgtaaagttatctcatttttcattccagtcacctgcaccactacaaaaggactatgttaggaagcgttcccagacaagccaaagtgttgttacaccaacaaggtcaactatgcttctcccaccggaagaagttgtgcctgggagacttatgtcctcgctccaaccatatagacatttttgtcctcaccccaaacatatggcttctaacatgggttag

SEQ ID NO: 18953 - protein, 276 aa, Sorghum bicolor
  misc_feature: Useful for making plants with altered terpenoid content
  misc_feature: Functional homolog of the protein sequence given in SEQ ID NO 13054
  misc_feature: Useful for making plants with altered alkaloid content
  misc_feature: Functional homolog of the protein sequence given in SEQ ID NO 13172
  misc_feature: Ceres ANNOT ID no. 8714361
  misc_feature (84)..(137): Pfam ID: zf-CW Pfam Description: CW-type Zinc Finger
  misc_feature (144)..(221): Pfam ID: MBD Pfam Description: Methyl-CpG binding domain
MESKAENSMISPIENSVSPPSVKRQKTLSDKDSDQCDDASQQVVIYKNDKSDRGRDEQSGSHLPIVPAKPSKKQKRALGKQIGAFAAQCAKCQKWRLISTKEKYEEIREQALEDPFVCEKACEWKPDVTCDDPSDVSQDNGMLWAIDKPNIPRTPQEWERLVKIRGEGSTKFADVYYWSPTGTQLRSSKEVEKYLEEHPECAAQGVKLSHFSFQSPAPLQKDYVRKRSQTSQSVVTPTRSTMLLPPEEVVPGRLMSSLQPYRHFCPHPKHMASNMG

SEQ ID NO: 18954 - DNA, 867 bp, Sorghum bicolor
  misc_feature: Ceres ANNOT ID no. 8714363
  misc_feature: Encodes the peptide sequence at SEQ ID NO 18955
atggactccaaaccagaaaaatctatgatcactcccaatgagaactctgtatcttcaccatctgggaagagacagaaaacattatatgataaagatggtgagcaatgtgatgatgcatctcagcaagtagtcatctataagaatgacaaaagtgataggggaagagatgaacagagtgcaagccatctcccaattgtaccagcaaaaccatcaaagaaacgaaagcgtgcattgggaaagaaacgaaagcgtgcattgggaaagcaaattggaacctttgtttctcaatgtgctaaatgtcagaaatggagacttgtttcaacaaaagagaagtacgaagaaattcgagagcaagctctagaggatccttttgtctgtgagaaagcccgtgagtggaagcctgatgtgacatgcgatgacccatcagatgtatctgaggatagcggtatgctttgggcaattgataaacctaacatcccacggacccctcaagaatgggaaaggttgattaagataagaggtgaaggaagcaccaaatttgctgatgtgtaccttggagagcatccagaatatgccgcacaaggtttaaagttatctcatttttcattcaagtcacctgcaccactacaaaaggactatgttaggaagcgttcccagacaagtcaaagtggtgttacaccaaaaaggtcaactaagcttctccaaccggaagaagtgcaacccatctcctgggcacctccaccggcggatggcaacctggagaacaacatgcagctggtcctcaacaatggagatcagactcaagtggtgcagtcgtcgtctgaaccgccagagcctgagagcccgccgcctgcaccagcagcttag

SEQ ID NO: 18955 - protein, 288 aa, Sorghum bicolor
  misc_feature: Useful for making plants with altered terpenoid content
  misc_feature: Functional homolog of the protein sequence given in SEQ ID NO 13054
  misc_feature: Ceres ANNOT ID no. 8714363
  misc_feature (92)..(145): Pfam ID: zf-CW Pfam Description: CW-type Zinc Finger
MDSKPEKSMITPNENSVSSPSGKRQKTLYDKDGEQCDDASQQVVIYKNDKSDRGRDEQSASHLPIVPAKPSKKRKRALGKKRKRALGKQIGTFVSQCAKCQKWRLVSTKEKYEEIREQALEDPFVCEKAREWKPDVTCDDPSDVSEDSGMLWAIDKPNIPRTPQEWERLIKIRGEGSTKFADVYLGEHPEYAAQGLKLSHFSFKSPAPLQKDYVRKRSQTSQSGVTPKRSTKLLQPEEVQPISWAPPPADGNLENNMQLVLNNGDQTQVVQSSSEPPEPESPPPAPAA

SEQ ID NO: 18956 - DNA, 765 bp, Sorghum bicolor
  misc_feature: Ceres ANNOT ID no. 8714374
  misc_feature: Encodes the peptide sequence at SEQ ID NO 18957
atggcggcgtggagggacggctacctggacatggtgctcatcccgctcgccatcctcttccccgccctataccacctctggctctaccgcgccgtccgccgcagccctctcagctccaccgtcggcatcagcgccgccgctcgccgcatctgggtcttctccatgatgaagaacaacgagaagcaggcggtgaccgtggtgcagtcgatccggaacgtgctgatgggttcgacgctggtgggcacgacgtcgatcctcttctgcacgggcgtggcggcggtgctgagcagcacctacgccgtgaagaagccgctcagcgacgccgtcttcggcgcgcacggcgagtacatgatggcgctcaagtacctgctcctcctctccgtcttcctcctcgccttcctctgccacagcctcgccatctgcacgctcaaccaggcctctttcctcgtcaacgcgctctcgccggcgccgcacctccacctccccggcgtcacgcgggactacgtcgccgacgtcatggagagaggattcatcctcaacctcgccggcaaccgcctcttcttcgccggcgcgcccctcctgctctggatctctggccccgtgttcccctgcatctgctcaatggccatgatccctgttctttataacatggacgtggtcgatgacgccgacgatggccggagcaggagcagcagcggtggagccaatggcgctgtcgtcgtcatggatggcgagagtgacgatcagagcattgaagtcgtctga

SEQ ID NO: 18957 - protein, 254 aa, Sorghum bicolor
  misc_feature: Useful for making plants with altered terpenoid content
  misc_feature: Functional homolog of the protein sequence given in SEQ ID NO 14331
  misc_feature: Ceres ANNOT ID no. 8714374
MAAWRDGYLDMVLIPLAILFPALYHLWLYRAVRRSPLSSTVGISAAARRIWVFSMMKNNEKQAVTVVQSIRNVLMGSTLVGTTSILFCTGVAAVLSSTYAVKKPLSDAVFGAHGEYMMALKYLLLLSVFLLAFLCHSLAICTLNQASFLVNALSPAPHLHLPGVTRDYVADVMERGFILNLAGNRLFFAGAPLLLWISGPVFPCICSMAMIPVLYNMDVVDDADDGRSRSSSGGANGAVVVMDGESDDQSIEVV

SEQ ID NO: 18958 - DNA, 876 bp, Sorghum bicolor
  misc_feature: Ceres ANNOT ID no. 8714388
  misc_feature: Encodes the peptide sequence at SEQ ID NO 18959
atgtcggggacgcgaggggcggcattgctgctgcttctgctagccactttggcggcggcggtgatggcgggcggcgagaaggtctgcgacaaggggtgggagtgcagcggcagccggttctgctgcaacgagaccatcggcgacttcttcaaggcgtaccagttcgaggagctcttccccaagcgcaactccgatctcgcccacgccgccggcttctgggattacaaggccttcatcaccgccgccgcgctctttgagccccgcgggttcggcaccactggaggcaaggagatgggcatgatggaggtcgccgccttccttggccacgtcggcgccaagacatcctcttgggggctttgctacaaccatgaattgagcccaagccagagctattgtgacgatagcaatgaattatacccttgtgttgaaggagttgagtactatggtcgaggtgctcttcctgtttactggaactacaactatggtatcgtcgggaagggtatcaagcaggatttgttgaaccacccagagctactggaacagaatgccacacttgcatttgaagcagccatttggaggtggatgactccaatgaagaggaagcagccatctgctcatgatgtgtttgttggtaactggaaacccaccaagaaggacacattatccaagaggtatcctggctttggtgctaccatgaacatcctgtatggtgatgccatctgtggtaaaggatccaccgataagatgaacttcattatatcccattaccaacattatcttggcttgatgggagttggccgtgagcgctctgaagataacttggattgtagtgaccaggtggctttcaatccatcatcagagagttctgacttctaa

SEQ ID NO: 18959 - protein, 291 aa, Sorghum bicolor
  misc_feature: Useful for making plants with modulated water use efficiency
  misc_feature: Functional homolog of the protein sequence given in SEQ ID NO 14327
  misc_feature: Useful for making plants with altered cell wall content and/or composition
  misc_feature: Functional homolog of the protein sequence given in SEQ ID NO 14328
  misc_feature: Ceres ANNOT ID no. 8714388
  misc_feature (34)..(282): SWISSPROT Homolog: EC 3.2.1.14 Chitinase
  misc_feature (49)..(276): Pfam ID: Glyco_hydro_19 Pfam Description: Chitinase class I
MSGTRGAALLLLLLATLAAAVMAGGEKVCDKGWECSGSRFCCNETIGDFFKAYQFEELFPKRNSDLAHAAGFWDYKAFITAAALFEPRGFGTTGGKEMGMMEVAAFLGHVGAKTSSWGLCYNHELSPSQSYCDDSNELYPCVEGVEYYGRGALPVYWNYNYGIVGKGIKQDLLNHPELLEQNATLAFEAAIWRWMTPMKRKQPSAHDVFVGNWKPTKKDTLSKRYPGFGATMNILYGDAICGKGSTDKMNFIISHYQHYLGLMGVGRERSEDNLDCSDQVAFNPSSESSDF

SEQ ID NO: 18960 - DNA, 978 bp, Sorghum bicolor
  misc_feature: Ceres ANNOT ID no. 8714408
  misc_feature: Encodes the peptide sequence at SEQ ID NO 18961
atggcgacgatgcagcaccaggccgctgcggcgccgccgagcacgacgactggcggcgggcagcgcgcgatggacctgtacgagaagctggagaaggttggggaggggacgtacgggaaggtgtacagggcgcgagagaaggcgacggggcggatcgtggcgctgaagaagacgcggctccccgaggacgacgagggcgtgcctcccaccgcgatgcgggaggtctccctgctgcggatgctgtcgcaggacccgcacgtggtgcgcctgctggacctcaagcagggcgtcaacaaggaggggcagaccatcctctacctcgtcttcgagtacatggacaccgacctcaagaagttcatccgcggacaccgcaacaaccgcgagaagatccccgaggccaccgtgaagatcctcatgtaccagctgtgcaagggcgtggccttcgtccacggccgtggggtgctgcaccgtgatctcaagccgcacaatctgctgatggaccgcaagaccatggcgcttaagatcgccgacctcggcctcagccgcgccatcaccgtccctatcaagaagtacacccacgagatccttactctctggtacagggctcccgagattctcctaggcgccacgcactactccacgcctgttgacatatggtctgttggctgcatttttgctgagttggtcactaaccagccacttttccctggtgactccgagttgcagcagctgctccacatcttcaagttgctgggcaccccgaatgaggaggtgtggccaggcgttgacaagctgcccaattggcacgtgtacccccagtggaagccgacgaagctgtccactcttgtgcccggtcttgacgctgatggctacgatctccttgagaaaatgctggtgttcgagccggggaagcggatccctgcgaagaaggccctggagcacccctacttcaacgacgtgaggaaagagatgcactga

SEQ ID NO: 18961 - protein, 325 aa, Sorghum bicolor
  misc_feature: Useful for making plants with modulated nitrogen use efficiency
  misc_feature: Functional homolog of the protein sequence given in SEQ ID NO 14265
  misc_feature: Useful for making plants with modulated growth rate
  misc_feature: Functional homolog of the protein sequence given in SEQ ID NO 14264
  misc_feature: Ceres ANNOT ID no. 8714408
  misc_feature (24)..(321): SWISSPROT Homolog: EC 2.7.11.22 Cyclin-dependent kinase
  misc_feature (27)..(317): Pfam ID: Pkinase Pfam Description: Protein kinase domain
MATMQHQAAAAPPSTTTGGGQRAMDLYEKLEKVGEGTYGKVYRAREKATGRIVALKKTRLPEDDEGVPPTAMREVSLLRMLSQDPHVVRLLDLKQGVNKEGQTILYLVFEYMDTDLKKFIRGHRNNREKIPEATVKILMYQLCKGVAFVHGRGVLHRDLKPHNLLMDRKTMALKIADLGLSRAITVPIKKYTHEILTLWYRAPEILLGATHYSTPVDIWSVGCIFAELVTNQPLFPGDSELQQLLHIFKLLGTPNEEVWPGVDKLPNWHVYPQWKPTKLSTLVPGLDADGYDLLEKMLVFEPGKRIPAKKALEHPYFNDVRKEMH

SEQ ID NO: 18962 - DNA, 993 bp, Sorghum bicolor
  misc_feature: Ceres ANNOT ID no. 8714427
  misc_feature: Encodes the peptide sequence at SEQ ID NO 18963
atgggcgacacgctgtgggacctgctcggggaggagatggcggcggcgggcggcgagcacgggcttcccccagggttccggttccaccccaccgacgaggagctggtgaccttctacctggcggccaaggtgttcaacggcgcctgctgcggcatcgacatcgccgaggtggacctcaaccggtgcgagccgtgggagctccccgacgcggcgcgcatgggggagcgcgagtggtacttcttcagcctccgcgaccgcaagtaccccacgggcctccgcaccaaccgcgccaccggcgccggctactggaaggccaccggcaaggaccgcgaggtgctcaacgccgccaccggcgcgctcctcggcatgaagaagacgctcgtcttctacaagggccgcgcgccgcgcggggagaagaccaagtgggtcctccacgagtaccgcctcgacggcgacttcgccgccgctcgccgcccatgcaaggaggaatgggtgatctgcaggatactgcacaaggcaggcgacctgtacagcaagctgatgatggtgaagaacccctactacctccccatggcaatggaaccctccagcttctgcttccagcaggagcccaccgcgcatcccctcacaaaccctagcggcggctgcacaatacccctcggcctccccttccaccacggccaccccggcatgcagccgccgtcgccgagcaaccatggcaacaagcaggtcgtcttcgccggggcagcgggctgctgcatgcagcaagagccgccaaacggcagcaacagcgccgtgctgcccatgccgccgttccctcccttcactcccatcgtcgctggcaagccggcggccccggcgccaccgccccaggtcggggtcaacgccggtccacaggagccaccgccaccaacctggctggaggcctacctgcagcacagtgatgggatcctttatgagatgggcccagctgcagcgcccaggggcgcatga

SEQ ID NO: 18963 - protein, 330 aa, Sorghum bicolor
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with altered lignin content
  misc_feature: Functional homolog of the protein sequence given in SEQ ID NO 13250
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 890 in the 10/374,780 US patent application
  misc_feature: Useful for making plants with altered carbohydrate content
  misc_feature: Functional homolog of the protein sequence given in SEQ ID NO 13622
  misc_feature: The sequence is a functional homolog of SEQ ID NO 891 in the 10/374,780 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: Useful for biocontainment applications
  misc_feature: Functional homolog of the protein sequence given in SEQ ID NO 13623
  misc_feature: Useful for making plants with modulated oxidative stress sensitivity
  misc_feature: Functional homolog of the protein sequence given in SEQ ID NO 13621
  misc_feature: Useful for making plants with altered cell wall content and/or composition
  misc_feature: Functional homolog of the protein sequence given in SEQ ID NO 13620
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Ceres ANNOT ID no. 8714427
  misc_feature (22)..(150): Pfam ID: NAM Pfam Description: No apical meristem (NAM) protein
MGDTLWDLLGEEMAAAGGEHGLPPGFRFHPTDEELVTFYLAAKVFNGACCGIDIAEVDLNRCEPWELPDAARMGEREWYFFSLRDRKYPTGLRTNRATGAGYWKATGKDREVLNAATGALLGMKKTLVFYKGRAPRGEKTKWVLHEYRLDGDFAAARRPCKEEWVICRILHKAGDLYSKLMMVKNPYYLPMAMEPSSFCFQQEPTAHPLTNPSGGCTIPLGLPFHHGHPGMQPPSPSNHGNKQVVFAGAAGCCMQQEPPNGSNSAVLPMPPFPPFTPIVAGKPAAPAPPPQVGVNAGPQEPPPPTWLEAYLQHSDGILYEMGPAAAPRGA

SEQ ID NO: 18964 - DNA, 1251 bp, Sorghum bicolor
  misc_feature: Ceres ANNOT ID no. 8714460
  misc_feature: Encodes the peptide sequence at SEQ ID NO 18965
atgtacggctcgccggtgtccaaggacctgaacctcccggtacagccgccgatgacctcgtccgggctgctacgctacagatcggcgcccagcacggtgctcggcgacctctgcgaggacctgctccctccggctccgggcgccggccccccgcgcgatggcgccgacaacgtcatctccaggttcctggccgaccaccaccaccacatccgggacgacaagccgtcgccgccgccgccgccggcggcggcgcctgcccacttcccgagtgcggccgacatggcctcccagcagcaccagcatcagcaaatgatgttccactcccagtcccagcagcagcatatggtggacgctaataagcccggcgggctctaccgcaccgtcagctcgggcatggaagacgccgccgggaccggcgccggcgtcggcgtgggcgcggccagcaacctgattcggcagagcagctcccccgcggggttcctggatcatttcagcatggacaacgggtacggcgcgatgctgagggcgagcatgggcatgggcttccgggacggcagcggcggcgttggcggggcaggtggcgcggcgacggactccctcgcgggcggcggcggcggtggcggtagcggtagcggcaggctcaaggggcagctgagcttctcgtcgcggcaggggtcgctgatgtctcagatctcggagatggacagcgaggagatcggagggagcagccccgaggctgctgcgggcggcaggggcgggtacatcccggggtatccgatgagctccgccgggtgggacgactcgtcgtcggcgctcatgtccgacagcctgtccgggatgaaacgcccgcgggactcgtcggagcctggcggccagcagcagcagcagcagcagaacggtggtggagggctggcgcaccagttcagcctgcccaagacgtcgtcggagatggcggccatcgagaagttcctccagttccaggacgccgtgccctgcaagatccgcgccaagcgcgggtgcgccacgcacccgcgcagcatcgccgagcgggtgaggaggacaaagatcagcgagcgaatcaggaagctgcaggagctcgtgcccaacatggacaagcaaaccaacacctccgacatgctggacttggccgtcgactacatcaaggatctccagaagcaggtcaaggcgttgaacgagagccgcgccagctgcacctgcccggcgagcaagcaccagcagttctccggctga

SEQ ID NO: 18965 - protein, 416 aa, Sorghum bicolor
  misc_feature: The sequence is a functional homolog of SEQ ID NO 1258 in the 10/412,699 US patent application
  misc_feature: The sequence is a functional homolog of SEQ ID NO 172 in the 10/714,887 US patent application
  misc_feature: The sequence is a functional homolog of SEQ ID NO 172 in the 11/435,388 US patent application
  misc_feature: The sequence is a functional homolog of SEQ ID NO 178 in the 10/714,887 US patent application
  misc_feature: The sequence is a functional homolog of SEQ ID NO 178 in the 11/435,388 US patent application
  misc_feature: The sequence is a functional homolog of SEQ ID NO 174 in the 10/714,887 US patent application
  misc_feature: The sequence is a functional homolog of SEQ ID NO 174 in the 11/435,388 US patent application
  misc_feature: The sequence is a functional homolog of SEQ ID NO 190 in the 10/714,887 US patent application
  misc_feature: The sequence is a functional homolog of SEQ ID NO 190 in the 11/435,388 US patent application
  misc_feature: The sequence is a functional homolog of SEQ ID NO 188 in the 10/714,887 US patent application
  misc_feature: The sequence is a functional homolog of SEQ ID NO 188 in the 11/435,388 US patent application
  misc_feature: The sequence is a functional homolog of SEQ ID NO 186 in the 10/714,887 US patent application
  misc_feature: The sequence is a functional homolog of SEQ ID NO 186 in the 11/435,388 US patent application
  misc_feature: The sequence is a functional homolog of SEQ ID NO 184 in the 10/714,887 US patent application
  misc_feature: The sequence is a functional homolog of SEQ ID NO 184 in the 11/435,388 US patent application
  misc_feature: The sequence is a functional homolog of SEQ ID NO 194 in the 10/714,887 US patent application
  misc_feature: The sequence is a functional homolog of SEQ ID NO 194 in the 11/435,388 US patent application
  misc_feature: Ceres ANNOT ID no. 8714460
  misc_feature (343)..(391): Pfam ID: HLH Pfam Description: Helix-loop-helix DNA-binding domain
MYGSPVSKDLNLPVQPPMTSSGLLRYRSAPSTVLGDLCEDLLPPAPGAGPPRDGADNVISRFLADHHHHIRDDKPSPPPPPAAAPAHFPSAADMASQQHQHQQMMFHSQSQQQHMVDANKPGGLYRTVSSGMEDAAGTGAGVGVGAASNLIRQSSSPAGFLDHFSMDNGYGAMLRASMGMGFRDGSGGVGGAGGAATDSLAGGGGGGGSGSGRLKGQLSFSSRQGSLMSQISEMDSEEIGGSSPEAAAGGRGGYIPGYPMSSAGWDDSSSALMSDSLSGMKRPRDSSEPGGQQQQQQQNGGGGLAHQFSLPKTSSEMAAIEKFLQFQDAVPCKIRAKRGCATHPRSIAERVRRTKISERIRKLQELVPNMDKQTNTSDMLDLAVDYIKDLQKQVKALNESRASCTCPASKHQQFSG

SEQ ID NO: 18966 - DNA, 1857 bp, Sorghum bicolor
  misc_feature: Ceres ANNOT ID no. 8714454
  misc_feature: Encodes the peptide sequence at SEQ ID NO 18967
atgacggaccatcttgctattatcgcgtccgagctaggggacgcaacggattttgaggttgatggcattgacaacctcagcgagaatgatgtcagtgatgaggagattgatgctgatgagcttgcccggcgaatgtggaaagacaaggtcaagctcaagaggatcagggagaggcagcagaagctcgctttgcagcggttggagctggagaagtccaagacaaagaagatttcagatcaagctctccggaagaagatgacgagggctcaggatgggatcttgaagtacatgctcaagctgatggaagtgtgcaatgcgcgggggttcgtgtacggcatcattcctgagaaagggaagcctgtcagtggtgcatcggataacatcagggaatggtggaaggagaaggtgaagtttgataagaatgggccagcggcgattgtaaaatatgaggttgagcactcgatgctgagtaatcctaagagcagtggagccatgaaccagcatagcttgatggatctccaagacggcactctgggttcattgctttcagcgttgatgcaacactgcagcccacagcagcgaagctatccattggataagggtgtcccgcccccttggtggccatcagggaatgagccatggtggcctgcgttgggccttccaaagggagaagcgcctccgtacaggaaaccacatgatctgaagaaggtttggaaagttggtgttctgacgggtgtgatcaagcacatggccccaaactttgataagatcagaaatcgtgtaaggaaatcaaagtgtctgcaggacaaaatgactgcaaaagagagcctcatttggcttggtgttttgcaacgcgaggagaagtctattcacagttttggcagtgctttactaccgattacccagcatagtacttcagaggacagaactgagggcatatatagcagcagtgatgagtatgatgtcgaccgcctggagcagcctcctcgttctacatcatccaaagatgatgagggagatgctcagcctgttttgcagattagaggggagcagatctcaactagagtgcctaagagaaagcgtcatgataaaccctccaaccaactagctattagcaaggaagaaacgacaaaacctaaacctcgacagcggaatcgcccctcagctcgttctccagttgctgaggttgaggttgaagtgacacaaagaaatgacaatccgccagatgtatcgtgcaatgcagctgatggtatgaaccttattgatccaattgatgtggtgggcatgactaaccagccaacgagctctagccatgccccccctacaattggagctttgcagcagcacggagattgtcaagggaattttctatctcctggtgctgtgatcaacaactacaacagcaaccaggctgcaagtgctgctcaatcaagcacttatctgggcgaccatcccctggcttgtgaaggcagcgatattgccaattcatggtctggacactcgtttcggcaggatattggtattgggcctattggttttaatccttcacaagctgttcatcaggatttggcaatgcagcagccactaccactgcctatggatcaccaagcgcctatcattggaacaggagctctcgccacgaatgactcttacagtctcccgacggcaggcagtgggaattctgggacaatagttggtgagacccaccagcagttcatggacgaccctttcttcggcgaggctggagacagcacttttggtggccttcctttcagcctcgttcctttcagtagtccgatgctcaactttgatgacttggtggacgacgatgacttgatgccgtacctgggcacatga

SEQ ID NO: 18967 - protein, 618 aa, Sorghum bicolor
  misc_feature: The sequence is a functional homolog of SEQ ID NO 204 in the 10/225,068 US patent application
  misc_feature: The sequence is a functional homolog of SEQ ID NO 2468 in the 10/374,780 US patent application
  misc_feature: The sequence is a functional homolog of SEQ ID NO 1350 in the 11/479,226 US patent application
  misc_feature: The sequence is a functional homolog of SEQ ID NO 2464 in the 10/374,780 US patent application
  misc_feature: The sequence is a functional homolog of SEQ ID NO 632 in the 10/412,699 US patent application
  misc_feature: The sequence is a functional homolog of SEQ ID NO 818 in the 10/225,066 US patent application
  misc_feature: Ceres ANNOT ID no. 8714454
  misc_feature (21)..(426): Pfam ID: EIN3 Pfam Description: Ethylene insensitive 3
MTDHLAIIASELGDATDFEVDGIDNLSENDVSDEEIDADELARRMWKDKVKLKRIRERQQKLALQRLELEKSKTKKISDQALRKKMTRAQDGILKYMLKLMEVCNARGFVYGIIPEKGKPVSGASDNIREWWKEKVKFDKNGPAAIVKYEVEHSMLSNPKSSGAMNQHSLMDLQDGTLGSLLSALMQHCSPQQRSYPLDKGVPPPWWPSGNEPWWPALGLPKGEAPPYRKPHDLKKVWKVGVLTGVIKHMAPNFDKIRNRVRKSKCLQDKMTAKESLIWLGVLQREEKSIHSFGSALLPITQHSTSEDRTEGIYSSSDEYDVDRLEQPPRSTSSKDDEGDAQPVLQIRGEQISTRVPKRKRHDKPSNQLAISKEETTKPKPRQRNRPSARSPVAEVEVEVTQRNDNPPDVSCNAADGMNLIDPIDVVGMTNQPTSSSHAPPTIGALQQHGDCQGNFLSPGAVINNYNSNQAASAAQSSTYLGDHPLACEGSDIANSWSGHSFRQDIGIGPIGFNPSQAVHQDLAMQQPLPLPMDHQAPIIGTGALATNDSYSLPTAGSGNSGTIVGETHQQFMDDPFFGEAGDSTFGGLPFSLVPFSSPMLNFDDLVDDDDLMPYLGT

SEQ ID NO: 18968 - DNA, 1698 bp, Sorghum bicolor
  misc_feature: Ceres ANNOT ID no. 8714510
  misc_feature: Encodes the peptide sequence at SEQ ID NO 18969
atggacagagggatgagagattatatcaaacccaattttccaacaggtacagcaagggcatccaatcctgaagccataaaagatccgaggtgctggatcgtaaaagcgcccctcgtttcgtctatccccatccccacctccacccggaccggaagccgcaagcccagcggcggaaaccacaaaaccaccaagccgagcgtgaaggcgcccggtgccccgccccgccccgcccaccaccccacgaaacccaaacgcgcctccctccccagcgagggatcccgcatccccccctacccgtttcaattttcattcaaaagggcgtggaggcgcaggcgccgcaccgccgccgccgccgccaccgacgagggaggaaacgccagtccttatttccccccgtcccctccccgaaccagcccgatgttgtccgaccaggagctggcccagtacgtggagtccttcgtgcagcacaccgccgcgcagggcggcaccgggatatcggcggatgccgtggtgcgccagctcggggcgcagctcggcgtcgacctctcccccaaggcgcacctcatccgcagcgtcctcgtcgcgctcctaggccccgctgccgcgccggcgccggaccccgccgcctcgcggaaggaccatttcgaccccgcgaccgccgccggcgggggcgcccgcgccgaggctcctgcgcagcagcagctgcccttctccacctccaccgccgccgcgtcgtcggcccccgccccggcgccggccgttccccacttcttcccgcagcagcaccagcaccagaggcagtctttcctctccgccccgcagcagtaccagcaccagcagcagcaacgcgccggcgggcctccctctccgttagacgtccccgcgtcgtaccgctacgggcaccagcccttcgcccaggctgaccaggcccagctgcagaggctcgtccagctacagcagcatcagcagcaacagcagttggctgccgcggcgagagctgcggctgcagcggcacccactccggcggagagcccccgtgcgcgggcgccggcaacggcgccggctggctccaagaaggacagtgctagtgctggagcaaaacgaagaggtggtcctggagggttaaacaaagtctgcggtgtgtctccagagctgcaagctattgttggtgaaccagccatggctagaactgagattgttaagcagctttgggcgtacattcgcaggaacaatttgcaagatcctaacaataagagaaagattatatgcaatgatgagctccgattagtttttgagactgatagcacagacatgttccagatgaataagcttctgtctaagcatatacgtcctctggagagtaaaaatgattcaaaacgagaagcaaaaaaattgaagccagagggtggtgaacaaattcctaaagttgaaactgatgttaaccaacttccccttacggtttctgatgctcttgctaccttttttggtacgggagaaagagaaatggtccattctgaggctgttaagcgtgtctgggagcacattaaaagcaataatttagaggatccagagaatcctacagtgatactgtgtgactccaaacttaaacaactctttggatgtgaaagtcttgctgctcatggtgtctcagagttgctttcagaccacctttacaagcagcaatctaccaagatctga

SEQ ID NO: 18969 - protein, 565 aa, Sorghum bicolor
  misc_feature: Useful for making plants with modulated biomass
  misc_feature: Useful for making plants with modulated drought sensitivity
  misc_feature: Useful for making plants with modulated flowering time
  misc_feature: Functional homolog of the protein sequence given in SEQ ID NO 12918
  misc_feature: Ceres ANNOT ID no. 8714510
  misc_feature (375)..(450): Pfam ID: SWIB Pfam Description: SWIB/MDM2 domain
  misc_feature (481)..(558): Pfam ID: SWIB Pfam Description: SWIB/MDM2 domain
MDRGMRDYIKPNFPTGTARASNPEAIKDPRCWIVKAPLVSSIPIPTSTRTGSRKPSGGNHKTTKPSVKAPGAPPRPAHHPTKPKRASLPSEGSRIPPYPFQFSFKRAWRRRRRTAAAAATDEGGNASPYFPPSPPRTSPMLSDQELAQYVESFVQHTAAQGGTGISADAVVRQLGAQLGVDLSPKAHLIRSVLVALLGPAAAPAPDPAASRKDHFDPATAAGGGARAEAPAQQQLPFSTSTAAASSAPAPAPAVPHFFPQQHQHQRQSFLSAPQQYQHQQQQRAGGPPSPLDVPASYRYGHQPFAQADQAQLQRLVQLQQHQQQQQLAAAARAAAAAAPTPAESPRARAPATAPAGSKKDSASAGAKRRGGPGGLNKVCGVSPELQAIVGEPAMARTEIVKQLWAYIRRNNLQDPNNKRKIICNDELRLVFETDSTDMFQMNKLLSKHIRPLESKNDSKREAKKLKPEGGEQIPKVETDVNQLPLTVSDALATFFGTGEREMVHSEAVKRVWEHIKSNNLEDPENPTVILCDSKLKQLFGCESLAAHGVSELLSDHLYKQQSTKI

SEQ ID NO: 18970 - DNA, 1287 bp, Sorghum bicolor
  misc_feature: Ceres ANNOT ID no. 8714496
  misc_feature: Encodes the peptide sequence at SEQ ID NO 18971
atggaagacccctacaggagcttcttcaagaacagctactactactacgcctcctcctacccggctgccccagccccccaccatctccctccttcccttccaccgtacaccagcctctaccccgccgccgcggcgccgcagtaccaccctgcttgcttcttccagccgccgccgccgtcgtcgctgccgcctctccatgacagcccgccgtcaccgccgctacgagaggcgctgcccctcctgtcgcagtcgcctacgcgcgccgcctcccgggcccagccgcgcccgcacgtggcggtggactccgactccgaagatgacgctgatgacttcgtcctacgggaggccgtcggcagctccgtgactccctctacgcgtgcgccgctcttcgccgacctcaactgcatgccctcctgctgcgacgccgaaggcgacccgatggacctggaggccgcggcgcccacggacgacgacgccgcagtcgctctgcgcatcggcctgcctccggctcccgtcaacggcggctgcggtggcgccgaggctgacctcctgtccgggctctccggcagggccggctgcggtggcatggagcacgaggaggatgaggacgagtgcaaggtggacaccggcgacggcgacgaggtggtgccgttagggttcgcgtcgacgcccatcgggaagctcaacaaggggcagtactggatcccgacgccggcgcagatcctcatcgggcctacgcaattctcctgccccgtctgctacaagactttcaaccgatacaacaacatgcagatgcacatgtgggggcacgggtctcagtaccgcaagggcccggagtcgctccgcggcgtgcagccgacggcgatgctccggctgccgtgctactgctgcgcgccgggttgccgcaacaacatcgaccacccgcgggcgcggccgctcaaggacttccggacgctgcagacgcactacaagcgcaagcacgggctgaagcccttcctgtgccgcaagtgcggcaaggcgttcgccgtcaagggcgactggcgcacgcacgagaagaactgcggcaagctctggtactgcctctgcggctccgagttcaagcacaagcgctcgctcaaggaccacgcgcgcgccttcgggcacggccacggcgccttcggctgcaacctcgacggcggcagcggcgccgacggcctcgacgacgacgacgacggcgccgtctccgagatcgagcacgacttgtgcgccgccgcatgcagcagcaggtccgccgccgccgcgcggtga

SEQ ID NO: 18971 - protein, 428 aa, Sorghum bicolor
  misc_feature: The sequence is a functional homolog of SEQ ID NO 1075 in the 10/666,642 US patent application
  misc_feature: The sequence is a functional homolog of SEQ ID NO 1077 in the 10/666,642 US patent application
  misc_feature: The sequence is a functional homolog of SEQ ID NO 1078 in the 10/666,642 US patent application
  misc_feature: The sequence is a functional homolog of SEQ ID NO 1076 in the 10/666,642 US patent application
  misc_feature: The sequence is a functional homolog of SEQ ID NO 306 in the 10/666,642 US patent application
  misc_feature: The sequence is a functional homolog of SEQ ID NO 1079 in the 10/666,642 US patent application
  misc_feature: The sequence is a functional homolog of SEQ ID NO 630 in the 10/666,642 US patent application
  misc_feature: The sequence is a functional homolog of SEQ ID NO 1074 in the 10/666,642 US patent application
  misc_feature: Ceres ANNOT ID no. 8714496
MEDPYRSFFKNSYYYYASSYPAAPAPHHLPPSLPPYTSLYPAAAAPQYHPACFFQPPPPSSLPPLHDSPPSPPLREALPLLSQSPTRAASRAQPRPHVAVDSDSEDDADDFVLREAVGSSVTPSTRAPLFADLNCMPSCCDAEGDPMDLEAAAPTDDDAAVALRIGLPPAPVNGGCGGAEADLLSGLSGRAGCGGMEHEEDEDECKVDTGDGDEVVPLGFASTPIGKLNKGQYWIPTPAQILIGPTQFSCPVCYKTFNRYNNMQMHMWGHGSQYRKGPESLRGVQPTAMLRLPCYCCAPGCRNNIDHPRARPLKDFRTLQTHYKRKHGLKPFLCRKCGKAFAVKGDWRTHEKNCGKLWYCLCGSEFKHKRSLKDHARAFGHGHGAFGCNLDGGSGADGLDDDDDGAVSEIEHDLCAAACSSRSAAAAR

SEQ ID NO: 18972 - DNA, 1611 bp, Sorghum bicolor
  misc_feature: Ceres ANNOT ID no. 8714522
  misc_feature: Encodes the peptide sequence at SEQ ID NO 18973
atggacgacggtgacgtcggcgaggaggacgccaacaagcagcgcctcgagcgggccaccatgaacctggagcgcggcgtcgtcgccggcgagaagggcgacggcagtggcgggaatgcgagccggaagccgccgataggcatcgtccggctcttcttggcctgcatggtctccggcggcatccaatacggctgggcgctgcagctctccctcctctcgccctactctcagactcttgggatctcacacagctacgtgtctctgacatggatctgcgggcctatcgccggatttgtggtgcaacccatcgtgggctactacagcgaccggtgcacctcgaagataggccggagaaggcccttcatcctcgctggatgcatcgtcatctgcctctctgtgctgatgatcgggttctcggcggacatcgggcggcgcctcggcgacaccaaggagcagtgcagcacgttcaccggctcccgctggtacgccgccgccgtctacattgttggcttctggttcctcgactttgccaacaacaccgtccagggtccggctcgcgccatgatggccgacctagctgctggacagcacggccccaacgttggccaggccattttctccctgtggttggctctcggcggcgtgctcggatacttggccggcgccaacgcgagatggcacgagtggctcccttggctcaaaaccgcggcgtgctgcgatgcctgcgcgaacctcaagggcgccttcttgactgcgttgatcctcattataatcaccatgtcggtcaccttgtggctcgccggcgagcagcaactcgacaaggacaacgtcgtcgacgcctccggcggcgcgtgctccttgttcgtccatctcttcaagagcctcaagaaccttccccctgccatgctcggcgtgctcgccgtcacggccgtcacctggctgtcgtggttcccgttcatccagtacaacaccgactggatggggcgggagatcttccacggcgagccgcagggcgcgggcggcaaggcggacctgtacaacgccggcgtccgcgagggcgccgtgggcctcctcttctgctccgtcgcgctgggcgtcacctccttcctcctccccaagctgtgccggaagctcacgtcccgggtcgtctggtccatcagcaacctcatggtgttcgccctcttgacggccatggtcgtcctcggcatggtctccatgaagggctacaagccctcgctcgccgcctccctctccgccggccccgaccacacgttcaagagcgccgcactcgctatcttcgccctcatcggcatacctcaagctgtgctgttcactgtaccttgcgccgtggcgtgtgagattgccactgaggagggcggtggccaaggtctcacccttggcgtcctcaacattgccgtcgtccttccacagctgttgatcgcgctcagcgcaggccccatcgacggcgccttcggcaaaggaaacgccccggccttgggcatcggcgccgtcttcgccctcatcagcgcggtcctggcgctcgtccttctcccaaagacgagaggcgtgtccaacgccagcgccaccgtcatggcgagcggccactgttga

SEQ ID NO: 18973 - protein, 536 aa, Sorghum bicolor
  misc_feature: Useful for making plants with modulated heat sensitivity
  misc_feature: Functional homolog of the protein sequence given in SEQ ID NO 13009
  misc_feature: Ceres ANNOT ID no. 8714522
  misc_feature (54)..(481): Pfam ID: MFS_1 Pfam Description: Major Facilitator Superfamily
MDDGDVGEEDANKQRLERATMNLERGVVAGEKGDGSGGNASRKPPIGIVRLFLACMVSGGIQYGWALQLSLLSPYSQTLGISHSYVSLTWICGPIAGFVVQPIVGYYSDRCTSKIGRRRPFILAGCIVICLSVLMIGFSADIGRRLGDTKEQCSTFTGSRWYAAAVYIVGFWFLDFANNTVQGPARAMMADLAAGQHGPNVGQAIFSLWLALGGVLGYLAGANARWHEWLPWLKTAACCDACANLKGAFLTALILIIITMSVTLWLAGEQQLDKDNVVDASGGACSLFVHLFKSLKNLPPAMLGVLAVTAVTWLSWFPFIQYNTDWMGREIFHGEPQGAGGKADLYNAGVREGAVGLLFCSVALGVTSFLLPKLCRKLTSRVVWSISNLMVFALLTAMVVLGMVSMKGYKPSLAASLSAGPDHTFKSAALAIFALIGIPQAVLFTVPCAVACEIATEEGGGQGLTLGVLNIAVVLPQLLIALSAGPIDGAFGKGNAPALGIGAVFALISAVLALVLLPKTRGVSNASATVMASGHC

SEQ ID NO: 18974 - DNA, 1209 bp, Sorghum bicolor
  misc_feature: Ceres ANNOT ID no. 8714513
  misc_feature: Encodes the peptide sequence at SEQ ID NO 18975
atggcagactacgtgtatggccccgggcggaaccacctgttcgttccgggcccggtgaacatcccggaccccgtgatccgcgccatgaaccggcagaacgaggactaccgctcgccggcgatcccggcgctcaccaaggtcctcctcgaggacgtgaagaggatcttcaaaaccaccaccggcacgccgttcctgatcccgaccaccggcaccggcgcgtgggagagcgcgctgaccaacacgctgtccccgggcgaccgcatcgtctcgttcctcatcgggcagttcagcctgctgtggatcgaccagcagcagcgcctgggcttcgacgtggacgtggtggagagcgactggggccacggcgccgacctcgacgcgctggagcggaagctccgcgacgacaccctccacaccatcaaggccgtcgccatcgtgcacaacgagacggccacgggcgtcaccaacgacctcgccgccgtgcgcacgctgctggacgcgtacgcccacccggcgctgctgctggtggacggcgtgtcgtccatctgcgcgctggacttccgcatggacgagtggggcgtcgacgtcgcgctcacggggtcgcagaaggcgctgtcgatgccgacagggatgggcatcgtgtgcgctagctccaaggcgctggaggccagcaaggcggcgaggtccgtgcgcgtcttcttcgactggaaggactacctcaggttctacgagatgggcacgtactggccatacacgccatccatccagctcctctacggactccgcaccgcgctcgacctcatcttcgaggaagggctcgacaatgtcgtcaagaggcacaatcgtcttggaacagccaccaggttcgccgtggaggcgtgggggctcaagaactgctgccagaaggaggagtgtttcagtgacacggtcaccgccgtcgtcgtgccgccatacatcgacagcgccgagatcgtcaagcacgcgtggaagcggtacaacctcagccttggcctcggccttaacaaggtcgccgggaaggtcttcaggatcggccatctcggcaacctcaacgagctgcaactcctgggatgcctgagcggtgtggagatggtgctcaaggacgtggggtacccggtgaagctcggcagtggagtggcggccgcggcggcgtacctgtcgaattccacgcctctgatcccgtccaggatctga

SEQ ID NO: 18975 - protein, 402 aa, Sorghum bicolor
  misc_feature: Useful for making plants with modulated nitrogen use efficiency
  misc_feature: Functional homolog of the protein sequence given in SEQ ID NO 14680
  misc_feature: Ceres ANNOT ID no. 8714513
  misc_feature (12)..(395): SWISSPROT Homolog: EC 2.6.1.45 Serine--glyoxylate transaminase
  misc_feature (13)..(361): Pfam ID: Aminotran_5 Pfam Description: Aminotransferase class-V
MADYVYGPGRNHLFVPGPVNIPDPVIRAMNRQNEDYRSPAIPALTKVLLEDVKRIFKTTTGTPFLIPTTGTGAWESALTNTLSPGDRIVSFLIGQFSLLWIDQQQRLGFDVDVVESDWGHGADLDALERKLRDDTLHTIKAVAIVHNETATGVTNDLAAVRTLLDAYAHPALLLVDGVSSICALDFRMDEWGVDVALTGSQKALSMPTGMGIVCASSKALEASKAARSVRVFFDWKDYLRFYEMGTYWPYTPSIQLLYGLRTALDLIFEEGLDNVVKRHNRLGTATRFAVEAWGLKNCCQKEECFSDTVTAVVVPPYIDSAEIVKHAWKRYNLSLGLGLNKVAGKVFRIGHLGNLNELQLLGCLSGVEMVLKDVGYPVKLGSGVAAAAAYLSNSTPLIPSRI

SEQ ID NO: 18976 - DNA, 789 bp, Sorghum bicolor
  misc_feature: Ceres ANNOT ID no. 8714527
  misc_feature: Encodes the peptide sequence at SEQ ID NO 18977
atgatggagttcaaaactggcatttttactgtggccatactagccattgtgctgtcctcaccagcagttgctcagaagagcccacctgctccatcagctacaatccttccaccagcgccagcacccgcacctgcgccgcgccatgttgacctcgctgatctcctcagtgtggccggaccgttccacaccttcctggactacctgcagaagaccaatgtcatcgagaccttccagaaccaggcgaacgacacaaagaacggcatcaccatctttgtgcccaaggactctgcgttcgccgcgctcaagaagacaacatttgccaacctcacccaggaccagctcaagtccctgctcctgtaccacgcgttccccaaatactactccctggctgagttcgacaaactgagcactctcaacccagtgaccacctttgccggctcgcagtacacgctgaacctcacctacaacatgggcaccatccaagtgaaatcgatgtggtccaaccccaagatcagcagcagcgtgtactcaacccgcccggtcgctgtgtacgaggtcaacaaggtcctcttgccaatgcaaatcttcaagagcgacccaccgctggcgcctgcccctgctcccgcccctgactccaaggcctctgatgttgctcccagcccaaggtcagggaaatcagcaagcgcaaaggcgaaggcggatgagaagagttcgtcgcaccaagttggtgccgacgttgcccattacctggcgcttgctgtctcaggtgtcctgatgctgttgtggtga

SEQ ID NO: 18977 - protein, 262 aa, Sorghum bicolor
  misc_feature: Useful for making plants with altered carbohydrate content
  misc_feature: Functional homolog of the protein sequence given in SEQ ID NO 14320
  misc_feature: Useful for making plants with altered cell wall content and/or composition
  misc_feature: Useful for making plants with altered lignin content
  misc_feature: Functional homolog of the protein sequence given in SEQ ID NO 14321
  misc_feature: Ceres ANNOT ID no. 8714527
  misc_feature (60)..(192): Pfam ID: Fasciclin Pfam Description: Fasciclin domain
MMEFKTGIFTVAILAIVLSSPAVAQKSPPAPSATILPPAPAPAPAPRHVDLADLLSVAGPFHTFLDYLQKTNVIETFQNQANDTKNGITIFVPKDSAFAALKKTTFANLTQDQLKSLLLYHAFPKYYSLAEFDKLSTLNPVTTFAGSQYTLNLTYNMGTIQVKSMWSNPKISSSVYSTRPVAVYEVNKVLLPMQIFKSDPPLAPAPAPAPDSKASDVAPSPRSGKSASAKAKADEKSSSHQVGADVAHYLALAVSGVLMLLW

SEQ ID NO: 18978 - DNA, 1491 bp, Sorghum bicolor
  misc_feature: Ceres ANNOT ID no. 8714592
  misc_feature: Encodes the peptide sequence at SEQ ID NO 18979
atgaatttgcactgtcagggatcaagtgttgttcaccaaacccagtccttaacgaaggatagtcaggggttaaatgttcatgctaacccaactgcgaccaagcatgaaactgaggaaaatctagttaaacctaagacatgtgattccatgtttgatgaacagagcgaggaaatccaaaatggggaagattcttcagctccagacactggcaccgccgatgatggatattttttgagggtaaacaggaggggcatgcccctactggatgatggatataactggagaaaatatggagaaaagcaagtgaaaaaaagtgaacacccaaggagctactacaaatgcactcacccaaaatgtcctgtcaagaaaatggtggagcgttctctagaaggtcatataacggagatagtctacagaggttctcatagtcacccactgcctcttcccaacagccggccaagtgtccctttgtcgcatttcaatgattcagaagctgatggtaacttcagttccaagcctgggcctggctatgactcgtcaacttcacagggaattgctccaaaaggtcagttccaagatgtgcacagcggagctcttgaaacaaaactgtctggctctcttactacaactgagattgctgacacgtctgttatggagtctatggatgtctcatcaacactctcctccaatgagaagggtgatagggccatgaatggtgccgttccttcaaccaatgacatgaacgaagacgagactgaatctaaaagaaggaaaatggaggtttctgtcgctagtaacactgccaacattgtcactgatatggcagctatggcatcaaggactgcccgggagcctcggattgttgtgcaaacaacaagtgaggtcgacatccttgacgatggctaccgctggcgcaagtatggacagaaagttgtgaaaggcaacccaaacccaaggagctactacaaatgcacttatgctggctgctcagtgcgcaaacatgtggagagggcctcaaatgatctcaagtccgtgatcacaacatatgaggggagacacaaccatgaagttccagctgccaggaacagcaatgggcatccgagctatggctccagtgctgcaccacagggtagcagtcttcaccggaggccagagcctccacaattcagcatgcctcacgctgctgccgccgctgcctacggttcactttgtctcccaccacaactcaatgcagcttcagggggtttctccttcggaatgctcccccctgcaatggcaatggcaattccagtaccatctctgggtaacttcatgccagcgcagatgcctggccatggatcaccaatgcagggttgttcaggccttatgctgccgagaggtgaggagaaggtgaacccagagcagcagtccagattgccggtagcgaatgggaatgcggcagcaacttaccagcagctcatgggaaggtggcctcagggtcatcagatgtaa

SEQ ID NO: 18979 - protein, 496 aa, Sorghum bicolor
  misc_feature: The sequence is a functional homolog of SEQ ID NO 1390 in the 10/412,699 US patent application
  misc_feature: The sequence is a functional homolog of SEQ ID NO 514 in the 10/374,780 US patent application
  misc_feature: The sequence is a functional homolog of SEQ ID NO 1389 in the 10/412,699 US patent application
  misc_feature: The sequence is a functional homolog of SEQ ID NO 513 in the 10/374,780 US patent application
  misc_feature: The sequence is a functional homolog of SEQ ID NO 86 in the 10/412,699 US patent application
  misc_feature: The sequence is a functional homolog of SEQ ID NO 202 in the 10/714,887 US patent application
  misc_feature: The sequence is a functional homolog of SEQ ID NO 202 in the 11/435,388 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8714592
  misc_feature (298)..(357): Pfam ID: WRKY Pfam Description: WRKY DNA -binding domain
  misc_feature (88)..(146): Pfam ID: WRKY Pfam Description: WRKY DNA -binding domain
MNLHCQGSSVVHQTQSLTKDSQGLNVHANPTATKHETEENLVKPKTCDSMFDEQSEEIQNGEDSSAPDTGTADDGYFLRVNRRGMPLLDDGYNWRKYGEKQVKKSEHPRSYYKCTHPKCPVKKMVERSLEGHITEIVYRGSHSHPLPLPNSRPSVPLSHFNDSEADGNFSSKPGPGYDSSTSQGIAPKGQFQDVHSGALETKLSGSLTTTEIADTSVMESMDVSSTLSSNEKGDRAMNGAVPSTNDMNEDETESKRRKMEVSVASNTANIVTDMAAMASRTAREPRIVVQTTSEVDILDDGYRWRKYGQKVVKGNPNPRSYYKCTYAGCSVRKHVERASNDLKSVITTYEGRHNHEVPAARNSNGHPSYGSSAAPQGSSLHRRPEPPQFSMPHAAAAAAYGSLCLPPQLNAASGGFSFGMLPPAMAMAIPVPSLGNFMPAQMPGHGSPMQGCSGLMLPRGEEKVNPEQQSRLPVANGNAAATYQQLMGRWPQGHQM

SEQ ID NO: 18980 - DNA, 687 bp, Sorghum bicolor
  misc_feature: Ceres ANNOT ID no. 8714590
  misc_feature: Encodes the peptide sequence at SEQ ID NO 18981
atggaggattggatgcttccctcacccagcccaagaacactgatgccaagcttcttcaacgaagaattcagctctgctcccttctccaacatcttcagtgatgatagaagcaacaaacccctggatgaaatcgagaagagtaaaactttcattggctcgagtgctcaagaaacctctcaagatacgaaagaccatccacagactgaatcaaaccttttcagcgcaaatcagaaatcaacctctccaggaggtcttgcagagaggatggccgcaagagcgggttttggtgtcctgaaaattgacacgtcccgtgtcagttcatctggtgcaccaatccggtctccggtgacaattccacctggtgtgagcccaagggaacttcttgagtcaccggttttccttccaaatgccacttcgcaaccttctcctaccactggtaaattgccattcctgatgcctaataattttaaatcaacaatgccgtccgtccccgagaagtctgaagatcactcacatgaagattctgcgttttccttccagcccattttgaggtctaaaccatcaaccttatggactgcagagaaggtaatttgcctgatcacatatttattgccattgctatttcttataattgcatttcctttttttttgactaattcaatctgcaaaagcatatctagcagttaa

SEQ ID NO: 18981 - protein, 228 aa, Sorghum bicolor
  misc_feature: The sequence is a functional homolog of SEQ ID NO 1389 in the 10/412,699 US patent application
  misc_feature: The sequence is a functional homolog of SEQ ID NO 513 in the 10/374,780 US patent application
  misc_feature: The sequence is a functional homolog of SEQ ID NO 1390 in the 10/412,699 US patent application
  misc_feature: The sequence is a functional homolog of SEQ ID NO 514 in the 10/374,780 US patent application
  misc_feature: Ceres ANNOT ID no. 8714590
MEDWMLPSPSPRTLMPSFFNEEFSSAPFSNIFSDDRSNKPLDEIEKSKTFIGSSAQETSQDTKDHPQTESNLFSANQKSTSPGGLAERMAARAGFGVLKIDTSRVSSSGAPIRSPVTIPPGVSPRELLESPVFLPNATSQPSPTTGKLPFLMPNNFKSTMPSVPEKSEDHSHEDSAFSFQPILRSKPSTLWTAEKVICLITYLLPLLFLIIAFPFFLTNSICKSISSS

SEQ ID NO: 18982 - DNA, 1122 bp, Sorghum bicolor
  misc_feature: Ceres ANNOT ID no. 8714611
  misc_feature: Encodes the peptide sequence at SEQ ID NO 18983
atgccgccaatagaaatccatgctgtagtagtgtacgacactcccccaaaaaagaacaaatgttttgttactccaatgcgaatgcgacacggacgtagccccgtgacaaggccggcaaggcggcgtcctcgcaacattgcgtcgtcaggcggtggccgccgaagcccccaatccctatcggacgggagcggtgagcacaggcacagcgacagctctcaagcggatcggatcagccaccacttggccagcgcctgtgctccatcctccatggcccatatgtccatgtgggaggccatgccattcagagtgagagtactagtagttggctcgtcgtcggcggcggcggcgaagacgaggaaggacacggcggccatggctgctgccagcagcgaccgcggcggcaccgaggtcaagaatatccacggcaaagacagcaccaagacgctcctcaagagcgaagcactctacgagtacatgctcaacacgatggtgcacccgcgggagcacgagtgcctgcgcgagctccgcctcatcacccagcaccacacctacgggttcatctcgtcgccgccggactcggcggcgctgctggcgatgctgctgaagctgacgggcgcccggaacacgatcgaggtgggcgtcttcacgggctactccgtgctggcgaccgcgctcgccatcccgcccgacggccgcgtcgtggccatcgacgtcagccgggaggacttcgacctgggcctgccggtgctcacccgcgccggcgtcgcgcacaaggtcgacttccgggagggcctcgcgtcggagcacctggacgcgctgctcgccgccgagagcaacctcggcgccttcgacttcgcgttcgtcgacgccgacaaggagagctacggcggctaccacgagcggctcctgcggctggtcctcgtcggcggcgtgctcgcctacgacaacacgctctggggcggctccgtcgccttccccgacgacgcgccgctcacggacgacgaccgggaggtccgggaccacatcagggcgttcaacgccgtgattgccgccgacgcgcgcgttgaggtcgtgcagctccccgtcgccgacggcatcacgctctgccgccgcgtcgtctga

SEQ ID NO: 18983 - protein, 373 aa, Sorghum bicolor
  misc_feature: Useful for making plants with altered carbohydrate content
  misc_feature: Functional homolog of the protein sequence given in SEQ ID NO 14031
  misc_feature: Useful for making plants with altered cell wall content and/or composition
  misc_feature: Functional homolog of the protein sequence given in SEQ ID NO 14681
  misc_feature: Ceres ANNOT ID no. 8714611
  misc_feature (133)..(372): SWISSPROT Homolog: EC 2.1.1.104 Caffeoyl-CoA O-methyltransferase
  misc_feature (160)..(372): Pfam ID: Methyltransf_3 Pfam Description: O-methyltransferase
MPPIEIHAVVVYDTPPKKNKCFVTPMRMRHGRSPVTRPARRRPRNIASSGGGRRSPQSLSDGSGEHRHSDSSQADRISHHLASACAPSSMAHMSMWEAMPFRVRVLVVGSSSAAAAKTRKDTAAMAAASSDRGGTEVKNIHGKDSTKTLLKSEALYEYMLNTMVHPREHECLRELRLITQHHTYGFISSPPDSAALLAMLLKLTGARNTIEVGVFTGYSVLATALAIPPDGRVVAIDVSREDFDLGLPVLTRAGVAHKVDFREGLASEHLDALLAAESNLGAFDFAFVDADKESYGGYHERLLRLVLVGGVLAYDNTLWGGSVAFPDDAPLTDDDREVRDHIRAFNAVIAADARVEVVQLPVADGITLCRRVV

SEQ ID NO: 18984 - DNA, 2160 bp, Sorghum bicolor
  misc_feature: Ceres ANNOT ID no. 8714627
  misc_feature: Encodes the peptide sequence at SEQ ID NO 18985
atgcgccaccggtcccaccccaacgcatccatcccctgccgcggctgctctcctctttcgtcttccccaccggcgcccgccgcgcccttctccccctcgcttcgccggtcgccaccacctccaggtttcctcacccatgttctaggtgctgggcactttttgcttcagaagatgtctcgggcgctgcacagtccctgctttatggctccgctgttgtgggtcgcgtcgctactggttgtcgtctcaccgggcgatgcgttctacttgcctggcagctacatgcacacatactcccaaggcgagttgatattcgccaaggtcaactctctcacgtccatcgagacggagatgcctttcaactactacagcctgccctactgccgtccccaggggggcatcaagaagagtgctgagaatctgggtgagcttctgatgggtgaccagattgacaactcgccctaccggttccgtgtgaatgttaatgagtctgtcttcctctgcaccacaaaagggcttaatgagaatgatgcgaagctccttaagcagcggacccgcgatctttaccaggttaacatgatgctggacaatctgcccgtcatgcgtttcactgagcagaatggtgtcatggtacagtggactggctttcctgttggttactctcctgccggtatctcggatgattatatcatcaaccatttgaagtttaaggtcttggtccatgagtacaagggcggaaaagtggaaatcattggcactggagaagaaggatctgctgtcatctcagagacagacaagaatgggatgtctgggtatcagattgttggatttcaggttgtgccttgcagtgtgaagcgtaatgctgaggatttcaataagcttaatatgtacgacaacattgacccggtggactgccctgtggagcttaagaagtctcaagtgatcaggcaacaggagagaattacattcacttatgatgttgagtttgtcaagagcgacatcaggtggccatctaggtgggatgcctatctgaagatggaggctggcgccaaggtccactggttctctataatgaactccctcatggtgatcttgttcttggctggaattgtctttgttatattcctcagaactgtcaggagggacctgactaggtatgaagagctcgacaaggaagcgcaagctcagatgaatgaggaactatctggttggaagcttgttgttggagatgtattcagagagccaacttgtgccaagctgttatgcataatgattggtgatggggttcagattttgggcatggcagtcgtaactatcgtttttgccacacttgggttcatgtctccagcctcaagaggaatgcttcttactgggatgattgttctatatcttttccttggcatcgcaagtgggtatgtcagtgttcggttttggcggactattaagggcacatctgaaggttggagatcagtgtcttggttgactgcctgctttttccctggtgtcatgtttacggtccttactgtcctaaactttgtgttgtggaaaagcgagagcacgggggctttacctatctcactatttttcaccctcctggctctatggttctgcgtttctgtgccattaacccttcttggtgggtttcttggtacaagagcggagaaaattgaattccctgttcggaccaatcagatccccagggagatccctgcacggaagtatccatcgtggcttcttgtccttggtgcaggaacgctgccatttgggaccctgtttattgagctcttcttcattctatcgagcatctggcttggacggttctactatgtctttggtttcctgctgattgtcctgctgctgcttgttgctgtctgtgctgaggtgtctgttgtactaacgtacatgaatctctgcgtggaggactggaggtggtggtggaaggctttcttcgcatctggttctgttgctctctacgtgttcctctactccatcaactacttggtctttgacctcagaagcctgagcggacctgtctctgcaatgctttatgttggctactcattcctcatggcatttgcaatcatgctggcaaccggaaccattggcttcttgacgtcattcgccttcgtgcactacctcttctcatccgtaaagattgattga

SEQ ID NO: 18985 - protein, 719 aa, Sorghum bicolor
  misc_feature: Useful for making plants with altered cell wall content and/or composition
  misc_feature: Functional homolog of the protein sequence given in SEQ ID NO 13969
  misc_feature: Ceres ANNOT ID no. 8714627
  misc_feature (117)..(677): Pfam ID: EMP70 Pfam Description: Endomembrane protein 70
MRHRSHPNASIPCRGCSPLSSSPPAPAAPFSPSLRRSPPPPGFLTHVLGAGHFLLQKMSRALHSPCFMAPLLWVASLLVVVSPGDAFYLPGSYMHTYSQGELIFAKVNSLTSIETEMPFNYYSLPYCRPQGGIKKSAENLGELLMGDQIDNSPYRFRVNVNESVFLCTTKGLNENDAKLLKQRTRDLYQVNMMLDNLPVMRFTEQNGVMVQWTGFPVGYSPAGISDDYIINHLKFKVLVHEYKGGKVEIIGTGEEGSAVISETDKNGMSGYQIVGFQVVPCSVKRNAEDFNKLNMYDNIDPVDCPVELKKSQVIRQQERITFTYDVEFVKSDIRWPSRWDAYLKMEAGAKVHWFSIMNSLMVILFLAGIVFVIFLRTVRRDLTRYEELDKEAQAQMNEELSGWKLVVGDVFREPTCAKLLCIMIGDGVQILGMAVVTIVFATLGFMSPASRGMLLTGMIVLYLFLGIASGYVSVRFWRTIKGTSEGWRSVSWLTACFFPGVMFTVLTVLNFVLWKSESTGALPISLFFTLLALWFCVSVPLTLLGGFLGTRAEKIEFPVRTNQIPREIPARKYPSWLLVLGAGTLPFGTLFIELFFILSSIWLGRFYYVFGFLLIVLLLLVAVCAEVSVVLTYMNLCVEDWRWWWKAFFASGSVALYVFLYSINYLVFDLRSLSGPVSAMLYVGYSFLMAFAIMLATGTIGFLTSFAFVHYLFSSVKID

SEQ ID NO: 18986 - DNA, 2160 bp, Sorghum bicolor; identical to SEQ ID NO: 18984
  misc_feature: Ceres ANNOT ID no. 8714632
  misc_feature: Encodes the peptide sequence at SEQ ID NO 18987

SEQ ID NO: 18987 - protein, 719 aa, Sorghum bicolor; identical to SEQ ID NO: 18985
  misc_feature: Useful for making plants with altered cell wall content and/or composition
  misc_feature: Functional homolog of the protein sequence given in SEQ ID NO 13969
  misc_feature: Ceres ANNOT ID no. 8714632
  misc_feature (117)..(677): Pfam ID: EMP70 Pfam Description: Endomembrane protein 70

SEQ ID NO: 18988 - DNA, 606 bp, Sorghum bicolor
  misc_feature: Ceres ANNOT ID no. 8714635
  misc_feature: Encodes the peptide sequence at SEQ ID NO 18989
atggagcccaaatccaccacccctcccccgcctccggtcatgggcgcgcccgtcgcgtaccctccgccccccggcgccgcgtaccccgccgggccgtacgcgcacgcgccggcagccgcgctgtaccctcctcccccgccgccgccggctcccccaacctcgcagcagggcgccgcggcggcgcagcagctgcagctcttctgggcggagcagtaccgcgagatcgaggccaccaccgacttcaagaaccacaacctgccgctggcccgcatcaagaagatcatgaaggccgacgaggacgtgcgcatgatcgccgccgaggcgcccgtcgtcttcgcccgcgcctgcgagatgttcatcctcgagctcacccaccgcggctgggcgcacgccgaggagaacaagcgccgcaccctgcagaagtccgacatcgccgccgccgtcgcgcgcaccgaggtcttcgacttcctcgtcgacatcgtgccgcgggacgaggccaaggaagccgactccgccgccgccatgggaccagccgggatcccgcaccccgccgccggcctgcccgccaccgaccccatgggctactactacgtccagccgcagtaa

SEQ ID NO: 18989 - protein, 201 aa, Sorghum bicolor
  misc_feature: The sequence is a functional homolog of SEQ ID NO 1108 in the 10/374,780 US patent application
  misc_feature: The sequence is a functional homolog of SEQ ID NO 1109 in the 10/374,780 US patent application
  misc_feature: The sequence is a functional homolog of SEQ ID NO 1908 in the 11/479,226 US patent application
  misc_feature: The sequence is a functional homolog of SEQ ID NO 2126 in the 10/374,780 US patent application
  misc_feature: The sequence is a functional homolog of SEQ ID NO 314 in the 10/374,780 US patent application
  misc_feature: The sequence is a functional homolog of SEQ ID NO 846 in the 10/225,066 US patent application
  misc_feature: The sequence is a functional homolog of SEQ ID NO 1190 in the 10/412,699 US patent application
  misc_feature: The sequence is a functional homolog of SEQ ID NO 837 in the 10/374,780 US patent application
  misc_feature: The sequence is a functional homolog of SEQ ID NO 1188 in the 10/412,699 US patent application
  misc_feature: The sequence is a functional homolog of SEQ ID NO 835 in the 10/374,780 US patent application
  misc_feature: Useful for making plants with altered alkaloid content
  misc_feature: Useful for making plants with altered lignin content
  misc_feature: Functional homolog of the protein sequence given in SEQ ID NO 13648
  misc_feature: The sequence is a functional homolog of SEQ ID NO 1107 in the 10/374,780 US patent application
  misc_feature: The sequence is a functional homolog of SEQ ID NO 102 in the 10/225,068 US patent application
  misc_feature: The sequence is a functional homolog of SEQ ID NO 230 in the 10/714,887 US patent application
  misc_feature: The sequence is a functional homolog of SEQ ID NO 230 in the 11/435,388 US patent application
  misc_feature: The sequence is a functional homolog of SEQ ID NO 310 in the 10/412,699 US patent application
  misc_feature: The sequence is a functional homolog of SEQ ID NO 727 in the 11/479,226 US patent application
  misc_feature: The sequence is a functional homolog of SEQ ID NO 94 in the 10/374,780 US patent application
  misc_feature: Useful for making plants with altered terpenoid content
  misc_feature: Functional homolog of the protein sequence given in SEQ ID NO 13125
  misc_feature: The sequence is a functional homolog of SEQ ID NO 712 in the 11/479,226 US patent application
  misc_feature: The sequence is a functional homolog of SEQ ID NO 1189 in the 10/412,699 US patent application
  misc_feature: The sequence is a functional homolog of SEQ ID NO 836 in the 10/374,780 US patent application
  misc_feature: Useful for making plants with modulated cold sensitivity
  misc_feature: Functional homolog of the protein sequence given in SEQ ID NO 13649
  misc_feature: The sequence is a functional homolog of SEQ ID NO 1004 in the 10/225,066 US patent application
  misc_feature: The sequence is a functional homolog of SEQ ID NO 340 in the 10/374,780 US patent application
  misc_feature: The sequence is a functional homolog of SEQ ID NO 450 in the 11/435,388 US patent application
  misc_feature: Ceres ANNOT ID no. 8714635
  misc_feature (87)..(191): SWISSPROT Homolog: EC 2.7.7.7 DNA-directed DNA polymerase
  misc_feature (84)..(148): Pfam ID: CBFD_NFYB_HMF Pfam Description: Histone-like transcription factor (CBF/NF-Y) and archaeal histone
MEPKSTTPPPPPVMGAPVAYPPPPGAAYPAGPYAHAPAAALYPPPPPPPAPPTSQQGAAAAQQLQLFWAEQYREIEATTDFKNHNLPLARIKKIMKADEDVRMIAAEAPVVFARACEMFILELTHRGWAHAEENKRRTLQKSDIAAAVARTEVFDFLVDIVPRDEAKEADSAAAMGPAGIPHPAAGLPATDPMGYYYVQPQ

SEQ ID NO: 18990 - DNA, 459 bp, Sorghum bicolor
  misc_feature: Ceres ANNOT ID no. 8714677
  misc_feature: Encodes the peptide sequence at SEQ ID NO 18991
atggcgcccaaggccgagaagaagcccgcggccaagaagccggcggaggaggagccatcgacggagaaggcagagaaggccccggcggggaagaagccgaaggccgagaagcggctcccgtcgggcaagtccgcgggcaaggaaggcggcgagaagaagggaaagaagaaggcgaagaagtcggtggagacgtacaagatctacatcttcaaggtgctgaagcaggtgcacccggacatcggcatctcgtccaaggccatgtccatcatgaactccttcatcaacgacatcttcgagaagctggcggcggaggcggccaagctggcgcggtacaacaagaagcccaccatcacgtcccgggagatccagacctccgtccgcctcgtcctccccggtgagctcgccaagcacgccgtctccgagggcaccaaggccgtcaccaagttcaccagctcctag

SEQ ID NO: 18991 - protein, 152 aa, Sorghum bicolor
  misc_feature: Useful for biocontainment applications
  misc_feature: Useful for making plants with modulated flowering time
  misc_feature: Functional homolog of the protein sequence given in SEQ ID NO 13102
  misc_feature: Ceres ANNOT ID no. 8714677
  misc_feature (59)..(129): Pfam ID: Histone Pfam Description: Core histone H2A/H2B/H3/H4
MAPKAEKKPAAKKPAEEEPSTEKAEKAPAGKKPKAEKRLPSGKSAGKEGGEKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 18992 - DNA, 789 bp, Sorghum bicolor
  misc_feature: Ceres ANNOT ID no. 8714691
  misc_feature: Encodes the peptide sequence at SEQ ID NO 18993
atggcgctagcagcactcctgctcctgctccctctggcctcggccgccgctggcaccccggcgaaggcgaaggcgcccgcggtcccaccggcgccgcccaacatcacggcgctgatgtccaagggcgggtgcaaggcgttcgcgtcgctggtgtccaagtcccccgacgcgctctccgcgttccagtcggcggtgggcggcggcgtgacggcgttctgcccgacggacgacgccgtgcgggacttcatgcccagctaccggaacctcaccgcggacggcaaggcgtcgctgctgctgttccacgcggtgccggtctactacacgctgcgggggctcaagtccagcaacgggcccatgaacacgctcgccaccgacggcgccgccagcaactacaacctcacggtgcagaactcgggcgaccaggtcacgctccggacgccggcgtccgatgaccccgttcgggtgcggtccaccgtgttcgacaaggaccccgtcgccatctacgccgtggacgcggtgctggagcccgtcgagctgttcgaccccgccgaggcgccggcccccgcccccgcgcccgcggctgccgacgcgcccagtccctcctcgtcgtccggcaagcggacgcggcaccagcggcggcacggcgcggacgcgcccgggccggcagctgacgactcttcgccggccgaccagaggaaggactccaggaagaacgcggcggctcccggcgccccgtgtcgcccaaggtggctcgccgccgtggccgtggccgccgccttggctgcttag

SEQ ID NO: 18993 - protein, 262 aa, Sorghum bicolor
  misc_feature: Useful for making plants with altered cell wall content and/or composition
  misc_feature: Functional homolog of the protein sequence given in SEQ ID NO 14315
  misc_feature: Ceres ANNOT ID no. 8714691
  misc_feature (43)..(176): Pfam ID: Fasciclin Pfam Description: Fasciclin domain
MALAALLLLLPLASAAAGTPAKAKAPAVPPAPPNITALMSKGGCKAFASLVSKSPDALSAFQSAVGGGVTAFCPTDDAVRDFMPSYRNLTADGKASLLLFHAVPVYYTLRGLKSSNGPMNTLATDGAASNYNLTVQNSGDQVTLRTPASDDPVRVRSTVFDKDPVAIYAVDAVLEPVELFDPAEAPAPAPAPAAADAPSPSSSSGKRTRHQRRHGADAPGPAADDSSPADQRKDSRKNAAAPGAPCRPRWLAAVAVAAALAA

SEQ ID NO: 18994 - DNA, 1062 bp, Sorghum bicolor
  misc_feature: Ceres ANNOT ID no. 8714715
  misc_feature: Encodes the peptide sequence at SEQ ID NO 18995
atggattcatttgcatgggcgtcggtgtctcaggctgcggggctagccggcggcagcgccgtcgtctccgacgggagaagcgggggactcttgccgccgccgatgctcgggctccagctcccgtcaccggccgctctcgagcacttcatggaccccggcctagtccagctggccatgcgctcctcgtacatcacctccgaggaacacccactgcaagccaccaccggcagtggcaacggcgagccggggtttggcggcggcggcgacgcgccgagcgccgaggcctgctcgtccagggtaccggagccggactccaactccaacaaaaggaagcgatcgaacgagtcgcaggacgttcttgggatgattgggacggatcaagatcaagggatgccgtccgtggattcttccaaggagcgtggcgaggacgacgccaaaggcaaggaggagacgccgccggcgacgcgcaagaagaaagggaagggagcttcggccgccgacggcgagtcggagtcgtacatccatgtcagggcccggaaggggcaggcaaccaacaggcatagcctcgcagagaggctgagaagggagaagatcagtgagaggatgaagcttctgcaagaccttgttcctggttgcactaaagtaactgggaaggcggtgatgctggacgagatcatcaattatgtccagtccctgcaaaggcaagtggagttcttatccatgaagcttgctgcggtcaatccacagctcggcctcaacataaaacagcttctgtcgaaagatctttttcgcgcccccagtggtccttcaagctcatctgctcacctgggattctcgttctcccacgaaatgatgcccatactaccaccaatgtcacggtcgggtgtgctcccaggaggcgttcatggcttggccaattcagatgggttcagaacagccatggaggagcaactaaacggcaaagactccatcgcagatcatgtctctcagtctcaggtgtttcagattagaaatttagagcaattatgcatttgcaatcaggttggttttcaagaatcctaa

SEQ ID NO: 18995 - protein, 353 aa, Sorghum bicolor
  misc_feature: The sequence is a functional homolog of SEQ ID NO 186 in the 10/714,887 US patent application
  misc_feature: The sequence is a functional homolog of SEQ ID NO 186 in the 11/435,388 US patent application
  misc_feature: Ceres ANNOT ID no. 8714715
  misc_feature (183)..(233): Pfam ID: HLH Pfam Description: Helix-loop-helix DNA-binding domain
MDSFAWASVSQAAGLAGGSAVVSDGRSGGLLPPPMLGLQLPSPAALEHFMDPGLVQLAMRSSYITSEEHPLQATTGSGNGEPGFGGGGDAPSAEACSSRVPEPDSNSNKRKRSNESQDVLGMIGTDQDQGMPSVDSSKERGEDDAKGKEETPPATRKKKGKGASAADGESESYIHVRARKGQATNRHSLAERLRREKISERMKLLQDLVPGCTKVTGKAVMLDEIINYVQSLQRQVEFLSMKLAAVNPQLGLNIKQLLSKDLFRAPSGPSSSSAHLGFSFSHEMMPILPPMSRSGVLPGGVHGLANSDGFRTAMEEQLNGKDSIADHVSQSQVFQIRNLEQLCICNQVGFQES

SEQ ID NO: 18996 - DNA, 2742 bp, Sorghum bicolor
  misc_feature: Ceres ANNOT ID no. 8714789
  misc_feature: Encodes the peptide sequence at SEQ ID NO 18997
atggctttcaaaggaggaggacttgcgcgtgactctcgtggatcccttgaagtcttcaatccagacgccgccgctgtttcctcctcggccgccgcttcaacaacaaataatcgggcgttcctcctccctcctgctgctggcgctggggatgctgacgtgggtcgggcgacgcagagggccgccgagtggggcctggtcctccagaccgacgagcacaccgggcggccccagggcgtcgtcgcccgcccctctggctccaaccgcaccagcgagagtggaaactccattgacgacgacagctcgagggccgccgccgccggtactagagcgctccccagagtgtcggaggagcttcgcgccgcgctctctgcgttccagcagaccttcgtcgtgtccgatgccactcgccccgactaccccatcctctacgctagtgctggattcttcaacatgactggttactcctcaaatgaggtggtcggaaggaactgccgcttccttcaaggttctgggactgaccccgtagagatttccaagatcaggcaggctctcgcagctgggtcaaattactgtggtcgtattctcaactacaagaaggatggtacaccattctggaacctcctaactgttgcccccatcaaggatgaggatggcagggtcctcaagttcattgggatgcaagtggaagtgagtaagtacacagaaggtagcaaggatacagctcttcgcccaaatggattgccagagtcactcatcaaatatgatgccagacagaaggatcatgcccgtagctcagtctcagagcttctacttgccctcaaggatccacgatcattgtcagaatcaagaaacaataccttaaaaaggaaatcacaggaatcaggagatgtgcttttaggtgaagttcccggcaagagaagctccgaaagtggatcccgtcgtaactcacggagtggaatgcgaaactctctacaaaaaattagtgaagtgcctgaaggagggaataagaccaggaaatctggtttgcgctcctttatgggtcttattggtatggggcatggaaatgtagagaagaacattctaaaaccaagggaagatccgctacttgatagcgatgatgagagaccagaaagctttgatgatgatttcaggaggaaagaaatgagaaggggtatagatttggctactacacttgaacgtattgaaaagaattttgtcatcactgacccaaggttaccggacaatccaattatatttgcatcagatagctttttacgattgacagagtattgtcgcgaagaaatattgggaagaaattgcaggtttcttcaaggacctgaaactgaccgtgggacagtaaagaagataagggatgccatagataaccaaacagaagttaccgttcagctgataaactatacaaagagcggtaaaaaattctggaacctctttcacttgcaacctatgcgtgatcagaagggtgaagttcaatacttcattggggttcaattggatggaactgagcgtgttcgagacactgctgcaaaagatggtgccatgatggttaagaaaactgcagataatattgatgaggctgcaaaggaacttccggatgctaatttgagaccagaggatctatgggctaatcattcaaaaccagtcttgccaaagccacatatgaaggataccgcatcatggagagccatccaaaaggttcttgagaatggtgaaaacattgatttgaaacattttagaccagtaagacccttaggatctggtgacactggcagtgtgcatttggtggagttgcttggcacaggtgaatactttgccatgaaagctatggataaaagtgtcatgcttaaccgaaacaaggtccatagagctaccgctgaacgacaaatcttggatatgttggaccacccattccttccaacattgtatgcatcatttcagacaaagacacatgtgtgtcttattaccgactattatgctggcggggaactctttatgctcctcgataggcaacctatgaaggttctaaaggaagatgcggttaggttctatgctgcagaagtggtcacagcacttgaatacctacattgccaaggtataatctacagagacttaaagccagagaacattttacttcaaagagatgggcacatttccttgacagactttgatttgtcttgcttgacatcctgccaaccacaagtgtttcttccagaagatgataagaagaaaaggaggaggaagagcaggagcaatcccatattctttgccgagccaatgcgagcatcaaattcttttgttggtacagaggagtacatagcaccagagattattaccggagccggccatacaagtgctgtagattggtgggcgctaggaattcttctatatgagatgttgtatggttatacaccctttagagggaaaacaagacaaaggacctttgctaatattctgcacaaggatatcagatttcctgcgagcattcaggtgagccttgcggcaagacaattgatatacaggttgctacaccgggaccctgcaaataggctaggttcctacgagggtgctattgagatcaaacaacaccccttcttccgtggcataaactgggctctagttcgtgccgcaacacctccagagttagaggctcccttgcaagatacattggaggccacaggagagacattgcctcctcctgattcagctcacaccgatatgttttga

SEQ ID NO: 18997 - protein, 913 aa, Sorghum bicolor
  misc_feature: Useful for making plants with modulated light quality sensitivity
  misc_feature: Functional homolog of the protein sequence given in SEQ ID NO 13712
  misc_feature: Ceres ANNOT ID no. 8714789
  misc_feature (107)..(913): SWISSPROT Homolog: EC 2.7.11.1 Non-specific serine/threonine protein kinase
  misc_feature (584)..(871): Pfam ID: Pkinase Pfam Description: Protein kinase domain
  misc_feature (141)..(233): Pfam ID: PAS_3 Pfam Description: PAS fold
MAFKGGGLARDSRGSLEVFNPDAAAVSSSAAASTTNNRAFLLPPAAGAGDADVGRATQRAAEWGLVLQTDEHTGRPQGVVARPSGSNRTSESGNSIDDDSSRAAAAGTRALPRVSEELRAALSAFQQTFVVSDATRPDYPILYASAGFFNMTGYSSNEVVGRNCRFLQGSGTDPVEISKIRQALAAGSNYCGRILNYKKDGTPFWNLLTVAPIKDEDGRVLKFIGMQVEVSKYTEGSKDTALRPNGLPESLIKYDARQKDHARSSVSELLLALKDPRSLSESRNNTLKRKSQESGDVLLGEVPGKRSSESGSRRNSRSGMRNSLQKISEVPEGGNKTRKSGLRSFMGLIGMGHGNVEKNILKPREDPLLDSDDERPESFDDDFRRKEMRRGIDLATTLERIEKNFVITDPRLPDNPIIFASDSFLRLTEYCREEILGRNCRFLQGPETDRGTVKKIRDAIDNQTEVTVQLINYTKSGKKFWNLFHLQPMRDQKGEVQYFIGVQLDGTERVRDTAAKDGAMMVKKTADNIDEAAKELPDANLRPEDLWANHSKPVLPKPHMKDTASWRAIQKVLENGENIDLKHFRPVRPLGSGDTGSVHLVELLGTGEYFAMKAMDKSVMLNRNKVHRATAERQILDMLDHPFLPTLYASFQTKTHVCLITDYYAGGELFMLLDRQPMKVLKEDAVRFYAAEVVTALEYLHCQGIIYRDLKPENILLQRDGHISLTDFDLSCLTSCQPQVFLPEDDKKKRRRKSRSNPIFFAEPMRASNSFVGTEEYIAPEIITGAGHTSAVDWWALGILLYEMLYGYTPFRGKTRQRTFANILHKDIRFPASIQVSLAARQLIYRLLHRDPANRLGSYEGAIEIKQHPFFRGINWALVRAATPPELEAPLQDTLEATGETLPPPDSAHTDMF

SEQ ID NO: 18998 - DNA, 741 bp, Sorghum bicolor
  misc_feature: Ceres ANNOT ID no. 8714802
  misc_feature: Encodes the peptide sequence at SEQ ID NO 18999
atggacgagtgggttcgccaagctgaggtgtgggtgcgccaagccgagagctggatccggcagcagcccccggagcagatctatatcgcggccgtggtggttgccctcacaatcctgctgcttatcctagcatcttgtctgaaatcctcaaagctaaatactatagtgctatccggacttagtggcagtggcaaaactactattttctaccagcttcgggatggatcatcacatcaaggaactgtgacttcaatggaagaaaacaatgacacatttgtactacattcggagcaagaaaggaaaggcaaagtaaaacctgtgcatgttgttgatgtccctggccattcaaggctcaagcccaagcttgatgaagtcctgcctaaagcagctggggttgttttcgttgttgatgctcaagatttcttgtctagcatgcaagctgccgcagagtacctgtatgacattctgacaaaggcaactgtagtgaagaaaaaggttcctgtgcttatattctgcaacaagacagataaagttacagcccactcaaaggaaaacaagcttcgggaatcaaggaatgccatatcatcagctgacatctctgatgaagttcagctcggggtccctggagaggtattcaacttcagccattgccagaacaaggtggctgttgctgagggtgccggttcgaccggtaatgtttcagctgttgagcaattcatccgtgaacatgtgaaggcgtag

SEQ ID NO: 18999 - protein, 246 aa, Sorghum bicolor
  misc_feature: Useful for making plants with modulated cold sensitivity
  misc_feature: Functional homolog of the protein sequence given in SEQ ID NO 12929
  misc_feature: Ceres ANNOT ID no. 8714802
  misc_feature (39)..(203): Pfam ID: Arf Pfam Description: ADP-ribosylation factor family
MDEWVRQAEVWVRQAESWIRQQPPEQIYIAAVVVALTILLLILASCLKSSKLNTIVLSGLSGSGKTTIFYQLRDGSSHQGTVTSMEENNDTFVLHSEQERKGKVKPVHVVDVPGHSRLKPKLDEVLPKAAGVVFVVDAQDFLSSMQAAAEYLYDILTKATVVKKKVPVLIFCNKTDKVTAHSKENKLRESRNAISSADISDEVQLGVPGEVFNFSHCQNKVAVAEGAGSTGNVSAVEQFIREHVKA

SEQ ID NO: 19000 - DNA, 1011 bp, Sorghum bicolor
  misc_feature: Ceres ANNOT ID no. 8714804
  misc_feature: Encodes the peptide sequence at SEQ ID NO 19001
atggtgtcatcccccaatattaaggaggaagctaggagcccaaaacaggcagaggccacgcaacaaccaagtggcagtggggagcgtaagccacggccacagctagctgaggcgctcaggtgcccacgctgcaactccaacaacaccaaattttgctactacaacaactacaacacaatgcaaccacgctacttttgcaagggctgtcgccggtattggacacatggcggcaccctccgcaatgtcccagttggcggtgggtgccgcaagaacaagcgtgcctctagatctgtctcaggctctggttcctcttcgtcctcggctgcctatgcaccattatcccccgacaccaacaccagctctagtaagatgagcatcaacacacaaccgatgatggtgcctaacatgatgatgcccaccccaacaatgacaggcttattccccaatgtgctcccgacacttatgtcgacaggtggaggcagccacttcaacttcaccatggacaaccaacatgcctccatgcccttcacaccaatgccactatccaaccaggcatccgtgcccatgctggccgcgggagggagtgggacaatgccatctttcctagagatgctgagaagagggcttcttcatggtagcagtagctacgatgcaggtctcgtgatgagtggcggcaacaatgaaatggacatgtcattcccactgccagcatatggtgcaatgcatgggcatggattgagtggctcaaccactgatgatgccaggcagctggtggggactcagcagggaatgaatactgatagtggttttgcaggatcaactagagtgcaggaggaggaggaagagaagggggataacaaagccatggttaaaagcagcaataacaacaatgcccaacaacaacaacaacaacaacaacaacaacaacaacaacaacaacaacaacaacaacaaggggcagcaggggtagtgtgccaagctgtggaagtgttgctactgcaaacaatttaa

SEQ ID NO: 19001 - protein, 336 aa, Sorghum bicolor
  misc_feature: Useful for biocontainment applications
  misc_feature: Useful for making plants with modulated biomass
  misc_feature: Useful for making plants with modulated flowering time
  misc_feature: Useful for making plants with modulated light quality response
  misc_feature: Functional homolog of the protein sequence given in SEQ ID NO 13821
  misc_feature: Ceres ANNOT ID no. 8714804
  misc_feature (34)..(96): Pfam ID: zf-Dof Pfam Description: Dof domain, zinc finger
MVSSPNIKEEARSPKQAEATQQPSGSGERKPRPQLAEALRCPRCNSNNTKFCYYNNYNTMQPRYFCKGCRRYWTHGGTLRNVPVGGGCRKNKRASRSVSGSGSSSSSAAYAPLSPDTNTSSSKMSINTQPMMVPNMMMPTPTMTGLFPNVLPTLMSTGGGSHFNFTMDNQHASMPFTPMPLSNQASVPMLAAGGSGTMPSFLEMLRRGLLHGSSSYDAGLVMSGGNNEMDMSFPLPAYGAMHGHGLSGSTTDDARQLVGTQQGMNTDSGFAGSTRVQEEEEEKGDNKAMVKSSNNNNAQQQQQQQQQQQQQQQQQQQQGAAGVVCQAVEVLLLQTI

SEQ ID NO: 19002 - DNA, 1188 bp, Sorghum bicolor
  misc_feature: Ceres ANNOT ID no. 8714824
  misc_feature: Encodes the peptide sequence at SEQ ID NO 19003
atggatgatgttcaggaggcggcggccaaggcgacggaggacgacatcatgacgaagggccggcggcgggtggacgacggcttcttcgacgccgggaagccgccgccgttccgcatcggcgacgtgcgcgcggcggtgccggagcactgctggcgcaagagcccctggcggtcgctgtggtacgtggcgcgcgacgtggcggtggtggcggcgctgggcgcggcggcggcggcgggcgcggacagctgggcggtgtggccgctctactgggcggcgcaggggaccatgttctgggcgctcttcgtcctcggacacgactgtggtcacggcagcttctcggacagcccgacgctcaacagcgtggttggtcatctcctccactccttcatcctcgtcccctaccatggatggaggatcagccacagaacacaccatcagaaccacggccacatccacagggacgagtcatggcacccgatcacggaggggctgtaccggcaactggagacgcgcaccaagaagctcagattcacggtgcccttcccgctgctcgcattccctgtctacctcctgtaccggagccccggcaagacgggctcccactttcttcccagcagtgagctgttcagccccaaggagaagggcgacgtcatgctctcaaccacctgctggtgcgtcatgctcgcctccctcttcgccatggcgtgcgcgttcggtccagcccaggtgctcaagatgtacggcctcccataccttgtgtttgtgatgtggcttgacttggtgacgtacctgcaccaccatgggcaccatgagcgcctcccctggtaccgtggcgaggagtggagctacctgcgcggcgggctgacgacggtggacagagactacggctggatcaacaagatccaccacgacatcggcacccatgtcatccaccatctcttcccgcagatcccgcactaccatctcgtcgaagctaccaaggcagcgaagccggtgctggggcgatactaccgggagccacagaagtcagggccgctgccacggcacctccttggcgtgctcctcaggagcctcagagtcgaccactttgtcagcgaccgtggggatgttgtctactaccaaactgaccatgacttgaacaccactgctaaaggctgggctgcccaaaaccatcataagcaaaaatga

SEQ ID NO: 19003 - protein, 395 aa, Sorghum bicolor
  misc_feature: Useful for making plants with modulated heat sensitivity
  misc_feature: Functional homolog of the protein sequence given in SEQ ID NO 13709
  misc_feature: Ceres ANNOT ID no. 8714824
  misc_feature (35)..(338): SWISSPROT Homolog: EC 1.14.99.33 Delta(12)-fatty acid dehydrogenase
  misc_feature (89)..(333): Pfam ID: FA_desaturase Pfam Description: Fatty acid desaturase
MDDVQEAAAKATEDDIMTKGRRRVDDGFFDAGKPPPFRIGDVRAAVPEHCWRKSPWRSLWYVARDVAVVAALGAAAAAGADSWAVWPLYWAAQGTMFWALFVLGHDCGHGSFSDSPTLNSVVGHLLHSFILVPYHGWRISHRTHHQNHGHIHRDESWHPITEGLYRQLETRTKKLRFTVPFPLLAFPVYLLYRSPGKTGSHFLPSSELFSPKEKGDVMLSTTCWCVMLASLFAMACAFGPAQVLKMYGLPYLVFVMWLDLVTYLHHHGHHERLPWYRGEEWSYLRGGLTTVDRDYGWINKIHHDIGTHVIHHLFPQIPHYHLVEATKAAKPVLGRYYREPQKSGPLPRHLLGVLLRSLRVDHFVSDRGDVVYYQTDHDLNTTAKGWAAQNHHKQK

SEQ ID NO: 19004 - DNA, 657 bp, Sorghum bicolor
  misc_feature: Ceres ANNOT ID no. 8714840
  misc_feature: Encodes the peptide sequence at SEQ ID NO 19005
atgccgaagtccaagcgcaaccgcgcagtgaccttatcaaagaccaagaagaagccgggtttagagcgcaagggcaaagtagtcgccgagatcaaagatgctatcgacaaatacagcagcgcctatgttttcacctatgataacatgaggaatcagaagctcaaggacctgagggagcagctcaaatcttctagcaggatatttctcgctggaaagaaggttatgcagatagcgttggggcgttcccctgctgatgaagctaaaacaggtctccacaaactttccaagttccttcaaggcgactctggtctgttctttaccaatcttccaagggatgatgtcgagaggatgtttcgagaatttgaggagcatgattttgcaaggacaggaagtactgcggcagagacggtggagcttaaggaaggtcctctggaacagttcacacatgagatggagccatttctacggaagcaaggacttccagttcgcttgaacaaagaccatgtagtttgtgaggaaggaaagcctctttcaccagaagcagcacagactctgatggcaacattccgtctataccttgtgtgccgctggtcatgtgatgacttcgaagtttacaaagaaggcttgatgcacctaggagctgatgattcctcttaa

SEQ ID NO: 19005 - protein, 218 aa, Sorghum bicolor
  misc_feature: Useful for making plants with modulated nitrogen use efficiency
  misc_feature: Functional homolog of the protein sequence given in SEQ ID NO 14581
  misc_feature: Ceres ANNOT ID no. 8714840
  misc_feature (19)..(123): Pfam ID: Ribosomal_L10 Pfam Description: Ribosomal protein L10
MPKSKRNRAVTLSKTKKKPGLERKGKVVAEIKDAIDKYSSAYVFTYDNMRNQKLKDLREQLKSSSRIFLAGKKVMQIALGRSPADEAKTGLHKLSKFLQGDSGLFFTNLPRDDVERMFREFEEHDFARTGSTAAETVELKEGPLEQFTHEMEPFLRKQGLPVRLNKDHVVCEEGKPLSPEAAQTLMATFRLYLVCRWSCDDFEVYKEGLMHLGADDSS

SEQ ID NO: 19006 - DNA, 1101 bp, Sorghum bicolor
  misc_feature: Ceres ANNOT ID no. 8714842
  misc_feature: Encodes the peptide sequence at SEQ ID NO 19007
atggagaaagatagtagcaaaggcttcgacgatgagagctctgcagaccaccaggtgctgccgtccgtcggcgatggggagggtgatgatgctggtggcgccgacgacgtgcctcgcgccggtcatgacgggagctcaagcaatagcagcacggtggagctggatgaagccggcggggacagcggcaggaaggccgccggcgcctcgccgtcctcggtgcggccctacgtccgctccaagaacccccgcctccgctggacgccggagctccacctctgcttcctccgcgccgtcgacaggctcggcggccaagaccgtgcaactcccaagctcgttcttcaattgatgaacgttaaaggccttagcataggccatgtcaagagccatctccaaatgtacaggagcaagaagatcgacgactccggccaagtggtaggtaatactggttcatggagagatcttcatcatcagttgcatgacgggggacaagcgtacaacttcggccatctctccttgcatcacggccagactggtgctagtaccatattgtcagcaaggtttggtgcatggccccattggaacaatttccatgatccatcatatttgcttcacagtcgccatcttcttggatcaaaaccctactactcatcaacatctgaagcggacgcattccttagaactcgcgctcagtatactgctagagctactagcagcactccagcgtgtactcttcaaaggtgtttaacatatcaaaatgatcaattcatcatgaatcatcatcaacgacgtctgctgcacaatgaggataatatccaccatgaccctcttgatcttgaacttgcattggatatcggcccaagccgggacaagagaataaagagatcactaggatgtagctggggaagacatcaagaagaggagaatgtcgagaatcaagaagttgagagtgctactgatgatactcagctatctctttctttgctcccgtctccttcttctgtgaggaccagtagtggtggtcatcataaagtcctaggtctcaatatggaaaaggggacaacgcatccaacaaggacaagtactcttgatctcaccatatga

SEQ ID NO: 19007 - protein, 366 aa, Sorghum bicolor
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
  misc_feature: Ceres ANNOT ID no. 8714842
  misc_feature (83)..(134): Pfam ID: Myb_DNA-binding Pfam Description: Myb-like DNA-binding domain
MEKDSSKGFDDESSADHQVLPSVGDGEGDDAGGADDVPRAGHDGSSSNSSTVELDEAGGDSGRKAAGASPSSVRPYVRSKNPRLRWTPELHLCFLRAVDRLGGQDRATPKLVLQLMNVKGLSIGHVKSHLQMYRSKKIDDSGQVVGNTGSWRDLHHQLHDGGQAYNFGHLSLHHGQTGASTILSARFGAWPHWNNFHDPSYLLHSRHLLGSKPYYSSTSEADAFLRTRAQYTARATSSTPACTLQRCLTYQNDQFIMNHHQRRLLHNEDNIHHDPLDLELALDIGPSRDKRIKRSLGCSWGRHQEEENVENQEVESATDDTQLSLSLLPSPSSVRTSSGGHHKVLGLNMEKGTTHPTRTSTLDLTI

SEQ ID NO: 19008 - DNA, 972 bp, Sorghum bicolor
  misc_feature: Ceres ANNOT ID no. 8714880
  misc_feature: Encodes the peptide sequence at SEQ ID NO 19009
atgccatcattcatttcaacatcgactgcgttagatggaaagaaacacaagagaaggaagaacaaaagaacaaaagataaggaaggattaggaagaacaaaggataaaaagattctaacatttagggcttctttggaaactcaaatccctaaattaatgacaggcccccggcggccgctactacctgtctacctcgccgcgcgcgcctacgccagcgcccagggcgtccccttcgacaacaccacgacgacggccatcttcgactatggcaccaccgccgccgccaacaacaccagcagcccggcgatgccgacgttcccggcgtacaacgacaccgcgacggtgacatcgttcacgacgagcctccgcgggttgcgtaaggcggagctgccggcccgcgtcgacgagagcctcttcttcaccgtcggcgtcggcctcttcaactgctcgagcggggagacctgcagcgggcctaacaacacgcggttcgcggcgaacatgaacaacgtctccttcgtgctcccgtccaccacctccatcctgcaggcgcactacgccagcggcggcgcaacgtcggcgcccgccggcgtgttcaccgccgacttcccggccaacccgccggtgacgttcgactacacggcgcagaacgtgagccgcgcgctgtggcagcccgtgccgggcaccagggtgtacaggctcaagtacggcgccgccgtgcagctggtgctccagggcaccaacgtgttcgccgccgagaaccaccccatccacctccatggctacgacttctacatcctcgccgaggggtgggcggtcatccggttcgtggcggataatccgggggtgtggctgatgcactgccatttggatgtgcacatcacctggggcctcgccatggcgttcctggtggaagatggcgttggggagctcgaatctctggaggcgccgccggcagacctgcctgtctgctga

SEQ ID NO: 19009 - protein, 323 aa, Sorghum bicolor
  misc_feature: Useful for making plants with altered carbohydrate content
  misc_feature: Functional homolog of the protein sequence given in SEQ ID NO 14465
  misc_feature: Useful for making plants with altered cell wall content and/or composition
  misc_feature: Functional homolog of the protein sequence given in SEQ ID NO 14582
  misc_feature: Ceres ANNOT ID no. 8714880
  misc_feature (64)..(269): SWISSPROT Homolog: EC 1.10.3.2 Laccase
  misc_feature (201)..(307): Pfam ID: Cu-oxidase_2 Pfam Description: Multicopper oxidase
MPSFISTSTALDGKKHKRRKNKRTKDKEGLGRTKDKKILTFRASLETQIPKLMTGPRRPLLPVYLAARAYASAQGVPFDNTTTTAIFDYGTTAAANNTSSPAMPTFPAYNDTATVTSFTTSLRGLRKAELPARVDESLFFTVGVGLFNCSSGETCSGPNNTRFAANMNNVSFVLPSTTSILQAHYASGGATSAPAGVFTADFPANPPVTFDYTAQNVSRALWQPVPGTRVYRLKYGAAVQLVLQGTNVFAAENHPIHLHGYDFYILAEGWAVIRFVADNPGVWLMHCHLDVHITWGLAMAFLVEDGVGELESLEAPPADLPVC

SEQ ID NO: 19010 - DNA, 1185 bp, Sorghum bicolor
  misc_feature: Ceres ANNOT ID no. 8714920
  misc_feature: Encodes the peptide sequence at SEQ ID NO 19011
atggacggcggaggcgcggcctcgcccgataccgccatctgcatcgcccctggccctgggcccatcgtcgcggtgccccccgccgggatcagggtggagaactgctacgtgttcaagagccggctgcaggagtacgcgcagaaggctggccttccgaccccggagtaccacaccctgaaagaaggcccgtcccacgaacctgtcttcaagtccacggtgttggtgaacaacaccacgtacgagtccctgcctgggttcttcagccggaaggctgcggagcagtcggccgcggaagtcgcgctcatggagattgccatgtctgctccggtcgccgagaccagaagcatcccagcagttcaagaaactggcctgtgcaagaatcttcttcaagagtatgctcagaagatgaattacgccattccatcttatatttgcactaagcaagcgtcaggtgtagctcctttcatatgcactgttgagattggtggcatacaatacattggtgctgcggctagaacaaagaaggaggcagagataaaagctgcccgaactgctcttcttgcaatccagggtcaatcagaaggttgtgcaaatggtgctaaaaagtacattgttgttcctggacaaaggccggttaaggagacagataaaaaaccaactgaaacccccaaaccacttaaagtgaagaaacgtggttccaaaaggaaatggaacaagaagaaattggtggggatggctaaccaaattgttgatgctcaaaaggatgtagaggggcttggaatgcttctacagtatgaccatgaggaagctggaagaatagaatatgagttatctagagatactgcaatggttcaatttaacaaggaagttatagtgatgcaacctggtgagggagataggatagtgcaaccggagtcacccagagatcctgcacaggtccaacataacaatgcagctagaagtgtcgaacaggacccactcagcaacactgaagtggtgatgcctaacaatgaagctataactatagagcatgagccgctgagtgcctatgtaccgttgcaatctaatggggattctacagatgtgaaggaggcaccaagtaatacctcaatgatgcagggtgaggaatcagaaaccacaaggcaagaagcacctcacactggtgaactggttcaacctaactag

SEQ ID NO: 19011 - protein, 394 aa, Sorghum bicolor
  misc_feature: Useful for making plants with altered lignin content
  misc_feature: Functional homolog of the protein sequence given in SEQ ID NO 14584
  misc_feature: Ceres ANNOT ID no. 8714920
  misc_feature (39)..(103): SWISSPROT Homolog: EC 3.1.26.3 Ribonuclease III
  misc_feature (38)..(104): Pfam ID: dsrm Pfam Description: Double-stranded RNA binding motif
  misc_feature (125)..(189): Pfam ID: dsrm Pfam Description: Double-stranded RNA binding motif
MDGGGAASPDTAICIAPGPGPIVAVPPAGIRVENCYVFKSRLQEYAQKAGLPTPEYHTLKEGPSHEPVFKSTVLVNNTTYESLPGFFSRKAAEQSAAEVALMEIAMSAPVAETRSIPAVQETGLCKNLLQEYAQKMNYAIPSYICTKQASGVAPFICTVEIGGIQYIGAAARTKKEAEIKAARTALLAIQGQSEGCANGAKKYIVVPGQRPVKETDKKPTETPKPLKVKKRGSKRKWNKKKLVGMANQIVDAQKDVEGLGMLLQYDHEEAGRIEYELSRDTAMVQFNKEVIVMQPGEGDRIVQPESPRDPAQVQHNNAARSVEQDPLSNTEVVMPNNEAITIEHEPLSAYVPLQSNGDSTDVKEAPSNTSMMQGEESETTRQEAPHTGELVQPN

SEQ ID NO: 19012 - DNA, 840 bp, Sorghum bicolor
  misc_feature: Ceres ANNOT ID no. 8714958
  misc_feature: Encodes the peptide sequence at SEQ ID NO 19013
atgattccatcacatcacatctcctcgaatcctttcatgtgcttgtgtgtatatatatatgtattgtatctactcaaccacacccacatccttcatcattcagaaagcatagcacagcaaaagcctctcatgccaacaaacccaagcacacacacctccagccttccttcttctacaactcttgcttcctgcagctctactctcttgtttcgatcggccatggcggcggcggcggcggcggcggtggccacagagactccgttccatgtcctggcggtggacgacagtctcccggacaggaagctcatcgagaggctcctcaagacctcttccttccaagtgaccactgtcgactcagggagcaaggcgctgcagttcctgggactccatgacgaccacagccctgttcctgtccacacagaccagctggatgtggcagtgaacctgatcatcacagactactgcatgcccggcatgacaggatatgacctgctcaagaagatcaaggagtcgtcgtctctcagagatatcccagtggtgatcatgtcctctgagaacattccttcaaggatcaataggtgcctggaggaaggagctgatgagtttttcctaaaaccagtacggctatcagacatgaacaagctcaagccccacatactgaaaagcagatgcagagagcacaatcaccaggaacagctccagcaaagtgacagcaacagcgaggaatgcagtaatcccacgagcagcagcagcagcagcggtagcagcagcaaccgcaagagaaagggagcagacaacgaagaaatcttgccccaggcaaacagatcaaggcatagttag

SEQ ID NO: 19013 - protein, 279 aa, Sorghum bicolor
  misc_feature: Useful for making plants with altered carotene content
  misc_feature: Useful for making plants with altered lignin content
  misc_feature: Useful for making plants with altered terpenoid content
  misc_feature: Functional homolog of the protein sequence given in SEQ ID NO 13463
  misc_feature: Useful for making plants with modulated low light sensitivity
  misc_feature: Useful for making plants with modulated nitrogen use efficiency
  misc_feature: Functional homolog of the protein sequence given in SEQ ID NO 13599
  misc_feature: The sequence is a functional homolog of SEQ ID NO 932 in the 10/666,642 US patent application
  misc_feature: Ceres ANNOT ID no. 8714958
  misc_feature (88)..(216): Pfam ID: Response_reg Pfam Description: Response regulator receiver domain
MIPSHHISSNPFMCLCVYIYVLYLLNHTHILHHSESIAQQKPLMPTNPSTHTSSLPSSTTLASCSSTLLFRSAMAAAAAAAVATETPFHVLAVDDSLPDRKLIERLLKTSSFQVTTVDSGSKALQFLGLHDDHSPVPVHTDQLDVAVNLIITDYCMPGMTGYDLLKKIKESSSLRDIPVVIMSSENIPSRINRCLEEGADEFFLKPVRLSDMNKLKPHILKSRCREHNHQEQLQQSDSNSEECSNPTSSSSSSGSSSNRKRKGADNEEILPQANRSRHS

SEQ ID NO: 19014 - DNA, 1545 bp, Sorghum bicolor
  misc_feature: Ceres ANNOT ID no. 8714952
  misc_feature: Encodes the peptide sequence at SEQ ID NO 19015
atggcggctccccttgcaaaagatgaagaagatcacaagaaacatggagagggttgtagccatagccacttcctcgtggtggcctacagcatgcaaggccacgtcaaccctgcacgcacgctcgcacatcgccttgctcaggtcagcggctgcaccgccaccctctcgatcccgctctccggccaccgccgcatgttcccctcttcctccgacgacgacgacaaggaggccgccatcgtcagcgacgggctcatctcctacctccccttctccgacggcgtagacgacgggacctggcccatcgaagaggaagaccgggcgcgccgccgtgacgccaacttcagaaccctctccgccatcatcacccgcctcgccgccagtggcggacggccgccggtgaccaccgtggtgtgcaccctcagcatgccggtggtcggcgaggtcgcgcgcgcgcacggcctcccgctggccatctactggatccagccagcgaccgttctcgccacgtactaccactacttccacggccacgacgacgacgagctccatcaactcctcgccgccggcagcagcagcaacctaaggtccgacgacgacgaggtcgtcgtcactctcccaggcatgcaccgccctcttcgaatccgcgacatgccgagctttttggtcgaggagaagacgcaggacggcctgtccaagatgatcctccagtcgatgcgcgggctgtttcagcagatggacgaggagaagccggtggttctggtgaacacgttcgccgcgctggaggacgacgtcgtgctcagagccgtccagccatacatggacgtcgaggtcttcgccgtagggccagcagttccattattgaagaagaaggacgacggaggagcaagcgaagaacgactagcacagatccatctcttccagcacgacgagacggcggcgtacatggagtggctggacgagcagccggagaagtccgtcgtctacctctcgttcgggagcttgctgggatacacgagacggcaagccgaggaggtcctccacgggctgcaggccagcgggcgaccatacctgtgggtggtgcgcagggagggccgcgccgaggaggtggatgacctctgccgcctgtcgacggcggcggagaagaaggcggcggggatggtggtggagtggtgcgaccagcagcgggtgctggcgcacccatcggtggggtgcttcgtgacgcactgcgggtggaactcgacgctggaggccgtggtgagcggcgtgcccatggtggccgtgccgagctggtcggaccagccggtgaacgcgtggctggtggaggaggggtggcaggtgggtgtccgggcggagcgggacggagaagggacgctgacgagaggggagctcgcgaggtgtgtggagctggtcatgggcgccggtgacaaggcggtgcaggtgagggcgaatgcgagtgggctgaagcagagagctcgagaggctgttgctgcaggtgggccgctggaaacgagtctcaggagatttgtcgaattcatgcaaaagtaa

SEQ ID NO: 19015 - protein, 514 aa, Sorghum bicolor
  misc_feature: Useful for making plants with altered carbohydrate content
  misc_feature: Functional homolog of the protein sequence given in SEQ ID NO 14682
  misc_feature: Ceres ANNOT ID no. 8714952
  misc_feature (252)..(513): SWISSPROT Homolog: EC 2.4.1.121 Indole-3-acetate beta-glucosyltransferase
  misc_feature (22)..(514): Pfam ID: UDPGT Pfam Description: UDP-glucoronosyl and UDP-glucosyl transferase
MAAPLAKDEEDHKKHGEGCSHSHFLVVAYSMQGHVNPARTLAHRLAQVSGCTATLSIPLSGHRRMFPSSSDDDDKEAAIVSDGLISYLPFSDGVDDGTWPIEEEDRARRRDANFRTLSAIITRLAASGGRPPVTTVVCTLSMPVVGEVARAHGLPLAIYWIQPATVLATYYHYFHGHDDDELHQLLAAGSSSNLRSDDDEVVVTLPGMHRPLRIRDMPSFLVEEKTQDGLSKMILQSMRGLFQQMDEEKPVVLVNTFAALEDDVVLRAVQPYMDVEVFAVGPAVPLLKKKDDGGASEERLAQIHLFQHDETAAYMEWLDEQPEKSVVYLSFGSLLGYTRRQAEEVLHGLQASGRPYLWVVRREGRAEEVDDLCRLSTAAEKKAAGMVVEWCDQQRVLAHPSVGCFVTHCGWNSTLEAVVSGVPMVAVPSWSDQPVNAWLVEEGWQVGVRAERDGEGTLTRGELARCVELVMGAGDKAVQVRANASGLKQRAREAVAAGGPLETSLRRFVEFMQK

SEQ ID NO: 19016 - DNA, 1167 bp, Sorghum bicolor
  misc_feature: Ceres ANNOT ID no. 8715005
  misc_feature: Encodes the peptide sequence at SEQ ID NO 19017
atggctggcccgccgaaagggttcgacagccgatctcgagcgccagagtcagggatccccagtgagcggtcgaagatcgaggcccgcctcgaggactcgctggcgatgttcaaggaaacaaggatggaacgtctaatcgggaccccctcgagacacccaaggtcagcgctccagatatcagcatattacgcggcgtccgaccctcgaccgaacagggtcccttcccagggacaagttgggcgtcgactgacaacaccacagctaccccgccggatccgccgccatgccgtacaagcacgcgacctcagaaccagtgcaaggcggcgcgcagggcagaacgcaggagcacgcgtaatcatcaccgggctatcaagatgggacggctcgaggccatgccgtacggaagcctcgagtaggtcggcgctccatgcggagacattgcataagcataaacttcacaaaactgaagatcaaggaatcgaagattttgctgagcaacaaaatagttcaactacaaataagagcttgcttaagaattggccattgatgtcatcaattatcttattttgtgtcacctcttttgatgatatggcttacacagagatattttctctatgggccgaaagcgacaaaaagtatggaggactaggtttctcatctgaggatgtcggtcaagtgcttgcagttacaggtgctagcatccttttgtaccaaacatttgtttatccacgtattgtaaaagttcttggaccagtcaatgcttcccgtattgcagctattttgtctatggtgctccttttcacttatccaccaatgacacatctatcaaaaccatggttatcagttgtagtgaatattgcatcaatgttgaaaaacaatttagttgttaccgttgtaacatgctcttttattcttcagaataattcagtgcctcaagagcaaagagcaactgcaaatggcttagcaactacattaatgtcctttttcaaggcatttgccccagcaggagctggtattgtattttcatgggcacaaaaacgccaacatgctttcctctttccaggtgatcaaatggtgttcttccttctggacattgtgatctttgttgagctcatatggacattcaagccatttctagccattccggagcaaatccccagaagttag

SEQ ID NO: 19017 - protein, 388 aa, Sorghum bicolor
  misc_feature: Useful for making plants with modulated flowering time
  misc_feature: Functional homolog of the protein sequence given in SEQ ID NO 12969
  misc_feature: Ceres ANNOT ID no. 8715005
MAGPPKGFDSRSRAPESGIPSERSKIEARLEDSLAMFKETRMERLIGTPSRHPRSALQISAYYAASDPRPNRVPSQGQVGRRLTTPQLPRRIRRHAVQARDLRTSARRRAGQNAGARVIITGLSRWDGSRPCRTEASSRSALHAETLHKHKLHKTEDQGIEDFAEQQNSSTTNKSLLKNWPLMSSIILFCVTSFDDMAYTEIFSLWAESDKKYGGLGFSSEDVGQVLAVTGASILLYQTFVYPRIVKVLGPVNASRIAAILSMVLLFTYPPMTHLSKPWLSVVVNIASMLKNNLVVTVVTCSFILQNNSVPQEQRATANGLATTLMSFFKAFAPAGAGIVFSWAQKRQHAFLFPGDQMVFFLLDIVIFVELIWTFKPFLAIPEQIPRS

SEQ ID NO: 19018 - DNA, 666 bp, Sorghum bicolor
  misc_feature: Ceres ANNOT ID no. 8715003
  misc_feature: Encodes the peptide sequence at SEQ ID NO 19019
atggccggcggtggtgaagcgccgttgctggaagggaagcccagggtgtacttcgacggctgccccgggtgtgccaatgaccggaggaaggcggagaacctgggaattccctacggccaattcttccatatctggatcatcatcctcgtctcctgtttgccaatatcattgttgtttcccttcatatatttcatgataagagacttgcatattgctgaaagggtagagggtattggattctatgccggttttgtaggtgcttcatatatgcttggtagagctctaacttccaccgcttggggaatgatagcagatcgtattgggaggaagcccgttatcattctttcaattatctccacgcttttgttcaacactttgttcggattgagtgtaaattattggatggcgatagcaacaagattccttcttggttctttaaatggtttacttggcccaataagagttagcacatcatgggcaataggtcttattattgggccagctattggtggatacctcgcacagccagttgaaaaatatccaaagttatttccagccaattcaatatttgggaggttcccatattttttaccatgtttgtgtgtatcattcttctgtttggttatcctcataagctgtatttggctcccgaccttcattttgtag

SEQ ID NO: 19019 - protein, 221 aa, Sorghum bicolor
  misc_feature: Useful for making plants with modulated flowering time
  misc_feature: Functional homolog of the protein sequence given in SEQ ID NO 12969
  misc_feature: Ceres ANNOT ID no. 8715003
MAGGGEAPLLEGKPRVYFDGCPGCANDRRKAENLGIPYGQFFHIWIIILVSCLPISLLFPFIYFMIRDLHIAERVEGIGFYAGFVGASYMLGRALTSTAWGMIADRIGRKPVIILSIISTLLFNTLFGLSVNYWMAIATRFLLGSLNGLLGPIRVSTSWAIGLIIGPAIGGYLAQPVEKYPKLFPANSIFGRFPYFLPCLCVSFFCLVILISCIWLPTFIL

SEQ ID NO: 19020 - DNA, 1653 bp, Sorghum bicolor
  misc_feature: Ceres ANNOT ID no. 8715000
  misc_feature: Encodes the peptide sequence at SEQ ID NO 19021
atgggccaatgctgctccaagggcgccggggcggcggccgatgacgcggcggcgccagacgcaaaggcggaggcgccgagccgcgccgcgtcgaacggtggccaggagcggccgtcggcgtcgtcgtcggcggcacctgctgctggtaccaataacaagcaggcggtggcggcgtcgccgtccggcggcagggccagcacgggcacgagcagcagcaagccaccgggcccccttggcgcggtgctggggcggcccatggaggacgtgcgcgcggcctactccatgggcaaggagctcgggcgcgggcagttcggcgtgacgcacctgtgcacgcacaaggcgagcggcgagaagctggcgtgcaagacgatcgcgaagcggaagctggcgaccaaggaggacgtggaggacgtccggcgggaggtgcagatcatgcaccacctctccggccagcccaacgtggtgagcctccggggcgcctacgaggacaagcacaacgtgcacctggtcatggagctctgcgccggcggcgagctcttcgaccgcatcatcgccaaagggcagtacacggagcgcgccgccgcgtcgctgctgcgcaccatcgtgcagatcgtgcacacctgccacgccatgggggtgatgcacagggacatcaagcccgagaacttcctgctccagagcaaggccgaggacgcgccgctcaaggccaccgacttcggcctctccgtcttcttcaaggaaggggaggtgctgcgggacatcgtcggcagcgcatactacatcgcgccggaggtgctcaagaggaggtacggaccggaggccgacatctggagcgtcggcgtcatgctctacatcttcctcgccggcgtgcctccattctgggcagagaatgagaacggcatcttcaccgccatcctgcgcgggcagcttgacctctccagcgagccatggccgcacatttcaccgggagccaaggatctcgtcaggaagatgctccacatcaaccccaaggagcgactaaccgcgttccaggtcctcaatcacccatggatcaaagaagacggggatgcacctgatacaccacttgacaatgttgtcctcaacaggctcaagcagttcagggccatgaaccagttcaagaaagcagcgctgaggatcatagctggctgcctgtctgaagaggagatcactgggctcaaggagatgttcaagaacatcgacaaagataacagcgggaccattacgcttgaagagctcaaaaacgggttggcaaagcatggacccaagctatcagacggtgaacttcagcagctgatggaagcagctgatgctgatggcaacgggttaattgactacgacgagttcgtcaccgcgacagtgcacatgaacaaattggatagagaggagcacctttacacagcgtttcagtattttgacaaggacaacagcgggtacattacgagagaagagcttgagcaagccttgaaggagcaaggattgtatgacgccgagaaaatcaaagaggtcatctcagatgccgactctgacaacgatggaaggatagattattcagagtttgtggcgatgatgaggaaagggaccgctggtgctgaggcaatgaacaagaagaggcgagacatagtcctagagtga

SEQ ID NO: 19021 - protein, 550 aa, Sorghum bicolor
  misc_feature: The sequence is a functional homolog of SEQ ID NO 2 in US patent 7084323
  misc_feature: Ceres ANNOT ID no. 8715000
  misc_feature (81)..(533): SWISSPROT Homolog: EC 2.7.11.1 Non-specific serine/threonine protein kinase
  misc_feature (93)..(351): Pfam ID: Pkinase Pfam Description: Protein kinase domain
  misc_feature (505)..(533): Pfam ID: efhand Pfam Description: EF hand
  misc_feature (398)..(426): Pfam ID: efhand Pfam Description: EF hand
  misc_feature (470)..(498): Pfam ID: efhand Pfam Description: EF hand
  misc_feature (434)..(462): Pfam ID: efhand Pfam Description: EF hand
MGQCCSKGAGAAADDAAAPDAKAEAPSRAASNGGQERPSASSSAAPAAGTNNKQAVAASPSGGRASTGTSSSKPPGPLGAVLGRPMEDVRAAYSMGKELGRGQFGVTHLCTHKASGEKLACKTIAKRKLATKEDVEDVRREVQIMHHLSGQPNVVSLRGAYEDKHNVHLVMELCAGGELFDRIIAKGQYTERAAASLLRTIVQIVHTCHAMGVMHRDIKPENFLLQSKAEDAPLKATDFGLSVFFKEGEVLRDIVGSAYYIAPEVLKRRYGPEADIWSVGVMLYIFLAGVPPFWAENENGIFTAILRGQLDLSSEPWPHISPGAKDLVRKMLHINPKERLTAFQVLNHPWIKEDGDAPDTPLDNVVLNRLKQFRAMNQFKKAALRIIAGCLSEEEITGLKEMFKNIDKDNSGTITLEELKNGLAKHGPKLSDGELQQLMEAADADGNGLIDYDEFVTATVHMNKLDREEHLYTAFQYFDKDNSGYITREELEQALKEQGLYDAEKIKEVISDADSDNDGRIDYSEFVAMMRKGTAGAEAMNKKRRDIVLE

SEQ ID NO: 19022 - DNA, 1281 bp, Sorghum bicolor
  misc_feature: Ceres ANNOT ID no. 8715008
  misc_feature: Encodes the peptide sequence at SEQ ID NO 19023
atgagtgcaaccaaggtgaagagacgtgtgggcaagtatgagctcggccgaaccataggtgaaggcacattcgcaaaggtcaggttcgccaagaacactgagaccggagaacccgtagccatcaagatcctagataaggaaaaagtcctcaggcacaagatggtcgagcagattaagcgggaaatttcgaccatgaagttgattaagcatcctaatgttgttcgcatatatgaggtgatgggaagtaaaacaaagatctacattgtgttggagtatgttactggtggcgagctttttgacacaattgctaaccatggtcgaatgagggaagatgaggcaaggagatacttccaacagttaatcaatgcagttgattattgtcatagcaggggtgtgtaccaccgggatttaaaaccagagaatttactgcttgactcatatggaaatctgaaggatgatggattgctgcatacaacttgtgggactccaaactacgttgcaccagaggtcctagaagaccaaggctatgatggtgcaatggctgatttgtggtcatgtggagttatcctgtttgttctgctagctgggtatttaccttttgaggactctaatcttatgacgctgtataagaaaatatcgaatgcagaatatacatttccaccatggacgtctttccctgccaagaggttgttaacaagaatccttgatccaaatccaatgacgagaataacaatccctgaaatactggaggatgaatggttcaaaaagggctacaagcgcccggagtttgacgagaaatatgacacaccattggatgatgtggatgctgtcttcaatgattcagaagagcatcacgtgacagagaagaaagaagaagaaccagtagttctcaatgcatttgaactgatttcaaggtcagcaggcctaaatcttgggaacctatttgactcagagcaggaattcaaaagagaaacaaggttcacatcaaaatgtccaccaaaagaaattgtgcgcaagattgaggaagctgcaaaacctctaggatttggtgttcagaagaaaaattacaagttgaggcttgagaaagtaaaagcagggaggaagggaaacctcaatgttgctactgagatactgcaagttgcaccctcacttcatatggtagaagtcaggaaagcaaaaggtgacactctggaattccaaaagttctacaagaacctttccaagaccttaaaggacgttgtctggaaatctgaagatctgcaaatgcaacctgcttcttag

SEQ ID NO: 19023 - protein, 426 aa, Sorghum bicolor
  misc_feature: Useful for making plants with modulated salt sensitivity
  misc_feature: Functional homolog of the protein sequence given in SEQ ID NO 14255
  misc_feature: Ceres ANNOT ID no. 8715008
  misc_feature (5)..(418): SWISSPROT Homolog: EC 2.7.11.1 Non-specific serine/threonine protein kinase
  misc_feature (13)..(254): Pfam ID: Pkinase Pfam Description: Protein kinase domain
  misc_feature (293)..(353): Pfam ID: NAF Pfam Description: NAF domain
MSATKVKRRVGKYELGRTIGEGTFAKVRFAKNTETGEPVAIKILDKEKVLRHKMVEQIKREISTMKLIKHPNVVRIYEVMGSKTKIYIVLEYVTGGELFDTIANHGRMREDEARRYFQQLINAVDYCHSRGVYHRDLKPENLLLDSYGNLKDDGLLHTTCGTPNYVAPEVLEDQGYDGAMADLWSCGVILFVLLAGYLPFEDSNLMTLYKKISNAEYTFPPWTSFPAKRLLTRILDPNPMTRITIPEILEDEWFKKGYKRPEFDEKYDTPLDDVDAVFNDSEEHHVTEKKEEEPVVLNAFELISRSAGLNLGNLFDSEQEFKRETRFTSKCPPKEIVRKIEEAAKPLGFGVQKKNYKLRLEKVKAGRKGNLNVATEILQVAPSLHMVEVRKAKGDTLEFQKFYKNLSKTLKDVVWKSEDLQMQPAS

SEQ ID NO: 19024 - DNA, 2976 bp, Sorghum bicolor
  misc_feature: Ceres ANNOT ID no. 8715016
  misc_feature: Encodes the peptide sequence at SEQ ID NO 19025
atgtgcgggatcttcgcctacctcaactacaacgtctcgcgggagcgccgctacatcctcgaggtgctcttcaacggcctccgccgcctcgagtaccgcggctacgactcctccgggatcgcgctcgatgccgacgccgccgccgcccagctcccctccccctcccccgcctacgccggggcgccgccgctcgtgttccgccaggagggcaagatcgagaacctcgtgcgatccgtctactccgaggttgatgagaaggatgtgaacctggatgctgccttcagtgtgcatgctgggattgcccacaccaggtgggccacgcacggtgtgcctgctccaaggaacagccacccccaatcgtccggtgccggtgatgagttcttggttgtccacaacggcattatcaccaactatgaggtgctgaaagagacactaactaggcatgggttcacctttgagtctgatacagacacagaagtcattcctaagctagcaaagttcgttttcgataaatctcatgatgaagaaggtgatgtaacgtttagccaagttgttatggaagtcatgaggcagcttgaaggagcctacgcacttatctttaaaagtccacactatcccaatgaattgattgcatgcaaacgaggcagccaactgatacttggtgtcaatgaattgagtggtcaacagaatgggaaatcatttcatgatgtcaaaaccttgacaacaaacggaaagcccaaagaattattcttctccagtgatctatgtgctattgtagagcatacgaagaactatttagctcttgaagataatgaaatttgtcatattaaggatggtagtgtctcgatcctcaagtttgacccgcacaaagagaagccagcatctgtgcaacgagcattgtctgttcttgagatggaagttgagcaaataaagaaaggaagttatgaccacttcatgcaaaaagaaatccatgaacagccacattcattgaaaacaacaatgaggggtagactgaaggatggcggggttcttctaggtggactgaaggaatatctcaaaacaattaggcgctgtagaagggtggtttttattggctgtggaacaagttacaatgctgccttagctgcaagaccttttgtggaagaactgactggtattcctgtgactatggaggttgcaagtgacttgctggacagacaaggtcccatctacagagaagacactgcagtttttgttagtcagtctggggagacagcagataccctcatggctcttgattatgcactagaaaatggagctctttgtgttggcataacaaatactgttggaagcacactgtctagaaaaacacactgcggagttcatatcaatgctggttgtgagattggtgttgccagtacaaaggcatatacaagtcaaatagtagccatggcgatgatggcgttggctattggatccgatcaaatatctactcaagctagaagggaaactatcatcagtggacttaccaacctttcaagcaatgttagcgaagttctcaaactagatgttgaaatgaaggaacttgcctcgtcgctgatcgattcagagtcgctcctcgtgttcggaagaggctacaactatgccaccgcgctggagggtgctctgaaagtcaaggaggttgcgctgatgcacagcgaaggcatgcttgctggcgagatgaagcatgggccgctggccctggtggacgagaaccttcccatcattgtcattgcgactcgcgacgcatgcttcagcaagcagcagtcggtgatccagcagctcctttcgcgcaaggggcgcctgatagttatgtgctcgaggggagacgcttccgctgtatgccctagtggatcctgcagagtcattgaagttccacaggttgcagattgtctccagccagtgattaacataattccattacagttgctggcataccatctgactgttctccgtggattcgatgtggaccaaccaaggaatctggcgaagagcgtgacaacgcagcataggcagggagcagcaacagaaagagagaggcaggcagaaagagagaggcgggcagcagaaagagaaaggcagagatctagaagaagcaaatcttacagaaggagggcggctgctgaaacctcacagtctactgcagaaattcgcgggtcctcgaaggaggaaggttcgaccattatggacaccagtcaacagcagactctcttgcatgaagaagatggttcttctagtatggacatcaagcaacatcagagactcttgcatgaagaagaagatcaactgcctgattggatgtcacagctggttgtgatggatccttgtggttttgacgatggatttgacgaatggttttcagagatgttgaagttgggaggctatgaagatgatgtgtcttttctccctgaggtggatcaagaagagaactctattgattcagatgagttatatgatcttatagataaggaggtaaaggagtactgcaagagtatgaagaaagtttcttacaagaaaacaattgagaatggtttcaaatggatgagtgaggaatgcctcttagctttcacaatttctgctgaaaagttacattgtgagggcatcgagcacaagtttggtgaacttcacagtcaatgtttcagcgttgagtctcatgacaagatttttcatcactataacttcactattgaggaaaagcatggaaattctgatgtttggacttcaaaactttattttgctgaagtaaagcagttttctggtgtaaaatcctttctctgctgtctgctggagcaaaatgactgtggtcactgctatggatgcaagaatcaggatgtgtatgacttaaaacatcctagtaaaggtggttattatgaaggacattctggtatatgttggccttttatggatgaaacagactatgactctgatagtgatgatggttgtgtccttggctattga

SEQ ID NO: 19025 - protein, 991 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 12878
  misc_feature: Ceres ANNOT ID no. 8715016
  misc_feature (245)..(675): SWISSPROT Homolog: EC 2.6.1.16 Glutamine--fructose-6-phosphate transaminase (isomerizing)
  misc_feature (97)..(199): SWISSPROT Homolog: EC 2.4.2.14 Amidophosphoribosyltransferase
  misc_feature (354)..(483): Pfam ID: SIS Pfam Description: SIS domain
  misc_feature (525)..(658): Pfam ID: SIS Pfam Description: SIS domain
  misc_feature (2)..(255): Pfam ID: GATase_2 Pfam Description: Glutamine amidotransferases class-II
MCGIFAYLNYNVSRERRYILEVLFNGLRRLEYRGYDSSGIALDADAAAAQLPSPSPAYAGAPPLVFRQEGKIENLVRSVYSEVDEKDVNLDAAFSVHAGIAHTRWATHGVPAPRNSHPQSSGAGDEFLVVHNGIITNYEVLKETLTRHGFTFESDTDTEVIPKLAKFVFDKSHDEEGDVTFSQVVMEVMRQLEGAYALIFKSPHYPNELIACKRGSQLILGVNELSGQQNGKSFHDVKTLTTNGKPKELFFSSDLCAIVEHTKNYLALEDNEICHIKDGSVSILKFDPHKEKPASVQRALSVLEMEVEQIKKGSYDHFMQKEIHEQPHSLKTTMRGRLKDGGVLLGGLKEYLKTIRRCRRVVFIGCGTSYNAALAARPFVEELTGIPVTMEVASDLLDRQGPIYREDTAVFVSQSGETADTLMALDYALENGALCVGITNTVGSTLSRKTHCGVHINAGCEIGVASTKAYTSQIVAMAMMALAIGSDQISTQARRETIISGLTNLSSNVSEVLKLDVEMKELASSLIDSESLLVFGRGYNYATALEGALKVKEVALMHSEGMLAGEMKHGPLALVDENLPIIVIATRDACFSKQQSVIQQLLSRKGRLIVMCSRGDASAVCPSGSCRVIEVPQVADCLQPVINIIPLQLLAYHLTVLRGFDVDQPRNLAKSVTTQHRQGAATERERQAERERRAAERERQRSRRSKSYRRRAAAETSQSTAEIRGSSKEEGSTIMDTSQQQTLLHEEDGSSSMDIKQHQRLLHEEEDQLPDWMSQLVVMDPCGFDDGFDEWFSEMLKLGGYEDDVSFLPEVDQEENSIDSDELYDLIDKEVKEYCKSMKKVSYKKTIENGFKWMSEECLLAFTISAEKLHCEGIEHKFGELHSQCFSVESHDKIFHHYNFTIEEKHGNSDVWTSKLYFAEVKQFSGVKSFLCCLLEQNDCGHCYGCKNQDVYDLKHPSKGGYYEGHSGICWPFMDETDYDSDSDDGCVLGY

SEQ ID NO: 19026 - DNA, 2202 bp, Sorghum bicolor
  misc_feature: Ceres ANNOT ID no. 8715012
  misc_feature: Encodes the peptide sequence at SEQ ID NO 19027
atggccgcggctgctgggacggggacggggatgatgacaaggtcgtcgtcggtgttgctgctgatagtggtgacgactgtgaccctacacatcagcgtcgtcggagcgtcgtggtggtcgccattttccctgccgcaccgcggcggcggcgccgcctccagatcatcgccggccacggcggcccctggcgttacgttgcgcgtcgacgattatcaccatcaggtggttgtggacaacggcgtggtgcaggtgacgctgtcgaaaccgcagggccacatcaccggcgtccgctacaacggcgagcgcaacctcctgcacttcgacggcagcgaaaactcaggagggtactgggatgtggtgtggaactaccggggctccgatcagccaagaggaatgatcgacatgttggacagtacggagttcaaggtcgtggtttcaactgaggaccaagtggagctctctttcagcagcacatacaatccgtcacgccaagacagtgttcgcctgaatgttgacaagaggcttgtgatgctgaaaggcagctccggtttctactgttacgccatcatggagcacaccagcgactaccctgctctcaacatctccgaggctcgactggctttcaagctcaacactgacaagttcaactacatggcgatttcagacgacatacagaggtacatgccgagcgcggcggacagggacgagccacgtggcacgccgctggcctacaaggaggccgtgctgctggtgaacccgcaggagccgcagttcaagggcgaggtggatgacaagtacgagtactccatggacaacaaggacaacgccgtccatggctggatcaccggcggcggcggccccatcgtcggcttctgggtcatcactcccagcaacgagttcaagagcggcggacccatgaagcgggagctcacctcccatgtcggccccacctcgctcactatgtttcttggcacgcattacgtcgggaacgacatcgtgctcagcgtcggcgacggcgagtactggaagaaggtgatggggccggtcttcatctacctcaactccggccccagccgcggcggccacgtcagggcgctctgggacgacgccaaggcgatggcgcgtgcggaggccggcaagtggccgtacagcttcccggagtcgccggacttcgccaaggccgacgagaggggctccgtcgcaggcaggctggtggtccaggacacgttcacgagcaccgccgccgacgttcccgccttgacgacggcgtacgtcgggctcgccgcgcccgggcaggctggcagctgggcgacggagtgcaagggctaccagttctggacgacggcggacgcgtcctgcggcggcggcggcgggttcagcttcaccatcggcaacgtccggccgggggtgtacagcgtctacgcgtgggttcccggggtgctcggagactacgtgtcggcttcctcggtgaccgtgactgcaggcggcgccgtggtcgacctcggcgagctcgtgttccggccacccaggtcgggcccgacggtgtgggagatcggcgtccccgaccggaccgccgcggagttcttcgtccccgacgtggatcccagatacgccaacaggctcttcatcaacaaggacaggtacaggcagtacgggctgtgggcgaggtacgccgagctgtaccctgacggcgaccccgtgttcaccgtcggccagagcgacgcttccaaggactggttcttcgcgcacgtcaccaggaaggtcggcgacggcgacggcgacggcgacgggcggtacgcggcgacgacgcgggagatccggttcacgctggaccgcgtggtggccgacggcacctacacgctgcgcgtggcgctcgcggccgcgcagatgtcgaggctgcaggtgcgcgtgaacgggaggggaggaggtgggttggcggcggagctgacgacgccggagttcggcggcgggaacgccatcgcgcggcacggcatccacggcgtggagtggagcttcgagttcccgatcagagggtacatgctgcaggagggcgagaacagcgtcagcatcacgcagaccagggccgccggcgagttcctcggagtcttgtacgactacctccgcctcgaggcacctcccgggtcatggcgagaccccacgacggcggcgagggcgaggacgaggacgacgcggcgtgcgtga

SEQ ID NO: 19027 - protein, 733 aa, Sorghum bicolor
  misc_feature: Useful for making plants with altered cell wall content and/or composition
  misc_feature: Functional homolog of the protein sequence given in SEQ ID NO 14592
  misc_feature: Useful for making plants with altered carbohydrate content
  misc_feature: Functional homolog of the protein sequence given in SEQ ID NO 14593
  misc_feature: Ceres ANNOT ID no. 8715012
  misc_feature (11)..(262): Pfam ID: Rhamnogal_lyase Pfam Description: Rhamnogalacturonate lyase family
MAAAAGTGTGMMTRSSSVLLLIVVTTVTLHISVVGASWWSPFSLPHRGGGAASRSSPATAAPGVTLRVDDYHHQVVVDNGVVQVTLSKPQGHITGVRYNGERNLLHFDGSENSGGYWDVVWNYRGSDQPRGMIDMLDSTEFKVVVSTEDQVELSFSSTYNPSRQDSVRLNVDKRLVMLKGSSGFYCYAIMEHTSDYPALNISEARLAFKLNTDKFNYMAISDDIQRYMPSAADRDEPRGTPLAYKEAVLLVNPQEPQFKGEVDDKYEYSMDNKDNAVHGWITGGGGPIVGFWVITPSNEFKSGGPMKRELTSHVGPTSLTMFLGTHYVGNDIVLSVGDGEYWKKVMGPVFIYLNSGPSRGGHVRALWDDAKAMARAEAGKWPYSFPESPDFAKADERGSVAGRLVVQDTFTSTAADVPALTTAYVGLAAPGQAGSWATECKGYQFWTTADASCGGGGGFSFTIGNVRPGVYSVYAWVPGVLGDYVSASSVTVTAGGAVVDLGELVFRPPRSGPTVWEIGVPDRTAAEFFVPDVDPRYANRLFINKDRYRQYGLWARYAELYPDGDPVFTVGQSDASKDWFFAHVTRKVGDGDGDGDGRYAATTREIRFTLDRVVADGTYTLRVALAAAQMSRLQVRVNGRGGGGLAAELTTPEFGGGNAIARHGIHGVEWSFEFPIRGYMLQEGENSVSITQTRAAGEFLGVLYDYLRLEAPPGSWRDPTTAARARTRTTRRA

SEQ ID NO: 19028 - DNA, 384 bp, Sorghum bicolor
  misc_feature: Ceres ANNOT ID no. 8715100
  misc_feature: Encodes the peptide sequence at SEQ ID NO 19029
atgaccaccaagaacaaggtggcggcgctgctcctctgcttcctcgtcctggccgcgatcgtctccgccgagatcatcgatgccaatggtgtcgacgacgacgacggtggtgatgaagagcagctagacaaaggcggcagcggcggccaccacaaccacaagggccacaacaaggatggcaagggaaacctgaagccctctcagtgcggcggggagtgcaagcggcgatgctccaagacgcaccacaagaagccgtgcctcttcttctgcaacaagtgctgcgccaagtgcctgtgcgtgccgccgggcacctacggcaacaaggacacctgcccctgctacaacaactggaagaccaagagaggaggtcccaaatgcccatga

SEQ ID NO: 19029 - protein, 127 aa, Sorghum bicolor
  misc_feature: Useful for making plants with altered alkaloid content
  misc_feature: Useful for making plants with modulated nitrogen use efficiency
  misc_feature: Functional homolog of the protein sequence given in SEQ ID NO 12973
  misc_feature: Useful for making plants with altered terpenoid content
  misc_feature: Functional homolog of the protein sequence given in SEQ ID NO 14097
  misc_feature: Ceres ANNOT ID no. 8715100
  misc_feature (3)..(127): Pfam ID: GASA Pfam Description: Gibberellin regulated protein
MTTKNKVAALLLCFLVLAAIVSAEIIDANGVDDDDGGDEEQLDKGGSGGHHNHKGHNKDGKGNLKPSQCGGECKRRCSKTHHKKPCLFFCNKCCAKCLCVPPGTYGNKDTCPCYNNWKTKRGGPKCP

SEQ ID NO: 19030 - DNA, 1290 bp, Sorghum bicolor
  misc_feature: Ceres ANNOT ID no. 8715119
  misc_feature: Encodes the peptide sequence at SEQ ID NO 19031
atggcgagtggtggcggcagtagcagtagagtgcccggcggcggtggcaacctgaacctcccagctgggttccggttccaccccactgacgaggagctgatcgtgcactacctcatgaaccaggccgcctccattccgtgccctgtccccatcatcgccgaggtcaacatctaccagtgcaacccctgggatctccctgcaaaagcattgtttggcgagaacgagtggtacttcttcagcccacgagaccgcaagtaccccaatggcgtccgccccaaccgcgccgccgggtcagggtactggaaggccaccggcaccgacaaggccatcctgtccacgccgacgagccagaacatcggcgtcaagaaggccctcgtcttctacggcggcaggcctcccaagggcgtcaagaccgactggatcatgcacgagtaccgcctcaccggcggcacgaccgccgcagcggccgatgacaagaacagcagcatcaaacgcagatcagggtcctccatgaggctggacgactgggtgctgtgcaggatccacaagaagagcaacgatttccagttgtcggaccaggagcaggagaaggagggctcaaccgtggaggaattagacactcttgccaacaccaccaacaccgacaacagcatgaacgactctactgaaacaacaactcttggtcatcatgaccagctccgtcatgaaacggcggccatgacgacgatgagcaagtcgtgctcgctcaccgacctcctcaacagcatcgactacgcgtcgctctcgcagatgttccttgacatccctgccgaggccgaggagcctgcacaacagcaaagcactccactaatctacccaccagcaacacaaacaacacaccaagcagcacttactagtaataataactatgacaacaacgtgatgaacaacagcaacttgccgattgctgcagtagacgcagtgatagcaggctcggataacagcggtgtgaagaagaggaataagagagtgatggccgtggacggcgccgccgctgaatcgtgcttcgatgatggcagcagcgacagtttcagtagcaagaaactgaagctgccaagtgattcgaggatcgccggccatttcggcaccacagcaagcagctactactactgcaacaaccagctgcagcttgtggacagcgcgatgagtagtggctttcatcagtacagcagcctgttgctgagcagcagcaatccgttcttgagccagcagcagcagctgctactcaacagccacatcgggatgcagtag

SEQ ID NO: 19031 - protein, 429 aa, Sorghum bicolor
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 853 in the 10/374,780 US patent application
  misc_feature: The sequence is a functional homolog of SEQ ID NO 891 in the 10/374,780 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 890 in the 10/374,780 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: The sequence is a functional homolog of SEQ ID NO 852 in the 10/374,780 US patent application
  misc_feature: The sequence is a functional homolog of SEQ ID NO 320 in the 10/374,780 US patent application
  misc_feature: The sequence is a functional homolog of SEQ ID NO 850 in the 10/225,066 US patent application
  misc_feature: Useful for making plants with altered carbohydrate content
  misc_feature: Functional homolog of the protein sequence given in SEQ ID NO 13622
  misc_feature: Ceres ANNOT ID no. 8715119
  misc_feature (20)..(148): Pfam ID: NAM Pfam Description: No apical meristem (NAM) protein
MASGGGSSSRVPGGGGNLNLPAGFRFHPTDEELIVHYLMNQAASIPCPVPIIAEVNIYQCNPWDLPAKALFGENEWYFFSPRDRKYPNGVRPNRAAGSGYWKATGTDKAILSTPTSQNIGVKKALVFYGGRPPKGVKTDWIMHEYRLTGGTTAAAADDKNSSIKRRSGSSMRLDDWVLCRIHKKSNDFQLSDQEQEKEGSTVEELDTLANTTNTDNSMNDSTETTTLGHHDQLRHETAAMTTMSKSCSLTDLLNSIDYASLSQMFLDIPAEAEEPAQQQSTPLIYPPATQTTHQAALTSNNNYDNNVMNNSNLPIAAVDAVIAGSDNSGVKKRNKRVMAVDGAAAESCFDDGSSDSFSSKKLKLPSDSRIAGHFGTTASSYYYCNNQLQLVDSAMSSGFHQYSSLLLSSSNPFLSQQQQLLLNSHIGMQ

SEQ ID NO: 19032 - DNA, 1488 bp, Sorghum bicolor
  misc_feature: Ceres ANNOT ID no. 8715102
  misc_feature: Encodes the peptide sequence at SEQ ID NO 19033
atggcgccccgcggacggaccctgctcctcccgctcgccgcggccaccctgctcgtcgcctccaccatcttcctcttcgccgccgtcggcgcgcgctggcggcccgccgacaccggcctccccgtcccgccccaccatgccttccccaccgccgtccccgcggccgtgacctcgaccgcttcctcctcacccaacgccaccgccggcgacaaagagctctcctttcttgacgagaacggccaacccgacgacccttcctccgtctcagcatccagctccacctcctccaccacctccgcgccggtcagatgcgacccccgcgccgacgctgcggtcaaggtcttcatgtacgacttgccgccggagttccacttcggcctcctcggctggtccccgccttccgctgactccgtctggccagacgtcacccccggctcctccccgccgccgccgcgctaccccggggggctcaaccagcagcacagcgtggagtactggctcacgctcgacctcctctcctcctcctcttccaccccacccccctgcggccgccactcggcagtgcgggtggccgactcccgggacgccgacctcgtcttcgtccctttcttcgcgtcgctcagctacaaccgccactcccgtcccgtgccgcccgagaaggtgagcagggacagggccctgcaggagaagctggtggcgtacctcacggcgcggccggagtggaggaggttcggtggcgccgaccacgtcatcgtcgcgcaccaccccaacagcttgctgcgtgcccgggagacactgtctccggccgtgttcgtgctgtcggacttcgggaggtacccaccgagagtggctagcttggagaaggatgtcattgcgccatacaagcacatggctaagacgttcatcaatgactcggctgagtttgatgaccgacccacgttattgtacttccggggagcaatttacaggaaggagggagggagcattcgacaggagctatattatatgctcaaagatgaaaaggatgtttacttttcctttggaagtgtccaggaccatggggccagcaaagccagccaaggaatgcactcatcaaaattttgcctaaacattgccggggacaccccttcttccaatcgcctgtttgacgcgatagtgagccactgtgtccctgttatcattagtgacaacattgagctaccttatgaggacgtgttggattattcaaagttctccatttttgtccgttcgtctgatgctgttaaaaaaggttacctgatgcaactgctcagtggtgtaagcaagcaacagtggacaaagatgtggaataggctcaaagaggtggataaacattttgagtatcagtatccatcccagaaggatgatgcagttcagatgatctggcaagcattgtctagaaaggtgccaacaattaagctgaaggttcatagatctagtagattttcaagatctgacagaggaaaataa

SEQ ID NO: 19033 - protein, 495 aa, Sorghum bicolor
  misc_feature: Useful for making plants with altered carbohydrate content
  misc_feature: Functional homolog of the protein sequence given in SEQ ID NO 14192
  misc_feature: Useful for making plants with altered cell wall content and/or composition
  misc_feature: Functional homolog of the protein sequence given in SEQ ID NO 14193
  misc_feature: Ceres ANNOT ID no. 8715102
  misc_feature (114)..(445): Pfam ID: Exostosin Pfam Description: Exostosin family
MAPRGRTLLLPLAAATLLVASTIFLFAAVGARWRPADTGLPVPPHHAFPTAVPAAVTSTASSSPNATAGDKELSFLDENGQPDDPSSVSASSSTSSTTSAPVRCDPRADAAVKVFMYDLPPEFHFGLLGWSPPSADSVWPDVTPGSSPPPPRYPGGLNQQHSVEYWLTLDLLSSSSSTPPPCGRHSAVRVADSRDADLVFVPFFASLSYNRHSRPVPPEKVSRDRALQEKLVAYLTARPEWRRFGGADHVIVAHHPNSLLRARETLSPAVFVLSDFGRYPPRVASLEKDVIAPYKHMAKTFINDSAEFDDRPTLLYFRGAIYRKEGGSIRQELYYMLKDEKDVYFSFGSVQDHGASKASQGMHSSKFCLNIAGDTPSSNRLFDAIVSHCVPVIISDNIELPYEDVLDYSKFSIFVRSSDAVKKGYLMQLLSGVSKQQWTKMWNRLKEVDKHFEYQYPSQKDDAVQMIWQALSRKVPTIKLKVHRSSRFSRSDRGK

SEQ ID NO: 19034 - DNA, 936 bp, Sorghum bicolor
  misc_feature: Ceres ANNOT ID no. 8715122
  misc_feature: Encodes the peptide sequence at SEQ ID NO 19035
atggctgatgatgaggcggctcccgctccagctccggctccggctccggcgccggcggcggggctgaaggagagcatcgcggcgctatacgacgagtgttcggggccgtgggagcgcttgttgagcgaccacattcaccacggcttctacgacgtgggcgaggacgcgtcgtccaacgccgaccaccgccaagcccagctccgcatgatagaggagtcgctcgccttcgccgccgtcccatctccagatgatcccaaggcaccaaaaaacatagtagatgttggatgtggacttggtggtagctcaaggtacctggccaagaaatacggagcacaggtcaaggggatcacgttgagccctgttcaagctgaaagaggaaatgctctcgctgcagcggaggggttgtccaatcaggttactgctcaagtagctgatgctctgcagcaaccgttttgtgatgggcagttcgatctcgtatggtccatggaatgtggcgagcacgtgccggacaggagaaagtttgttagtgagatggcacgcgtcgcggctcctggagggagaataatcatcgtggcatggtgccataggaacctcgaaccatctgaaacctcgctgaaacccgatgaactgagcatcctgaagaggatttgcaatgcatactacttcccggagtggtgctcagcttcagaatatgtcaacattgccaagtcactgtctctcgaggatatcaagacagctgattggtcggagaacattgtcccgttttggcccgcttgtatgaaattattactaagttggaagggcctcacctctctactgacgagtggatggaagacgatcaaaggggtgatggtgattccgctgttgatccagggctacaagaagggggtcgtcaaattcgccatcatcacctgtcgcaagcctggagcagcgtag

SEQ ID NO: 19035 - protein, 311 aa, Sorghum bicolor
  misc_feature: The sequence is a functional homolog of SEQ ID NO 22 in US patent 7226745
  misc_feature: The sequence is a functional homolog of SEQ ID NO 36 in US patent 7244877
  misc_feature: Useful for making plants with modulated nitrogen use efficiency
  misc_feature: Functional homolog of the protein sequence given in SEQ ID NO 13084
  misc_feature: Ceres ANNOT ID no. 8715122
  misc_feature (22)..(308): SWISSPROT Homolog: EC 2.1.1.95 Tocopherol O-methyltransferase
  misc_feature (92)..(190): Pfam ID: Methyltransf_11 Pfam Description: Methyltransferase domain
MADDEAAPAPAPAPAPAPAAGLKESIAALYDECSGPWERLLSDHIHHGFYDVGEDASSNADHRQAQLRMIEESLAFAAVPSPDDPKAPKNIVDVGCGLGGSSRYLAKKYGAQVKGITLSPVQAERGNALAAAEGLSNQVTAQVADALQQPFCDGQFDLVWSMECGEHVPDRRKFVSEMARVAAPGGRIIIVAWCHRNLEPSETSLKPDELSILKRICNAYYFPEWCSASEYVNIAKSLSLEDIKTADWSENIVPFWPACMKLLLSWKGLTSLLTSGWKTIKGVMVIPLLIQGYKKGVVKFAIITCRKPGAA

SEQ ID NO: 19036 - DNA, 1086 bp, Sorghum bicolor
  misc_feature: Ceres ANNOT ID no. 8715132
  misc_feature: Encodes the peptide sequence at SEQ ID NO 19037
atggcctttcttatgttatgtttcacatcctttttgcacctacccattgcttctccattgcaaatcgacgccgtgacgacatctgcgcaagaccctgaacaggtcgtgcaagatgtagtcagaagcagcgtgaacatgccgtcgctgcaccggcgacggatggtaggcgaatgcagcagcggcaatccggtggacgactgctggcgctgcgaccccagctggtccgacaaccggcagcgcctggcggactgcgcggtcggcttcggccgcggctccaccggcggcaagaacggcaagtcctacgtggtgaccgaccccagcgacgacgccgacgcggcgagcccggcgccgggcacgctccgctacggcgtcatccagcaggagccgctgtggatcacgttcgcgcgcgacatgaccatcaggccgaagcaggacctggtcgtcgcctccgacaagaccgtcgacggccgcggcgccggcgtggtggtcggcgacggcggcgcctgcttcgtgctgcgcaacgtgagcaacgtcatcatccatgggctcaccatacgcgactgtaggcctgcacaggcgacatcgtcgtcgtcggagtcgcagggtgacggcatcaccgtgttcagctccaccgacgtgtgggtcgatcactgcacgctcgaggcctgcgccgacggcctcatcgacgtcacagacggctccacgaacgtgaccctgtccaacaacgttctcaggaaccataacaagacgatgctgcttggacacagcgacgatctcactgaatatatgtatatgtgccggtttggactgtttcacgtcatcaaaaacgactacataaactgggaaatatatgccattggtgggcagtgcttcgtgaccaagcgcgagggagcaccagacagtgagtggagtaagtggacctggatatctgaagatgatacgatgctcaacggcgcattcttcacttcatctggtactcctggacctgaagttaaggccccggggtttgccaagccgtcctcttctgtggcagcgatcactgcctcggtaggggttctaccatgcaaggagggctctctgtgctga

SEQ ID NO: 19037 - protein, 361 aa, Sorghum bicolor
  misc_feature: Useful for making plants with altered cell wall content and/or composition
  misc_feature: Functional homolog of the protein sequence given in SEQ ID NO 14683
  misc_feature: Ceres ANNOT ID no. 8715132
  misc_feature (9)..(261): SWISSPROT Homolog: EC 4.2.2.2 Pectate lyase
  misc_feature (143)..(291): Pfam ID: Pec_lyase_C Pfam Description: Pectate lyase
MAFLMLCFTSFLHLPIASPLQIDAVTTSAQDPEQVVQDVVRSSVNMPSLHRRRMVGECSSGNPVDDCWRCDPSWSDNRQRLADCAVGFGRGSTGGKNGKSYVVTDPSDDADAASPAPGTLRYGVIQQEPLWITFARDMTIRPKQDLVVASDKTVDGRGAGVVVGDGGACFVLRNVSNVIIHGLTIRDCRPAQATSSSSESQGDGITVFSSTDVWVDHCTLEACADGLIDVTDGSTNVTLSNNVLRNHNKTMLLGHSDDLTEYMYMCRFGLFHVIKNDYINWEIYAIGGQCFVTKREGAPDSEWSKWTWISEDDTMLNGAFFTSSGTPGPEVKAPGFAKPSSSVAAITASVGVLPCKEGSLC

SEQ ID NO: 19038 - DNA, 1233 bp, Sorghum bicolor
  misc_feature: Ceres ANNOT ID no. 8715165
  misc_feature: Encodes the peptide sequence at SEQ ID NO 19039
atgggcaactgcggcacgcgagaggagaatgccgtcgtcgccgcgcacgcgcaagttcagcagctccacttgttacaacatcctgccaagaacgcccttgcagataagaagcacacccgctcgtcgtcagatataagtgatccttcaacacctaagaaaattgaagatgccaagaacatttccatatacaatgacgtgattgccttcacattgtttgagctagagactatcacaaagagcttccgtgccgattatgttcttggtgagggaggatttgggaccgtttacaagggttacatagatgagaatgtcagggttggtctgaagtcactgcctgttgcagtcaaggtgctcaacaaagatgggcatcaagggcacagagaatggcttaccgaggttaacttcctggggcagttaaggcatccaaatttggtgaagttgattggatattgctgtgaggatgatcataggctacttgtatatgagtttatgtttcgaggaagtctagaaaaccacttattccgaaagacagctacaccattaccctggggtactaggatgtcaattgcattgggagctgctaaagggcttgcttgcctccacaatgctcaaaggcctgtaatctacagagatttcaagacctcaaatattctgctggactctgattatactgctaaactgtctgattttggcctggcaaaagctggccctgaaggtgatgagactcatgtgtcaacgagggtgatgggaacctatggatatgctgcccctgaatatgtgatgactggtcacttgactgctagaagtgatgtctacagcttcggcgtcgtccttctggagctcttgacagggcgcaagtcaattgacaagtcacggcccagcagggagcagagcctagttgactgggcccttcccaagctcaatgacaagaggaggcttctccaaataatcgacccgaaactggagggacagtattcggtcagagcggctcacaaagcctgcagcctcgcattctactgcttgagccataaccccaaggcaaggccactaatgagtgacgtcgtcgagaccctggagccgttgcagggcggtggcagtagcgatggagctggtcaatcttctggccttcctgattatagagctcgacgcaggctaacagggaacaacgtccacttaagggccatcccaaaccccaagtgctcccctgctgtccccgcttgcagagtgcggtga

SEQ ID NO: 19039 - protein, 410 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8715165
  misc_feature (29)..(397): SWISSPROT Homolog: EC 2.7.11.1 Non-specific serine/threonine protein kinase
  misc_feature (81)..(358): Pfam ID: Pkinase Pfam Description: Protein kinase domain
MGNCGTREENAVVAAHAQVQQLHLLQHPAKNALADKKHTRSSSDISDPSTPKKIEDAKNISIYNDVIAFTLFELETITKSFRADYVLGEGGFGTVYKGYIDENVRVGLKSLPVAVKVLNKDGHQGHREWLTEVNFLGQLRHPNLVKLIGYCCEDDHRLLVYEFMFRGSLENHLFRKTATPLPWGTRMSIALGAAKGLACLHNAQRPVIYRDFKTSNILLDSDYTAKLSDFGLAKAGPEGDETHVSTRVMGTYGYAAPEYVMTGHLTARSDVYSFGVVLLELLTGRKSIDKSRPSREQSLVDWALPKLNDKRRLLQIIDPKLEGQYSVRAAHKACSLAFYCLSHNPKARPLMSDVVETLEPLQGGGSSDGAGQSSGLPDYRARRRLTGNNVHLRAIPNPKCSPAVPACRVR

SEQ ID NO: 19040 - DNA, 1398 bp, Sorghum bicolor
  misc_feature: Ceres ANNOT ID no. 8715381
  misc_feature: Encodes the peptide sequence at SEQ ID NO 19041
atgggggtggccggcggcggggggcggctgcgtgcgagcagcgcgaagaagcagcggcagcggacgctgaacaacatcaagatcacgctgctgtgcggcttcatcacggtgctggtcctccgcggcacggccggcttcaacctcctgatcagcggcggcgacctggacggcgcggcggcggcggcggcggacgccaaggtggtggaggacgtggagcgcatcctggccgagatccgctccgactcggaggcggacgacgtcgtgttcgtggtcgaggacgacggctcatctctgccgtcgtcgtcgccgcggcgcaacgagacggcggcgagcttcggcaacttctcggcgtcggcgacggtggtgaaggtgcgggagtacagcctaggtcccaagctgacggactgggacgcgcagcggcgggagtggatgtcgcggcacccggagttccctccgctcgacccgcggcgtggtggccggccgcgcgtcctcctcgtctccggctcccctcctggcccctgcgacaaccccgtcggcgaccactacctcctcaaatcgaccaagaacaagatcgactactgccgtctccatggcatcgacgtggtgcacaacatggcgcacctggacccggagctgacggggtactggtccaagctgcccctggtgcggcggctcatgctggcgcacccggaggtggagtggatctggtggatggacagcgacgccatcttcacggacatggcgttcgagctcccactgtcccgctacgacggcgccaacctcgtcatccacgggtacccggacctgctgttcgagaagaggtcatggatcgcgctcaacgccggcatcttcctcctccggaactgccagtggtcgctggacctgctggacgcctgggtgcccatgggtccccgaggaccgtcgcgcgtcgaggcagggaagctgctgacggcgagcttgacgggccggccggcgttcgaggccgacgatcagtcggcgctcatccacctgctgctgatgcagaaggagaggtggatggacaaggtgcacgtggagacggagttctacctccatggattctggacggggctggtggacaggtacgaggagatgatggaggagcaccacccggggctcggcgacgaccggtggccattcatcacgcacttcgtcggctgcaagacctgcggcaggtacgaggattacccgctggaccggtgcgtcggcggcatggagcgcgccttcaacttcgccgacaaccaggtgctccggctgtacggattccggcaccgctcgctcaccaccgccaaggtcaggagggtcaccgacccggccaccaacccgctcatggcaaaggaggcggcgctcaagatggacgccaagttctccagcaactag

SEQ ID NO: 19041 - protein, 465 aa, Sorghum bicolor
  misc_feature: Useful for making plants with altered cell wall content and/or composition
  misc_feature: Functional homolog of the protein sequence given in SEQ ID NO 14684
  misc_feature: Useful for making plants with altered carbohydrate content
  misc_feature: Functional homolog of the protein sequence given in SEQ ID NO 14541
  misc_feature: Ceres ANNOT ID no. 8715381
  misc_feature (125)..(453): SWISSPROT Homolog: EC 2.4.2.39 Xyloglucan 6-xylosyltransferase
  misc_feature (159)..(403): Pfam ID: Glyco_transf_34 Pfam Description: galactosyl transferase GMA12/MNN10 family
MGVAGGGGRLRASSAKKQRQRTLNNIKITLLCGFITVLVLRGTAGFNLLISGGDLDGAAAAAADAKVVEDVERILAEIRSDSEADDVVFVVEDDGSSLPSSSPRRNETAASFGNFSASATVVKVREYSLGPKLTDWDAQRREWMSRHPEFPPLDPRRGGRPRVLLVSGSPPGPCDNPVGDHYLLKSTKNKIDYCRLHGIDVVHNMAHLDPELTGYWSKLPLVRRLMLAHPEVEWIWWMDSDAIFTDMAFELPLSRYDGANLVIHGYPDLLFEKRSWIALNAGIFLLRNCQWSLDLLDAWVPMGPRGPSRVEAGKLLTASLTGRPAFEADDQSALIHLLLMQKERWMDKVHVETEFYLHGFWTGLVDRYEEMMEEHHPGLGDDRWPFITHFVGCKTCGRYEDYPLDRCVGGMERAFNFADNQVLRLYGFRHRSLTTAKVRRVTDPATNPLMAKEAALKMDAKFSSN

SEQ ID NO: 19042 - DNA, 1548 bp, Sorghum bicolor
  misc_feature: Ceres ANNOT ID no. 8715380
  misc_feature: Encodes the peptide sequence at SEQ ID NO 19043
atgcgtacgccggcggccggcgtgtggcggctgcacccgcggggcagcggcagcggcggcggcggcggcagcaagctaaccaggcggataatcagcaacgtcaagatcaccctcctgtgcgccttcgtcacgctcctcgtcctccgcggcaccgtcggcgtcaaccgccgcctcgtctacatcgccggcacctccgacgacaaccgcgcggcggccacggccagcaccagacccgtcgacgacatcgagcgcatcctccgtgagatccgcgccgactccgaccccgacgcggcggcgaagcccagcttctcggcggagcactacgaccgcggcgccgcgtggacgacggcgaactacagcctgggtccccgggtgacgcggtggaacgccaagcggcggcggtggctgcaccagaacccggggttcccttcccgcgacgcgcggggcggtccgagggtgcttctcgtcacggcgtcgccgccggggccctgcagcagccccgccggcgaccgattcctgctccgggccaccaagaacaggctcgactactgccgcctccacggcgtcgagatggtgcacgtcacggcgcggctggaggaccccgagctgtcgtcgtcgtcgtcgtcgggcggtgccggcgggtgggccaagctcgcgctgctgcggcgcctcatgctggcgcacccggaggtggagtggctgtggtggctggacgcgggcgcgctcgtcaccgacatggggttcgagctcccgctggcgcgctacgagggcgcgcacctcgtcgtgcacggcaactcgtacctcctcttccagcgccggtcatgggacgccgccagcaccgccagcttcctgctccggaactgccagtggtctctggacctgctcgacgcctgggccgtcatggcgcccaggggccgcgcccgcgacgacgccgggaggctgctcaccgcgacgctggcagggcggccggagggagaagccgacgaccagtccgcgctcgtccacctgctcatcaccgagaaggagcggtggatggacagggtgtacctcgagaaccagttctacctccacggcgtctggacggggctcgtcggcaagttcgaggaggccatggagaagcaccacccggggtacggcgacgaccgctggccgttcgtcacgcacttcgccggctgcaagatttgcgacggcaggtccaacaggtccgcgtccgccggcgacggtggcggcggcaagaatcgcagtgatgagtacccgctggaccggtgcgtcggcggcatggagcgcgccttcaacttcgccgacaaccaggtgctcaggctctacgggttccggcaccagtcgctggcgaccgccgaggtcaggcgggtggccaaccggtcggcgaacccgctggaggccaaggaggaggcgctcgctttcttgaagaaacccaatgagccggatccatggagtagtgatgtgcgcaagtatctaaagcgaaaaggaaagggagattctgttcttgcaagaatcctgaggagactaggatggcgatccaagatttga

SEQ ID NO: 19043 - protein, 515 aa, Sorghum bicolor
  misc_feature: Useful for making plants with altered cell wall content and/or composition
  misc_feature: Functional homolog of the protein sequence given in SEQ ID NO 14540
  misc_feature: Ceres ANNOT ID no. 8715380
  misc_feature (115)..(395): SWISSPROT Homolog: EC 2.4.2.39 Xyloglucan 6-xylosyltransferase
  misc_feature (149)..(402): Pfam ID: Glyco_transf_34 Pfam Description: galactosyl transferase GMA12/MNN10 family
MRTPAAGVWRLHPRGSGSGGGGGSKLTRRIISNVKITLLCAFVTLLVLRGTVGVNRRLVYIAGTSDDNRAAATASTRPVDDIERILREIRADSDPDAAAKPSFSAEHYDRGAAWTTANYSLGPRVTRWNAKRRRWLHQNPGFPSRDARGGPRVLLVTASPPGPCSSPAGDRFLLRATKNRLDYCRLHGVEMVHVTARLEDPELSSSSSSGGAGGWAKLALLRRLMLAHPEVEWLWWLDAGALVTDMGFELPLARYEGAHLVVHGNSYLLFQRRSWDAASTASFLLRNCQWSLDLLDAWAVMAPRGRARDDAGRLLTATLAGRPEGEADDQSALVHLLITEKERWMDRVYLENQFYLHGVWTGLVGKFEEAMEKHHPGYGDDRWPFVTHFAGCKICDGRSNRSASAGDGGGGKNRSDEYPLDRCVGGMERAFNFADNQVLRLYGFRHQSLATAEVRRVANRSANPLEAKEEALAFLKKPNEPDPWSSDVRKYLKRKGKGDSVLARILRRLGWRSKI

SEQ ID NO: 19044 - DNA, 1218 bp, Sorghum bicolor
  misc_feature: Ceres ANNOT ID no. 8715414
  misc_feature: Encodes the peptide sequence at SEQ ID NO 19045
atggggtccatggggaaggcactaccggccaccgtcgacgagatcaggcgtgcgcagcgcgcggaagggccggccgccgtgctcgccatcggcacggcgaacccgcccacaatcatgccccaggacgactaccccgactactacttccgcgtcaccaacagcgagcacctcaccgacctcaaggccaagctcagcaggatctgcaaccacaacaagtccggcatcaggcagcgctacctgcacctcaacgaggagcttctcgccgccaacccgggcttcatcgaccccaagcggccgtccctggacgagcgcgtggagatggcctccgccgccgtcccggagctggccgcgaaagccgccaccaaggccatcgcggagtggggccgtcccgccaccgacatcacccacctcatcttcagcacctactccggcgcgcgtgccccgagcggagaccgccgcctcgcctccctgctgggcctccgccccaccgtgtcccgcaccatcctcaacctccacggctgctacggcggggggcggtcgctccagctcgccaaggagatcgccgagaacaaccgcggcgcgcgcgtcctcgtcgcctgctccgagctcacgctcatcgccttctacgggcccgagggaggctgcgtcgacaacatcatcggccagaccttgttcggcgacggtgccggcgccgtcgtcgtcggcgccgaccctgacgccgccgtcgagcgcccgctgttcgagatggcgttcgcgacgcagaccacgataccggagagcgaggacgccatctccatgcagtacagcaaatgtggcatggagtaccacctctccagcaaggtgccacgcctgatagggtgcaacgtggaacgctcccttgtcgacacgttccgcacgctcggcgtcaccgccgcatggaatgacctgttctgggcggttcaccccggaggtcgtgccatcctggacaacatcgaggaagtgctcggtctggaggacgacaaactggcggcgagtcgccatgtgctcagtgagtttggcaacatgagtggcaccacggtgatcttcgtgctcgatgagttgcgccgacgtcgggcagcggcggcgaagcagggaggggaaacgccggagtggggagtgctcatggcttttggaccgggaatcacaatcgagaccatagtgctccacaccccaagcaacccggaactggagggaaattga

SEQ ID NO: 19045 - protein, 405 aa, Sorghum bicolor
  misc_feature: The sequence is a functional homolog of SEQ ID NO 2 in US patent 7202397
  misc_feature: Ceres ANNOT ID no. 8715414
  misc_feature (11)..(398): SWISSPROT Homolog: EC 2.3.1.74 Naringenin-chalcone synthase
  misc_feature (10)..(238): Pfam ID: Chal_sti_synt_N Pfam Description: Chalcone and stilbene synthases, N-terminal domain
  misc_feature (248)..(398): Pfam ID: Chal_sti_synt_C Pfam Description: Chalcone and stilbene synthases, C-terminal domain
MGSMGKALPATVDEIRRAQRAEGPAAVLAIGTANPPTIMPQDDYPDYYFRVTNSEHLTDLKAKLSRICNHNKSGIRQRYLHLNEELLAANPGFIDPKRPSLDERVEMASAAVPELAAKAATKAIAEWGRPATDITHLIFSTYSGARAPSGDRRLASLLGLRPTVSRTILNLHGCYGGGRSLQLAKEIAENNRGARVLVACSELTLIAFYGPEGGCVDNIIGQTLFGDGAGAVVVGADPDAAVERPLFEMAFATQTTIPESEDAISMQYSKCGMEYHLSSKVPRLIGCNVERSLVDTFRTLGVTAAWNDLFWAVHPGGRAILDNIEEVLGLEDDKLAASRHVLSEFGNMSGTTVIFVLDELRRRRAAAAKQGGETPEWGVLMAFGPGITIETIVLHTPSNPELEGN

SEQ ID NO: 19046 - DNA, 789 bp, Sorghum bicolor
  misc_feature: Ceres ANNOT ID no. 8715430
  misc_feature: Encodes the peptide sequence at SEQ ID NO 19047
atggcgctcgccgcctcccaccacggcctcctgcccgtcgcccccgcccccaccgccacccttaccccgtcgcggggtcacctgcgcttccgcgccgcgcgacctctgcggcaccgacccgcccggagaatttgttgccaatctatcaactcagctaatgtgttgggagcttcttcaaagacatctgatgaggcagtcccagtcccagttgtccagatagatcaagattcagaccgtgatgcaaccattgtgcagctaagttttggagatcgtttgggggcactacttgacacgatgaaagcactcaaggaccttggccttgatgtcacaaaaggaagtgtgacaactgactcagctgtcacacaaacaaagttccacatcatgcgatctggacgcaaggttgaggaccctgacatgttagaaaggattcggctaaccatcatcaacaaccttctccagtatcatcctgaatcaagtgagaagttagcgatgggtgaattttttgggataaagcctcctgagaagaaggcaaatgatggaccaaaaagaagcatgctttacatagagacagccgatcggcctggcctacttcttgagataatcaagattattgcggacacaaatgttgatgtggaatcagctgagattgatactgaaggtttggttgcaaaggacaagttccatgtaagttacagaggtgcaaaactaaacagctccttatctcaggcgctgatcaattgtctgcgttattacctccgaaggcctgagacagatgaagacagttattga

SEQ ID NO: 19047 - protein, 262 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 13316
  misc_feature: Ceres ANNOT ID no. 8715430
  misc_feature (71)..(242): SWISSPROT Homolog: EC 2.7.7.59 [Protein-PII] uridylyltransferase
MALAASHHGLLPVAPAPTATLTPSRGHLRFRAARPLRHRPARRICCQSINSANVLGASSKTSDEAVPVPVVQIDQDSDRDATIVQLSFGDRLGALLDTMKALKDLGLDVTKGSVTTDSAVTQTKFHIMRSGRKVEDPDMLERIRLTIINNLLQYHPESSEKLAMGEFFGIKPPEKKANDGPKRSMLYIETADRPGLLLEIIKIIADTNVDVESAEIDTEGLVAKDKFHVSYRGAKLNSSLSQALINCLRYYLRRPETDEDSY

SEQ ID NO: 19048 - DNA, 1389 bp, Sorghum bicolor
  misc_feature: Ceres ANNOT ID no. 8715417
  misc_feature: Encodes the peptide sequence at SEQ ID NO 19049
atggagatggacccgccgccgccgccgcccctgcacgccgacaaccgccgccgccgccgctgccgcgagtacctgctcgcgctggaggaggaggagcgcaagatccgggtgttccagcgcgagctgccgctctgcctcgacctcgtcacgcagactatcgaggagatgaggagccacatggacagcgtggtggtcggcagcgaggaggagacggtcagcgaccacggcggcgggcccgtgctcgaggagttcatgccgctcaagcccaccctctcgtcctcctcttccgaggacgacgacgacgatgagcacgacagctcccgccaccaccaacaccgcgctgccggcgttggtgatgacgacaagaagaacgacgaggcatcgggagatccggagacggcggcagccttagccagcagcaggcggccgttgttgccacagccggagaccaagaaggcgatgccggactggctacagtccgtgcagctctggagtaaccaacaacagccgccgccgcagcagcagcaccaggacgagctgctgctgccgtgccggccggtggcgctcaacgcctaccggaagcccgggggcgcgttccagccgttcgagaaggacaaggacaaggagaagcagcgcggcgaactgccgctgccggcctcgtcgtcggccgcggcgagctcggccgtggtcggtgacagctgctgcgacagggccggcggcgccaccgacaccgacacggcggagaatactaataagttgagcatcaaaggcggcaaggacaaggaggctcagtcgtcgtcgcaggcgcccggccggaagccgcgccggtgctgggcgccggagctccaccgccggttcctgcaggcgctgcagcagctcggcgggtcccacgcggcgacgccgaagcagatccgggagctcatgaaggtcgacggtctcaccaacgatgaggtcaagagccatttgcagaagtatcgcttgcacacgaggcggccgaactcgacgacggcggtcgcggtccagagcgggggcaccagcgtcgtcgcgccgccgacggcgccacagttcgtcgtggtgggaggcatctgggtgccaccgccggagtacgctgccgcggctgcggcagctgctgctgcggcggcggcggcggcggcatcgcagccgcagcaggcgccgcacctagccagcaccggcgacgcgtcaggaacgccgacggcgaccgccaacaaggtgtacgctccggtggcgacgacgttgacaacgcccggactgctgcagccgcgtccggagaggcagtccagcagctgctccggcgggcggcgcagtggggacgcctgctctgggtcgccggccgtgtcgtcgtcgtcgtcgcagaccacctctgcgtaa

SEQ ID NO: 19049 - protein, 462 aa, Sorghum bicolor
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
  misc_feature: Ceres ANNOT ID no. 8715417
  misc_feature (275)..(326): Pfam ID: Myb_DNA-binding Pfam Description: Myb-like DNA-binding domain
MEMDPPPPPPLHADNRRRRRCREYLLALEEEERKIRVFQRELPLCLDLVTQTIEEMRSHMDSVVVGSEEETVSDHGGGPVLEEFMPLKPTLSSSSSEDDDDDEHDSSRHHQHRAAGVGDDDKKNDEASGDPETAAALASSRRPLLPQPETKKAMPDWLQSVQLWSNQQQPPPQQQHQDELLLPCRPVALNAYRKPGGAFQPFEKDKDKEKQRGELPLPASSSAAASSAVVGDSCCDRAGGATDTDTAENTNKLSIKGGKDKEAQSSSQAPGRKPRRCWAPELHRRFLQALQQLGGSHAATPKQIRELMKVDGLTNDEVKSHLQKYRLHTRRPNSTTAVAVQSGGTSVVAPPTAPQFVVVGGIWVPPPEYAAAAAAAAAAAAAAAASQPQQAPHLASTGDASGTPTATANKVYAPVATTLTTPGLLQPRPERQSSSCSGGRRSGDACSGSPAVSSSSSQTTSA

SEQ ID NO: 19050 - DNA, 1374 bp, Sorghum bicolor
  misc_feature: Ceres ANNOT ID no. 8715431
  misc_feature: Encodes the peptide sequence at SEQ ID NO 19051
atgggagatactagtagttctagccattcaaggcaggatccctgtgctcttggctatggcttccatggtgccatcgccaattccattcctgcaaacttctttgaccaagacggaggtgcctattttggagagctggaagaggctttcatgcatcaggttgcctcactcgcaagaactcaacaagctgcaactacctccatagctcatcatggagacatcaagcctgcaacgactacagctaggccacctcctacactggacatcttcccagcttggcctatgaggtctcttcacacacccaaggagggctcaaatgtgacagcagacagcacagacgactcggagagcagcagcaagaacaacagcaaccactcagatcagcacggagcagcagcagacatgcaaagccagtttggtcaaggttcacagcagcagcagcagcagcagcttcagcacaagacaatcagaaggcttgcgcagaaccgagaagctgcacgcaaaagccggctgcgaaagaaggcttacattcagcagcttgagagcagcaaactgaagcttgctcagatagaacaggatatgcagagagcacattcccagggcatctttctaggaggagctccaggtgcaaactctagctcaggcgccgcaatgttcgacgtggagtacgcccgttggctggatgaccacggccggcgcatggccgagctgcacggagctctgcatgcgcacttgccagatggtgacctcagagccatcgtggatgacaccctgacccaccacgatgagctgttccagctaaaggcgtcggcagccaagtctgacgtgttccacctcatcaccggggtgtggacgaccccggctgagcggtgcttcctctggatgggtggattcaggccatcggatctggtcaagacgctgctgccccagctagatcccttgactgagcagcaactggtaggcatatgcaaccttcaacagtcatcacagcaggcagaggaagctctctcccagggcctggaccagctgcatcagtccctagctgacaccatggccggtggatctctgattgacgacaccaacatgagcttcatgggtcaaatggcccttgcccttggcaagctgtccaaccttgaaggttttgtgatacaggctgataacttgaggcagcagactcttcatcagatgcaccggattctgacagttcggcaggcagctcgatgtttcttggccattggcgagtaccacaaccgcctccgtgccttaagctccctctgggtttctcggcctcgagagatactgggtgcagatgaaggcaattgtggggagataagcattgcggcacaagcatctcaaagccaattttcatccttctga

SEQ ID NO: 19051 - protein, 457 aa, Sorghum bicolor
  misc_feature: The sequence is a functional homolog of SEQ ID NO 1498 in the 10/374,780 US patent application
  misc_feature: The sequence is a functional homolog of SEQ ID NO 1568 in the 10/412,699 US patent application
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: Useful for making plants with modulated biomass
  misc_feature: Functional homolog of the protein sequence given in SEQ ID NO 13416
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: The sequence is a functional homolog of SEQ ID NO 1788 in the 10/412,699 US patent application
  misc_feature: The sequence is a functional homolog of SEQ ID NO 2026 in the 10/374,780 US patent application
  misc_feature: The sequence is a functional homolog of SEQ ID NO 354 in the 10/412,699 US patent application
  misc_feature: The sequence is a functional homolog of SEQ ID NO 823 in the 11/479,226 US patent application
  misc_feature: The sequence is a functional homolog of SEQ ID NO 930 in the 11/435,388 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 114 in the 10/666,642 US patent application
  misc_feature: The sequence is a functional homolog of SEQ ID NO 2362 in the 10/374,780 US patent application
  misc_feature: The sequence is a functional homolog of SEQ ID NO 376 in the 10/412,699 US patent application
  misc_feature: The sequence is a functional homolog of SEQ ID NO 608 in the 10/225,066 US patent application
  misc_feature: The sequence is a functional homolog of SEQ ID NO 848 in the 11/435,388 US patent application
  misc_feature: The sequence is a functional homolog of SEQ ID NO 871 in the 11/479,226 US patent application
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: Ceres ANNOT ID no. 8715431
MGDTSSSSHSRQDPCALGYGFHGAIANSIPANFFDQDGGAYFGELEEAFMHQVASLARTQQAATTSIAHHGDIKPATTTARPPPTLDIFPAWPMRSLHTPKEGSNVTADSTDDSESSSKNNSNHSDQHGAAADMQSQFGQGSQQQQQQQLQHKTIRRLAQNREAARKSRLRKKAYIQQLESSKLKLAQIEQDMQRAHSQGIFLGGAPGANSSSGAAMFDVEYARWLDDHGRRMAELHGALHAHLPDGDLRAIVDDTLTHHDELFQLKASAAKSDVFHLITGVWTTPAERCFLWMGGFRPSDLVKTLLPQLDPLTEQQLVGICNLQQSSQQAEEALSQGLDQLHQSLADTMAGGSLIDDTNMSFMGQMALALGKLSNLEGFVIQADNLRQQTLHQMHRILTVRQAARCFLAIGEYHNRLRALSSLWVSRPREILGADEGNCGEISIAAQASQSQFSSF

SEQ ID NO: 19052 - DNA, 822 bp, Sorghum bicolor
  misc_feature: Ceres ANNOT ID no. 8715438
  misc_feature: Encodes the peptide sequence at SEQ ID NO 19053
atggcaaatgcttctctgcaatcctttcttctcccgcagcaccattctttcgccagcaacggcggcagccatgacggctccccgtctgccctgttcaagctctccaccaacaccggcagcagcatttccttcaggctccaccccaacacctcccgctcggtgaccacaacctcgaccaccaactcgtcagctccaactccagtggccccggcagctgcatcagcagcagaagaagactcatcaccagccccctcccttgacctcctcagccgccagctcgcggcaggggactaccgccaggccgacgagaccacccgggcgctcatcatcgaccttgctggcgagtccgcgaggcgccgagggtacgtcttcttctcagaggtccagttcatctccgccgaggaccttcgcgccattgacgagctctggaaagagcacagcaatggcaagttcgggtacagcgtgcagcggcggctctgggagaaatcgcagcgcgacttcacccgcttcttcatcagggtcggctggatgaagaagctggacactgaggtagagcagtacaactacagggccttccctgacgagttcatgtgggagataaaggatgacacacctgagggtcacctgccgctcaccaatgcgctcaggggcacacagctcctggggaacatcctcacccacccggccttccaggaggagaaccagcaagacgaagctgcagctgcagcagagagtgccaccactggtcaaagcaaagatgataacaaagggagggagagaccaaagttcatgaaagatttcaagcctgattattccttttga

SEQ ID NO: 19053 - protein, 273 aa, Sorghum bicolor
  misc_feature: Useful for biocontainment applications
  misc_feature: Functional homolog of the protein sequence given in SEQ ID NO 14685
  misc_feature: Ceres ANNOT ID no. 8715438
  misc_feature (89)..(232): Pfam ID: GUN4 Pfam Description: GUN4-like
MANASLQSFLLPQHHSFASNGGSHDGSPSALFKLSTNTGSSISFRLHPNTSRSVTTTSTTNSSAPTPVAPAAASAAEEDSSPAPSLDLLSRQLAAGDYRQADETTRALIIDLAGESARRRGYVFFSEVQFISAEDLRAIDELWKEHSNGKFGYSVQRRLWEKSQRDFTRFFIRVGWMKKLDTEVEQYNYRAFPDEFMWEIKDDTPEGHLPLTNALRGTQLLGNILTHPAFQEENQQDEAAAAAESATTGQSKDDNKGRERPKFMKDFKPDYSF

SEQ ID NO: 19054 - DNA, 1311 bp, Sorghum bicolor
  misc_feature: Ceres ANNOT ID no. 8715659
  misc_feature: Encodes the peptide sequence at SEQ ID NO 19055
atggacttcagttgctttcagccccacacagggatttgtagttacctgccatttgattcatatatgcagcaaaatggacgctgtgagctacatcctgttgatcatcatccaattgaagttattggggatgcagccttcaacgaccttagacaccagttctttacagaaagagaaatcaagaagcccatatttgaccgtggttcatcgattggtcatagagttggatctcaactgcctctgctgactcccaaaactgaggtttctcatctcatggacagtggccttggatcatataaggcatatgagatgaatggcaggtttctgccaagaaagaagacatctttgaagaaaaccaatgttgtgaaagggcagtggacaccagaggaagatagtgaactcattcttggaaaatttaacaggaagctggtaaaattagtggaacaatttggactgaggaagtggtcttacatagcacaactgctaccaggaagagtgggaaagcaatgcagagaaagatggcacaaccacttgaggccaaacatcaagaaagacatttggaacgacgaggaagacatggtgctgatacaagcacacaaggaagtgggcaacaaatgggcagagatagctaagcggctacccggcaggacagagaactccataaagaaccattggaacgcaacaaagcgaaggcagtttgcacggagaaggagccgcaatagctccaagggtcccaaatcaggcacccttcttcagaactacatcaaaggccttggtatttgcccaagcaacaagaccgtcgccgtcgccgtcgccgccacgcctcttcctgaacctaaatcgtcgccatcttcttcacctgaaactcccggagcgaagaagccagcaaagactgatgaaataaagctggaaaacatactgaattcccaagacattcttcttcccagcatggaggagtacatttgcagcgagtctctgtcctgtgatgaccttcttgcccctatctgtgatggcttttcagttgaaatgtgtgacggcctgttcgacgcgaacgagggcggcttccaagtatgcaccgtggatgacgacgacatcgacatgaactacatcttcaaccatatcgaccacgcgatcaaggttgatcctgagatagacatggagatgatgatgatgatgtgggatgaggacgccctcgaatgcgctgaacctgctggacctgcagctcatgtcgaaactgtgcatgtgaaggaggagatggacctgattgagatggtggcagccacgcagaactgcggcgaggcagaaaatcactag

SEQ ID NO: 19055 - protein, 436 aa, Sorghum bicolor
  misc_feature: Useful for making plants with altered cell wall content and/or composition
  misc_feature: Functional homolog of the protein sequence given in SEQ ID NO 13602
  misc_feature: Ceres ANNOT ID no. 8715659
  misc_feature (183)..(228): Pfam ID: Myb_DNA-binding Pfam Description: Myb-like DNA-binding domain
  misc_feature (122)..(177): Pfam ID: Myb_DNA-binding Pfam Description: Myb-like DNA-binding domain
MDFSCFQPHTGICSYLPFDSYMQQNGRCELHPVDHHPIEVIGDAAFNDLRHQFFTEREIKKPIFDRGSSIGHRVGSQLPLLTPKTEVSHLMDSGLGSYKAYEMNGRFLPRKKTSLKKTNVVKGQWTPEEDSELILGKFNRKLVKLVEQFGLRKWSYIAQLLPGRVGKQCRERWHNHLRPNIKKDIWNDEEDMVLIQAHKEVGNKWAEIAKRLPGRTENSIKNHWNATKRRQFARRRSRNSSKGPKSGTLLQNYIKGLGICPSNKTVAVAVAATPLPEPKSSPSSSPETPGAKKPAKTDEIKLENILNSQDILLPSMEEYICSESLSCDDLLAPICDGFSVEMCDGLFDANEGGFQVCTVDDDDIDMNYIFNHIDHAIKVDPEIDMEMMMMMWDEDALECAEPAGPAAHVETVHVKEEMDLIEMVAATQNCGEAENH

SEQ ID NO: 19056 - DNA, 1170 bp, Sorghum bicolor
  misc_feature: Ceres ANNOT ID no. 8715723
  misc_feature: Encodes the peptide sequence at SEQ ID NO 19057
atggtcgctgctagccttctcaagtcctccttccttcccaagaagtccgaatggggcgccacccggcaagccgccgcctccccccggccggccaccgtctccgtcgtcgtccgcgcctccgcctacgccgatgagctcgtcaagaccgccaaaacgatcgcgtcgccggggcgaggcatcctggcgatggacgagtcgaacgcgacgtgcgggaagaggctggcgtcgatcgggctggagaacacggaggcgaacaggcaggcgtaccggacgctgctggtgacggcgccggggctgggccagtacatctccggcgccatcctgttcgaggagacgctgtaccagtccgccgtcgacggccggaagatcgtcgacatcctggtggagcaagggatcgtgcccgggatcaaggtcgacaagggcctcgtcccgctcgccggctccaacaacgagtcctggtgccagggcctcgacggcctcgcctctcgcgaggccgcctactaccagcagggcgcccggttcgccaagtggcgcaccgtcgtcagcatccctaatggcccctctgagctcgccgtcaaggaggccgcctggggcctcgctcgctacgccgccatctcacaggacaatgggctggtgccgatcgtggagccggagatcctcctcgacggcgagcacgggatcgagcggacgttcgaggtggcgcagaaggtgtgggcggagacgttctacgcgatggcggagaacaacgtgatgttcgagggcatcctactgaagccatccatggtgacgccgggggcggaggccaaggacagggcgacgccggagcaggtggcggagtacacgctgaagctcctgcaccgccggatcccgccgtccgtgccggggatcatgttcctctcgggaggccagtcggaggtggaggcgacgcagaacctcaacgccatgaaccagggcaccaacccgtggcacgtgtccttctcctacgcccgcgcgctgcagaacacctgcctcaagacctggggcggccagccggagaaggtgacggcggcgcaggacgcgctgctgctccgcgccaaggctaactccctggcgcagctcggcaagtacacctccgacggcgaggccgccgaggccaaggagggcatgttcgtcaagaactacagctactaa

SEQ ID NO: 19057 - protein, 389 aa, Sorghum bicolor
  misc_feature: Useful for making plants with modulated biomass
  misc_feature: Functional homolog of the protein sequence given in SEQ ID NO 13636
  misc_feature: Useful for making plants with modulated phosphate use efficiency
  misc_feature: Functional homolog of the protein sequence given in SEQ ID NO 12920
  misc_feature: Ceres ANNOT ID no. 8715723
  misc_feature (1)..(389): SWISSPROT Homolog: EC 4.1.2.13 Fructose-bisphosphate aldolase
  misc_feature (45)..(389): Pfam ID: Glycolytic Pfam Description: Fructose-bisphosphate aldolase class-I
MVAASLLKSSFLPKKSEWGATRQAAASPRPATVSVVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAEYTLKLLHRRIPPSVPGIMFLSGGQSEVEATQNLNAMNQGTNPWHVSFSYARALQNTCLKTWGGQPEKVTAAQDALLLRAKANSLAQLGKYTSDGEAAEAKEGMFVKNYSY

SEQ ID NO: 19058 - DNA, 1944 bp, Sorghum bicolor
  misc_feature: Ceres ANNOT ID no. 8715823
  misc_feature: Encodes the peptide sequence at SEQ ID NO 19059
atgggttcacgagtttcggggccccaccacatggatcctcctcctccgccgccgccgccgccgcagcagcagcaccctcctcatcctcagggtgagcgtcacggcggcggagagacgatgccgtaccaggacgcggaccataggctccgcgcgctggccgggcgcgcggagggcttcggccgccacgccatcggcggcctccacggatccatctaccgcgtcacgtcgctccaagacgacgggtgcgggagcctgagggaggcgtgccgcggggaggagccgcggtggatcgtcttcgaggtgtccggcaccatccacctccgcacctacctccgtgtctcctcgtacaagaccatcgacggccgcgggcagcgcgtggtgctcgccggcaaggggctccagctcaagtcctgccaccacgtcatcgtctgcaacctggtgttcgaaggaggacgcggccacgacgtcgacggcatccagatcaagcccgactccaccaacatctggatcgaccgctgcaccctcgccgactacgacgacggcctcatcgacatcacgcggcagagcaccgacatcacggtctcaagatgccacttcatgcggcacgacaagacgatgctgatcggcgccgacccgacgcacgtcggcgaccgctgcatcagggtgaccatccaccactgtttcttcgacggcacgcggcagaggcacccccgcctccgtttcggcaaggtgcacctctacaacaactacacgcggagctggggcatctacgcggtctgcgcaggcgtcgaggcccagatcgtgtcgcagtgcaacatctacgaggcgggtggagggcctccgaagaagacgactgtgttcaagtacatgccggagaaggccggcgaccgagaggatgtggtggcggggttggtcagctcggaaggggacgccttcctcaacggcgcgctgccctgcctgatcggtggccctggacctgtcttcaggccagaggattactaccagcagtggactatggagccagcgtcgccggcgctcaaggacataatacagctctgtgcaggatggcagccgttccatgtcaggagcgtcatggttgacccgacgttccgcgggacgccgtgttctgaagctgttggcgatgagagtggctcccagcatgaccgaccatatccaccaccatggccagaggccgaaggtggtggctgcatagtcctcgaagatctggctagcatcggtaggaaccagagctgtcgggcgaagaaggcttctcgcatgggtccccagagccgatgccaaaggatccccgagactgttgccgtcagagcggcaaaacagatccgggatagatgtctagctaacgctgagtggtgtacgaagtatcctagaactactgtttaccatcttcctatgcttcgcagtgaccatgctcctatcctcacgttgcttgattctaatcggcatatttatgttaaactcttccgttttgaaaatcggtggctgctcgaagaggattatgatactacggctaggattagtcggaacaagtcgattcatagacctttccaccaaaaaactaaataccttgctctagatcttaaaaagtggtgtaggaaaaaaccccgtttagacgatctcctctctaacattgaaagccagcttcttactgctcaaactcttcaccctactctccaagactataacttgcaggcacgtctctcccatcaacaccaacaccagcagctccttcacaaggatgagcagttccacctgcaaagagccaaaaaggattgggccaagcatggtgacagaaacactgctttttccatcaatctattatcaaaagatcaagaaagatcagaattactgttgatgcaaaagttgatctgcaaacacaaagggctaatacccggtttaaacgttaaggcgtgccagccgatttga

SEQ ID NO: 19059 - protein, 647 aa, Sorghum bicolor
  misc_feature: Useful for making plants with altered cell wall content and/or composition
  misc_feature: Functional homolog of the protein sequence given in SEQ ID NO 13741
  misc_feature: Useful for making plants with altered carbohydrate content
  misc_feature: Functional homolog of the protein sequence given in SEQ ID NO 13742
  misc_feature: Ceres ANNOT ID no. 8715823
  misc_feature (155)..(324): SWISSPROT Homolog: EC 4.2.2.2 Pectate lyase
  misc_feature (108)..(274): Pfam ID: Pec_lyase_C Pfam Description: Pectate lyase
MGSRVSGPHHMDPPPPPPPPPQQQHPPHPQGERHGGGETMPYQDADHRLRALAGRAEGFGRHAIGGLHGSIYRVTSLQDDGCGSLREACRGEEPRWIVFEVSGTIHLRTYLRVSSYKTIDGRGQRVVLAGKGLQLKSCHHVIVCNLVFEGGRGHDVDGIQIKPDSTNIWIDRCTLADYDDGLIDITRQSTDITVSRCHFMRHDKTMLIGADPTHVGDRCIRVTIHHCFFDGTRQRHPRLRFGKVHLYNNYTRSWGIYAVCAGVEAQIVSQCNIYEAGGGPPKKTTVFKYMPEKAGDREDVVAGLVSSEGDAFLNGALPCLIGGPGPVFRPEDYYQQWTMEPASPALKDIIQLCAGWQPFHVRSVMVDPTFRGTPCSEAVGDESGSQHDRPYPPPWPEAEGGGCIVLEDLASIGRNQSCRAKKASRMGPQSRCQRIPETVAVRAAKQIRDRCLANAEWCTKYPRTTVYHLPMLRSDHAPILTLLDSNRHIYVKLFRFENRWLLEEDYDTTARISRNKSIHRPFHQKTKYLALDLKKWCRKKPRLDDLLSNIESQLLTAQTLHPTLQDYNLQARLSHQHQHQQLLHKDEQFHLQRAKKDWAKHGDRNTAFSINLLSKDQERSELLLMQKLICKHKGLIPGLNVKACQPI

SEQ ID NO: 19060 - DNA, 552 bp, Sorghum bicolor
  misc_feature: Ceres ANNOT ID no. 8715950
  misc_feature: Encodes the peptide sequence at SEQ ID NO 19061
atggccctggagacgtgcttcagagcgtgggcgctgcacgccgcccctgccgctggtggcaaggacagcaggctcctcgtcgtcggcagcagcagcggcagcggcagtaacctggttctgccgtcgaagcgggccgccgccgccgcggtcgtcgcgccgctgtccgtcggccgcgtcgccacgcgccggccgcggcatgtctgccagtccaagaacgccgtcgacgaagtgctggtggcggacgagaagaattgggacgggatggtgatggcgtgcgagacgccggtgctggtggagttctgggcgccgtggtgcgggccgtgcaggatgatcgcgccggtgatcgacgagctggccaaggactacgccggcaagatcacgtgctgcaaggtgaacacggacgagagccccaacgtggcgtccacctacggcatccgcagcatccccaccgtgctcatcttcaaggccggcgagaagaaggagagcgtcatcggcgccgtcccaaagtccacgctcaccacactcatcgacaagtacatcggcacctcatga

SEQ ID NO: 19061 - protein, 183 aa, Sorghum bicolor
  misc_feature: Useful for making plants with modulated heat sensitivity
  misc_feature: Functional homolog of the protein sequence given in SEQ ID NO 14555
  misc_feature: Ceres ANNOT ID no. 8715950
  misc_feature (76)..(178): SWISSPROT Homolog: EC 1.8.1.8 Protein-disulfide reductase
  misc_feature (76)..(179): Pfam ID: Thioredoxin Pfam Description: Thioredoxin
MALETCFRAWALHAAPAAGGKDSRLLVVGSSSGSGSNLVLPSKRAAAAAVVAPLSVGRVATRRPRHVCQSKNAVDEVLVADEKNWDGMVMACETPVLVEFWAPWCGPCRMIAPVIDELAKDYAGKITCCKVNTDESPNVASTYGIRSIPTVLIFKAGEKKESVIGAVPKSTLTTLIDKYIGTS

SEQ ID NO: 19062 - DNA, 1308 bp, Sorghum bicolor
  misc_feature: Ceres ANNOT ID no. 8716004
  misc_feature: Encodes the peptide sequence at SEQ ID NO 19063
atggagatgaagctcaccatcaagagggtgcccaccgtcgtctccaactaccaggacgacgccgacaagccgcgcgccggctgcgggaggaactgcctcggcgactgctgcctgcctgcttccaagcttcccctctacgcgttcaagttgaatccggcaaagcgctcgcaggagggtgctgcttcaaccaagctgcttgttgatatcctccttagcgagtgggaagacaggatggcccgaggcttattccgctatgatgtcactgcctgtgagaccaaggtcatccctggcaaccttgggtttgttgcacaactcaatgaagggcgccaccttaagaagcgccctactgagtttcgtgtggaccgtgtgctccagccatttgaccctgccaagttcaatttcaccaaagttggccaggaagaggttctcttccaatttgagaatggtgatggtgatgacagctatttcctgaatgacgctccaatcattgctgttgatcgtgctccaaatgttgttgctatcaatgtgagcccaattgaatatggacatgtgcttctcattcctcgtgttctggaccgcctgcctcagaagattgatccagagagcttcttgcttgcactgcaaatggcagctgaggcagctagcccttacttcaggcttggttacaatagcttgggtgcctttgccaccatcaatcacctccactttcaggcatactacttgtcagtgcctttccctgtcgagaaggcagctaccctcaagatccctctttctgaggacacaatgaagaatggagtgaccgtgtccaagctgataaattatcctgtgagaggcctggtatttgagggagggaacacactggaggacctggcaaatgtggtttccaatgcttgcatttggctgcaggacaacaatgtgccttacaacgtgctcatttctgactgtggaaagagggtcttcctgttcccccagtgttatgcagagaagcaggctctgggtgaagtgagccaggagctgctggacactcaggtgaacccagccgtgtgggagataagtggccacatcgtgctgaagcggaggagcgactatgaggaggcatctgaaacctctgcgtggaagctcctcgctgaggtctccctctctgaggagcgcttcgaggaagtgaaggcgtacatcttcagcgctgctggcctggttctgtctgacgaggaagaggaggaagccagtgagggcaagggcaccaccacctttgctcctgtcccagtttccccaatgcctgtcgctgaaggctgcctcgtccaccagtga

SEQ ID NO: 19063 - protein, 435 aa, Sorghum bicolor
  misc_feature: Useful for making plants with modulated nitrogen use efficiency
  misc_feature: Functional homolog of the protein sequence given in SEQ ID NO 14686
  misc_feature: Ceres ANNOT ID no. 8716004
MEMKLTIKRVPTVVSNYQDDADKPRAGCGRNCLGDCCLPASKLPLYAFKLNPAKRSQEGAASTKLLVDILLSEWEDRMARGLFRYDVTACETKVIPGNLGFVAQLNEGRHLKKRPTEFRVDRVLQPFDPAKFNFTKVGQEEVLFQFENGDGDDSYFLNDAPIIAVDRAPNVVAINVSPIEYGHVLLIPRVLDRLPQKIDPESFLLALQMAAEAASPYFRLGYNSLGAFATINHLHFQAYYLSVPFPVEKAATLKIPLSEDTMKNGVTVSKLINYPVRGLVFEGGNTLEDLANVVSNACIWLQDNNVPYNVLISDCGKRVFLFPQCYAEKQALGEVSQELLDTQVNPAVWEISGHIVLKRRSDYEEASETSAWKLLAEVSLSEERFEEVKAYIFSAAGLVLSDEEEEEASEGKGTTTFAPVPVSPMPVAEGCLVHQ

SEQ ID NO: 19064 - DNA, 291 bp, Sorghum bicolor
  misc_feature: Ceres ANNOT ID no. 8716213
  misc_feature: Encodes the peptide sequence at SEQ ID NO 19065
atggggaggggaaggattgagaacaagagggtcgtcgagaacaacacgagctggccgatcaccttctgcatgcgccgcaacgggctcctcaagaaggcatatgatgagctcttcgctgtcctctgctacgccgtggtggcgctcatcgtcgtcttctccagccgccgcgtccgcctgtacgaacgagtacgccagcaggtgcggccacctttcttgcatgcatattgcatgcgtgctgtgtcatcattaatatttcatttcatgtttaaacgatctacttgcaattgttaa

SEQ ID NO: 19065 - protein, 96 aa, Sorghum bicolor
  misc_feature: Useful for biocontainment applications
  misc_feature: Functional homolog of the protein sequence given in SEQ ID NO 13753
  misc_feature: Useful for making plants with altered alkaloid content
  misc_feature: Useful for making plants with altered lignin content
  misc_feature: Useful for making plants with modulated biomass
  misc_feature: Useful for making plants with modulated flowering time
  misc_feature: Functional homolog of the protein sequence given in SEQ ID NO 13528
  misc_feature: Useful for making plants with altered terpenoid content
  misc_feature: Functional homolog of the protein sequence given in SEQ ID NO 13438
  misc_feature: The sequence is a functional homolog of SEQ ID NO 32 in the 10/666,642 US patent application
  misc_feature: The sequence is a functional homolog of SEQ ID NO 14 in the 10/666,642 US patent application
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 707 in the 10/666,642 US patent application
  misc_feature: The sequence is a functional homolog of SEQ ID NO 4 in US patent 7057087
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 30 in the 10/666,642 US patent application
  misc_feature: The sequence is a functional homolog of SEQ ID NO 28 in the 10/666,642 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 46 in the 10/666,642 US patent application
  misc_feature: The sequence is a functional homolog of SEQ ID NO 1243 in the 11/479,226 US patent application
  misc_feature: The sequence is a functional homolog of SEQ ID NO 1420 in the 10/666,642 US patent application
  misc_feature: The sequence is a functional homolog of SEQ ID NO 1814 in the 10/412,699 US patent application
  misc_feature: The sequence is a functional homolog of SEQ ID NO 570 in the 10/412,699 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 730 in the 10/666,642 US patent application
  misc_feature: The sequence is a functional homolog of SEQ ID NO 729 in the 10/666,642 US patent application
  misc_feature: The sequence is a functional homolog of SEQ ID NO 731 in the 10/666,642 US patent application
  misc_feature: The sequence is a functional homolog of SEQ ID NO 2191 in the 10/666,642 US patent application
  misc_feature: The sequence is a functional homolog of SEQ ID NO 42 in the 10/666,642 US patent application
  misc_feature: The sequence is a functional homolog of SEQ ID NO 2193 in the 10/666,642 US patent application
  misc_feature: The sequence is a functional homolog of SEQ ID NO 919 in the 10/666,642 US patent application
  misc_feature: The sequence is a functional homolog of SEQ ID NO 1454 in the 10/374,780 US patent application
  misc_feature: The sequence is a functional homolog of SEQ ID NO 1453 in the 10/374,780 US patent application
  misc_feature: Ceres ANNOT ID no. 8716213
  misc_feature (10)..(62): Pfam ID: SRF-TF Pfam Description: SRF-type transcription factor (DNA-binding and dimerisation domain)
MGRGRIENKRVVENNTSWPITFCMRRNGLLKKAYDELFAVLCYAVVALIVVFSSRRVRLYERVRQQVRPPFLHAYCMRAVSSLIFHFMFKRSTCNC

SEQ ID NO: 19066 - DNA, 345 bp, Sorghum bicolor
  misc_feature: Ceres ANNOT ID no. 8716214
  misc_feature: Encodes the peptide sequence at SEQ ID NO 19067
atgacgatacagctagctgatcgagatcgatcttattggaggaaagaacttcccttttctgtgcttcgagttggtgcaagttgcgactttggttctccagcatgcatcgggaggggaaggattgagaattacaagaggatcgagaacaacacgagccggcagcaggtcaccttctgcaagcgccgcaaccggctcctcaagaagacgtatgagctctgcgctgtcgtcctcgatctgctacgccgtggtggcgctcatcgtcgtcttctccagccgtggccgcctgtacgaacgagtacgccaacagcaggtgcggccgcgcctttctttggtagcctctggtga

SEQ ID NO: 19067 - protein, 114 aa, Sorghum bicolor
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: Ceres ANNOT ID no. 8716214
  misc_feature (45)..(95): Pfam ID: SRF-TF Pfam Description: SRF-type transcription factor (DNA-binding and dimerisation domain)
MTIQLADRDRSYWRKELPFSVLRVGASCDFGSPACIGRGRIENYKRIENNTSRQQVTFCKRRNRLLKKTYELCAVVLDLLRRGGAHRRLLQPWPPVRTSTPTAGAAAPFFGSLW

SEQ ID NO: 19068 - DNA, 2202 bp, Sorghum bicolor
  misc_feature: Ceres ANNOT ID no. 8716371
  misc_feature: Encodes the peptide sequence at SEQ ID NO 19069
atggggaaggggaggactgagaacaacacgaaccggcaggtcaccttctgcaacggcctccacatcaagaaggcgtatgagttctctgctgctgtcctctgcaacgctgtggtggcgctgatcaccgtcgtcttctccagacgcggtcgcctccatgagtgcgccaacaacagggcccacaacatgtccagccccggccgcctcgacaaccacgagtgcaccagcaacagtgataagaaaatggtgaagttgctgattgtgactgctatcttcctggggacacacctggcaccagtaaactcctccagtagaactagtgcgtactgggagttctactgcgcaggggggaatttcacccctagcagcacatactccaggtcattggacaagatagcagcagagctgccgaagaaggtggcctcctcccctttgttgtttgctggttcacaaatcggtgacgttcatgcacttgcacaatgccgccaggattttaccgcctcagcatgcaaaatgtgcattgctggaggtctcagggatgcagtaaaggttctttgtgagtccagaaaaggggcagtggtttttcttgaaatttgtaccgtggcatattctcatcaggagttgttgcaatatccgactggcaatgagttggacataacagcctctaagagagatttcctgccaatcattcttgaaactgaacccttcaacacctcagttcgggagctggcaagagctgtggcacgaatggcagctacgtctcctgctcattttggaacaggagagaaaaaggtggttcaagcacagtatagactgacaatttacgcactgggtcagtgcatgcccaatttgtcagacaaagactgtgaaatatgcctcacagatttagtttacgcaatagatattggtgtagacatgacaacagggagagtcgcaaaggtttggtgcagctaccggttctcgctatacaagttttttcggggtaaaccggcactagtcattccagcagaggggttgccacaaaagggagggaagaggcaccataatgacgacaaaacaacaatcgcatgggctttagttgttgtgttgttcaccttgttgctactatcagtagtagcagggcttgtctactggtggaggaatcggaaccaacagaagaagtccttgggtaaagaagttcagtgcatagggaaagaagtccagtgcacagggaaagcggtagaggtttctttaaattttggggtaaggcccaaggccgagttgccctatgcaagcaagcagccttacaaggctacagagatctggcctggggaagaaatagatggtattaggcccaagcccaacacagatgccatgcccattcccaaagagtgggggtgcttgttaatgtttttgtgggccggttggcaggaaagggttgtaccttgcccgtcggctttagaagcctttgaagaaataattggtctagccaataataatgaaatcgcagttttccttgactatgacggaaccctctctccaattgttaatgatcccgaaaaggcctatatgtcctccgagatgcgccaagttttaaaagctattgcagaaaactttaaaacgtcgattgtcagtgggcgcgcacgcgaaaaagtttttgagtttgtgcaaattgatactatcaactacgcaggcagccacggcacggacatcaagatggcttctaccacatggggcgagataactgaagaacatgattcgtaccagcctgcaaagaagtttgcaacggtgatgaatcaggtttataattctctggttcgtgaaactggacatataaatggtgcaaaggtagagaacaacacttactgtgtaagtgttcactaccggaatgtagccaaagaggaccagctccgtgttctacatgtcgtgcaggaagtcctgaaaaaccttaacagcggtcttgacctaacttacgggcatatggtatatgagattcgtccaccactggcttttaacaagggaaatgctgtagcttatattcttgataagcttgggctagatttttctatatacattggggatgacttgaccgacgaggacgctttcaaggttattcgtgatagaaaaaagggtatcagaattctcgtctccaataccagcagggaaactagcgcgttctactcgctaaaagatccaccacaggttcagcctgagaatatcaggtga

SEQ ID NO: 19069 - protein, 733 aa, Sorghum bicolor
  misc_feature: The sequence is a functional homolog of SEQ ID NO 16 in US patent 7214858
  misc_feature: Ceres ANNOT ID no. 8716371
  misc_feature (498)..(727): SWISSPROT Homolog: EC 3.1.3.12 Trehalose-phosphatase
  misc_feature (497)..(725): Pfam ID: Trehalose_PPase Pfam Description: Trehalose-phosphatase
  misc_feature (4)..(56): Pfam ID: SRF-TF Pfam Description: SRF-type transcription factor (DNA-binding and dimerisation domain)
MGKGRTENNTNRQVTFCNGLHIKKAYEFSAAVLCNAVVALITVVFSRRGRLHECANNRAHNMSSPGRLDNHECTSNSDKKMVKLLIVTAIFLGTHLAPVNSSSRTSAYWEFYCAGGNFTPSSTYSRSLDKIAAELPKKVASSPLLFAGSQIGDVHALAQCRQDFTASACKMCIAGGLRDAVKVLCESRKGAVVFLEICTVAYSHQELLQYPTGNELDITASKRDFLPIILETEPFNTSVRELARAVARMAATSPAHFGTGEKKVVQAQYRLTIYALGQCMPNLSDKDCEICLTDLVYAIDIGVDMTTGRVAKVWCSYRFSLYKFFRGKPALVIPAEGLPQKGGKRHHNDDKTTIAWALVVVLFTLLLLSVVAGLVYWWRNRNQQKKSLGKEVQCIGKEVQCTGKAVEVSLNFGVRPKAELPYASKQPYKATEIWPGEEIDGIRPKPNTDAMPIPKEWGCLLMFLWAGWQERVVPCPSALEAFEEIIGLANNNEIAVFLDYDGTLSPIVNDPEKAYMSSEMRQVLKAIAENFKTSIVSGRAREKVFEFVQIDTINYAGSHGTDIKMASTTWGEITEEHDSYQPAKKFATVMNQVYNSLVRETGHINGAKVENNTYCVSVHYRNVAKEDQLRVLHVVQEVLKNLNSGLDLTYGHMVYEIRPPLAFNKGNAVAYILDKLGLDFSIYIGDDLTDEDAFKVIRDRKKGIRILVSNTSRETSAFYSLKDPPQVQPENIR

SEQ ID NO: 19070 - DNA, 516 bp, Sorghum bicolor
  misc_feature: Ceres ANNOT ID no. 8716516
  misc_feature: Encodes the peptide sequence at SEQ ID NO 19071
atggtcagagggaaggtgcaaatgcgacaaattgagaaccctgtccacagaagggtaaccttctccaagcgccgggaaggactgctcaagaaggcaagagaactctcagtgctttgtggtgctgatgtaggtgtaatcatattttcctccactgggaaagtccatgaactagcgactaacgggtgccatggtttaagatccactggagggggagcagaggacatgagactggatagactgcacgcgctcgagaaaggtcttgaactctggtattaccagacacgctccgcaaagatcatgcagcaagaaattcactttcttagaaataaggaaaacatacttaaatcagaaaatgaaattcttcaacagaaggaaggcatcctgaaagcagaaaacaaagttctccaacagaaggtgaatgagcagaatgaatttataaacaactgcttggcgttttctggatcttcgtatccgatgcattacaacataaatgagagtagcttgttcaagatatag

SEQ ID NO: 19071 - protein, 171 aa, Sorghum bicolor
  misc_feature: Useful for making plants with modulated flowering time
  misc_feature: Functional homolog of the protein sequence given in SEQ ID NO 13660
  misc_feature: Ceres ANNOT ID no. 8716516
  misc_feature (9)..(59): Pfam ID: SRF-TF Pfam Description: SRF-type transcription factor (DNA-binding and dimerisation domain)
MVRGKVQMRQIENPVHRRVTFSKRREGLLKKARELSVLCGADVGVIIFSSTGKVHELATNGCHGLRSTGGGAEDMRLDRLHALEKGLELWYYQTRSAKIMQQEIHFLRNKENILKSENEILQQKEGILKAENKVLQQKVNEQNEFINNCLAFSGSSYPMHYNINESSLFKI

SEQ ID NO: 19072 - DNA, 810 bp, Sorghum bicolor
  misc_feature: Ceres ANNOT ID no. 8716561
  misc_feature: Encodes the peptide sequence at SEQ ID NO 19073
atggggcggggaaggattgagatcaagaggatcgagaacaacacgagccggcaggtcaccttctgcaagcgccgcaacgggctcctcaagaaggcgtacgagctctccgtcctgtgcgacgccgaggtggccctcatcgtcttctccagccgcggccgcctctacgagtacgccaacaacagcgtgaaggctacgattgagaggtacaagaaggtacacaccgttgggtcttcctctgggcccccactcttagagcacaatgcccagcaattctaccagcaagaatccgcaaaactgcgcaaccagattcagatgctgcaaaacactaacaggcacttggtcggtgattctgtgggaaacctgacactcaaggagctgaagcagctggagagccgccttgagaaaggcatctctaaggtcagggccaggaagaatgagctgctggctgcggagatcaattacatggccaaaagggagactgaacttcagaatgaccacatgaacctcaggaccaagattgaggagggagagcaacagctgcagcaggtgaccgtggcccggtctgtcgcagcagcagcagcagccaccaacgtggagctgaacccattcttggagatggataccaaatgcttcttccctggcggccccttcgcgacgctggacatgaagtgcttcttccctggcggctatcagatgctggaagcgacggcggcacagcaccgccagatgctcaccactgagctaaacctcggctaccaactggcgctgcctaactctgacgctgccaacaataaccctcatcagttctaa

SEQ ID NO: 19073 - protein, 269 aa, Sorghum bicolor
  misc_feature: Useful for biocontainment applications
  misc_feature: Functional homolog of the protein sequence given in SEQ ID NO 13753
  misc_feature: The sequence is a functional homolog of SEQ ID NO 32 in the 10/666,642 US patent application
  misc_feature: Useful for making plants with altered terpenoid content
  misc_feature: Useful for making plants with modulated flowering time
  misc_feature: Functional homolog of the protein sequence given in SEQ ID NO 13438
  misc_feature: The sequence is a functional homolog of SEQ ID NO 14 in the 10/666,642 US patent application
  misc_feature: Useful for making plants with altered alkaloid content
  misc_feature: Useful for making plants with altered lignin content
  misc_feature: Useful for making plants with modulated biomass
  misc_feature: Functional homolog of the protein sequence given in SEQ ID NO 13528
  misc_feature: The sequence is a functional homolog of SEQ ID NO 1701 in the 10/412,699 US patent application
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: The sequence is a functional homolog of SEQ ID NO 1949 in the 10/412,699 US patent application
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 1955 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8716561
  misc_feature (75)..(175): Pfam ID: K-box Pfam Description: K-box region
  misc_feature (9)..(59): Pfam ID: SRF-TF Pfam Description: SRF-type transcription factor (DNA-binding and dimerisation domain)
MGRGRIEIKRIENNTSRQVTFCKRRNGLLKKAYELSVLCDAEVALIVFSSRGRLYEYANNSVKATIERYKKVHTVGSSSGPPLLEHNAQQFYQQESAKLRNQIQMLQNTNRHLVGDSVGNLTLKELKQLESRLEKGISKVRARKNELLAAEINYMAKRETELQNDHMNLRTKIEEGEQQLQQVTVARSVAAAAAATNVELNPFLEMDTKCFFPGGPFATLDMKCFFPGGYQMLEATAAQHRQMLTTELNLGYQLALPNSDAANNNPHQF

SEQ ID NO: 19074 - DNA, 987 bp, Sorghum bicolor
  misc_feature: Ceres ANNOT ID no. 8716574
  misc_feature: Encodes the peptide sequence at SEQ ID NO 19075
atggatctttccgggacgcagggcgagctgccgatggcaatgcatgccggcggcggcggcggaggctcgccgtacctggggctgcaccacgggcaccacgagcagcagcataaccatggcgcgaacggccggcacatgtcgccgccggacgtggtggcggaggaggccaagaaccggcagctggcggtggtgcccgtgagcggcgcaggaggaggcgggggagcaggggtgaggtaccgcgagtgcctgaagaaccacgcggcggccatcggcgggagcgcgacggacgggtgcggcgagttcatgcccgcgggcgaggaagggtcgctggacgcgctccggtgctcggcgtgcgggtgccaccgcaacttccaccgcaaggagccgccgggtgggggcggaggcggcgacgcgcggcagctgcacgggcacgggcaccaccaccaccaccaccatccactgagcccgctgagcccgctggccgcggcgcaccaccaccgggggctgctggtggcggcgctgcccccggcgccgacgcgcatggtgatgccgctgagcgccatgcaccatcagcagcagcaccacaacagctcggcgtccgcggagtccgacgacgcgcacaacgcgccgggacatgcgcacgggcagcagcagggcccgccggcccggaagcggttccggaccaagttcacggcggagcagaaggcccgcatgctgggtttcgcggaggaggccgggtggcggctgcagaagctggacgacgcggcggtgcagcgcttctgccaggaggtgggcgtgaagcggcgcgtgctcaaggtgtggatgcacaacaacaagcacaccctggcgcggcgcggccacgacggcgttggcgacccgcagcagcaggggccgcacggcggccagctcggcatgccgctcccggagcccggcgggcccggacggagccccagccggagcccgccgccgcagctgcggctggagtga

SEQ ID NO: 19075 - protein, 328 aa, Sorghum bicolor
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13913
  misc_feature: Useful for making plants with modulated low light sensitivity
  misc_feature: Functional homolog of the protein sequence given in SEQ ID NO 13756
  misc_feature: Ceres ANNOT ID no. 8716574
  misc_feature (74)..(133): Pfam ID: ZF-HD_dimer Pfam Description: ZF-HD protein dimerisation region
MDLSGTQGELPMAMHAGGGGGGSPYLGLHHGHHEQQHNHGANGRHMSPPDVVAEEAKNRQLAVVPVSGAGGGGGAGVRYRECLKNHAAAIGGSATDGCGEFMPAGEEGSLDALRCSACGCHRNFHRKEPPGGGGGGDARQLHGHGHHHHHHHPLSPLSPLAAAHHHRGLLVAALPPAPTRMVMPLSAMHHQQQHHNSSASAESDDAHNAPGHAHGQQQGPPARKRFRTKFTAEQKARMLGFAEEAGWRLQKLDDAAVQRFCQEVGVKRRVLKVWMHNNKHTLARRGHDGVGDPQQQGPHGGQLGMPLPEPGGPGRSPSRSPPPQLRLE

SEQ ID NO: 19076 - DNA, 600 bp, Sorghum bicolor
  misc_feature: Ceres ANNOT ID no. 8716682
  misc_feature: Encodes the peptide sequence at SEQ ID NO 19077
atggcggcttcgaagcccatcctgtacagcgcgtggatcagctcctgctccttccgagtccggatcgccctcaacctcaaaggtgtggattatgagtacagggctgtgacacggacggatctagattatgaaaagatcaatccaatcaagtatgttccagcattggttgatggggattttgttgtttctgactcccttgcaatcatactgtatcttgaagacaaatatcctcaacaccctcttttgcctcaagatctcaaaaagaaagctattaatcttcagattgcaaatatgggtctgcttgatggcaagttaggttcagatgagagccttcagattgttaggaattacaccgacaagggatttaaagcaatcgaaaaacttctggaaggttgtgacagtaaatatgctactggagacgaagtccaactggcagatgtgtttcttgcaccccagatccatgcaggcgtgacgcgcttcaaaattgatatgtcaaactaccctcttttggagaggttctacaaagcctatatggagatcccagcatttcaagtagcggctcctgaaaaacagccagatgcgcctgcgtctccatactga

SEQ ID NO: 19077 - protein, 199 aa, Sorghum bicolor
  misc_feature: Useful for biocontainment applications
  misc_feature: Functional homolog of the protein sequence given in SEQ ID NO 12971
  misc_feature: Ceres ANNOT ID no. 8716682
  misc_feature (1)..(197): SWISSPROT Homolog: EC 2.5.1.18 Glutathione transferase
  misc_feature (4)..(74): Pfam ID: GST_N Pfam Description: Glutathione S-transferase, N-terminal domain
  misc_feature (90)..(181): Pfam ID: GST_C Pfam Description: Glutathione S-transferase, C-terminal domain
MAASKPILYSAWISSCSFRVRIALNLKGVDYEYRAVTRTDLDYEKINPIKYVPALVDGDFVVSDSLAIILYLEDKYPQHPLLPQDLKKKAINLQIANMGLLDGKLGSDESLQIVRNYTDKGFKAIEKLLEGCDSKYATGDEVQLADVFLAPQIHAGVTRFKIDMSNYPLLERFYKAYMEIPAFQVAAPEKQPDAPASPY

SEQ ID NO: 19078 - DNA, 993 bp, Sorghum bicolor
  misc_feature: Ceres ANNOT ID no. 8716974
  misc_feature: Encodes the peptide sequence at SEQ ID NO 19079
atggcgccgccgctgccgccggtgtcgtcggaaccggacgagggggagctggtgaccaacaggcgtgtgatcctgaagcgctaccccgtgccgcccgggtcgacggccatcgtggtcaagaacctctacctctcgagcgacccctacatgcgcacccgcatgtcgaggcacgaccagccaagcttcatcccggattttgtcccaggggaggttctggataactgggctgtgagcaaggtggtggtctctgggcacccggatttcaagcccggcgatcttttgtgtcttgtgactgggtgggaagagtacagcttgatcaacaacacaacactctgtcgtaagattaagcactccgagtttccaccctcctattacaccggtgttcttggggtgccggggattaccgcacatgctgggctttttgaagtggccaaggctaagaaagacgagtatgtcttcgtctcagcggcatcaggcgccgttggtcagatcgttgggcagcttgctaagctcacaggctgctacgttgtcggcagtgctggctctgatcacaaggtcaatctgttgaagacaaagtttggcttcgacgacgctttcaattataagaaggagctggacctcgacgctgccttgcagaggtgcttccctgagggcatcgacgtgtatttcgagaacgtgggcggcgcaatgctggaggcggtgctgcgcaacatgcggccgtatggccggatcgccgtgtgcgggcaggtgtcgcagtacaacctccggcggccggacgtctcgccggacctcttcctgctcgtcgggaagcgcctccgcatggaagggttcctagtgggcgacgtggaggagatggtggcctacctcaacgaagggaaggtggtctacgtggaggacgtcgccgaggggatcgaggcggcgccggcagcactagtcggcctcttctccggccgcaacgtcggcaagcaggtggttgccctcgcgcgggagtga

SEQ ID NO: 19079 - protein, 330 aa, Sorghum bicolor
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: Ceres ANNOT ID no. 8716974
  misc_feature (30)..(248): SWISSPROT Homolog: EC 1.6.5.5 NADPH:quinone reductase
  misc_feature (148)..(291): Pfam ID: ADH_zinc_N Pfam Description: Zinc-binding dehydrogenase
MAPPLPPVSSEPDEGELVTNRRVILKRYPVPPGSTAIVVKNLYLSSDPYMRTRMSRHDQPSFIPDFVPGEVLDNWAVSKVVVSGHPDFKPGDLLCLVTGWEEYSLINNTTLCRKIKHSEFPPSYYTGVLGVPGITAHAGLFEVAKAKKDEYVFVSAASGAVGQIVGQLAKLTGCYVVGSAGSDHKVNLLKTKFGFDDAFNYKKELDLDAALQRCFPEGIDVYFENVGGAMLEAVLRNMRPYGRIAVCGQVSQYNLRRPDVSPDLFLLVGKRLRMEGFLVGDVEEMVAYLNEGKVVYVEDVAEGIEAAPAALVGLFSGRNVGKQVVALARE

SEQ ID NO: 19080 - DNA, 1062 bp, Sorghum bicolor
  misc_feature: Ceres ANNOT ID no. 8717010
  misc_feature: Encodes the peptide sequence at SEQ ID NO 19081
atggcggcggcggcggcgtcgtcggccgacgggcaggaggtgcccaacaagcgggtgatcctgaagcgctacgtgtcggggttccccagcgaggacgacatggaggtggtcaccgggacggcgcgcctcgccgtgccgccggggacggcggccatggtggtcaagaacctctacgtctcgtgcgacccttacatgcgcggccgcatgaccaagcacgacaggcccagctacgtcccggacttcgtcgtcggagaggctttggtaaactttggtgtatgcaaggtgatagcatctgggcatccggatttcaaggttggtgatcttgtctgggggatgaccggatgggaggagtacactttcgtcccgaagccagagtcgtttttcaagatcaatcaccctgaactgcctctgtcgtactacacaggtgttcttggcatgcccggccttacagcttgggctggattcttcgatgtgggcaagcccaagaatggcgactatgtcttcgtctcagcagcatcaggcgccgttggtcagcttgttggtcagtttgctaagctcacaggctgttatgttgtcggcagtgctggttcagacgagaaggtgagtcttctgaaatccaagtttggctttgatgaagcattcaactacaagaaagagcaggacctcgatgccgcgttgaggaggtacttcccagagggcattgacatctacttcgagaacgtgggcggccgcacgctggaagccgtgctgtccaacatgcgcaaccatgggcggatcccgacctgcgggatgatctcgcagtacaacctggaggagccagagggcgtgcacaacctgttccagatcgtcgctaagcgcctgcgcatggagggcttcatagtcatggactactacggccagtaccacaagttcgagcaggagatggccgggtacctcaaggagggaaagataacctatgttgaggacattgctgatgggctagagaaggctccggcggcgctcatcgggctcttcaccggccgcaacgtcggcaagcaactggtcgccgtcgctcgggagtga

SEQ ID NO: 19081 - protein, 353 aa, Sorghum bicolor
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: Ceres ANNOT ID no. 8717010
  misc_feature (35)..(263): SWISSPROT Homolog: EC 1.6.5.5 NADPH:quinone reductase
  misc_feature (163)..(310): Pfam ID: ADH_zinc_N Pfam Description: Zinc-binding dehydrogenase
MAAAAASSADGQEVPNKRVILKRYVSGFPSEDDMEVVTGTARLAVPPGTAAMVVKNLYVSCDPYMRGRMTKHDRPSYVPDFVVGEALVNFGVCKVIASGHPDFKVGDLVWGMTGWEEYTFVPKPESFFKINHPELPLSYYTGVLGMPGLTAWAGFFDVGKPKNGDYVFVSAASGAVGQLVGQFAKLTGCYVVGSAGSDEKVSLLKSKFGFDEAFNYKKEQDLDAALRRYFPEGIDIYFENVGGRTLEAVLSNMRNHGRIPTCGMISQYNLEEPEGVHNLFQIVAKRLRMEGFIVMDYYGQYHKFEQEMAGYLKEGKITYVEDIADGLEKAPAALIGLFTGRNVGKQLVAVARE

SEQ ID NO: 19082 - DNA, 528 bp, Sorghum bicolor
  misc_feature: Ceres ANNOT ID no. 8717077
  misc_feature: Encodes the peptide sequence at SEQ ID NO 19083
atggagatggagtcgacgactcttcctctgctgacaccgtacaagatgggcgagttcaacctggcacacagggttgtgctggcgccgctgacgaggtgccgggcgtacgggaacgtgccgcagccggagcacatggccgtctactactgccagcgcgcgacgccgggcgggctcctcatcgccgaggcctgcgccgtgtcggagagcgcgcgcgggtacccggacgttccggggctgtggaccgaccaacaggtggaggcctggaagcccatcgtcgacgccgtccacgccagcggcgccgtcttcttcgcccagatctggcacaccggacgagcctccgccccagaattccaaccaaatgggcaggcaccgatctcaagcacggacaagcaaatcccaccgcaggtgagccatgccggcgtcgtcaacaccttcgcggtgcctcgaagaccggaaacagaggagataccacacgtcgtcaacgacttccggattgccgccagaaacgccatcaaagctgatacatga

SEQ ID NO: 19083 - protein, 175 aa, Sorghum bicolor
  misc_feature: Useful for making plants with modulated water use efficiency
  misc_feature: Functional homolog of the protein sequence given in SEQ ID NO 13609
  misc_feature: Ceres ANNOT ID no. 8717077
  misc_feature (7)..(173): SWISSPROT Homolog: EC 1.3.1.42 12-oxophytodienoate reductase
  misc_feature (9)..(175): Pfam ID: Oxidored_FMN Pfam Description: NADH:flavin oxidoreductase / NADH oxidase family
MEMESTTLPLLTPYKMGEFNLAHRVVLAPLTRCRAYGNVPQPEHMAVYYCQRATPGGLLIAEACAVSESARGYPDVPGLWTDQQVEAWKPIVDAVHASGAVFFAQIWHTGRASAPEFQPNGQAPISSTDKQIPPQVSHAGVVNTFAVPRRPETEEIPHVVNDFRIAARNAIKADT

SEQ ID NO: 19084 - DNA, 774 bp, Sorghum bicolor
  misc_feature: Ceres ANNOT ID no. 8717082
  misc_feature: Encodes the peptide sequence at SEQ ID NO 19085
atggcggctggtggtggggatgtgggggcagcggcggttggagaagtggagcgaggcggcgaggatcgacgagaccgtgataccacgttgtcaaagacgttaaaccctcgggttacatataaaatttatggatctacaaaagtcaaaacaatttataacttgaaaccgttaggctttgacggagtggagatccacgcggcaaacgggtacctgttcgaccagttcatgaaggacagcaccaatgaccgtgacgatgcctacgggggcagcctggagaaccgatgccgtttcaccgccgaggtgacggcagctgtggcggctgaggtcggcggtgaccggctgggcgtgcgcctctctccgttcgccgactacatggactgccatgactctgatccagaggcgcttgggcttcatgtcatcgacaagacgctgaacccgctcggcgtgctctactgccacatggtagaggcaaggatgcgggtgaacccagaggacggcaacaaaatgaccctccagcagatgctactgccgttcaggagggcgtttcgggtgacgttcatagctagcggaggatacgaccgtgaggaaggcaacgccgccatcgcccatggttatgccgacctgatcgcgtacggccggatgttcctggccaacccggatcttccggcgcgttttgccaagaaggccgcgctgaacaagtatgacaggagcaccttctacacctcggatcctgtggttggctacactgattacccattcctcgatcaattctag

SEQ ID NO: 19085 - protein, 257 aa, Sorghum bicolor
  misc_feature: Useful for making plants with modulated water use efficiency
  misc_feature: Functional homolog of the protein sequence given in SEQ ID NO 13609
  misc_feature: Ceres ANNOT ID no. 8717082
  misc_feature (53)..(255): SWISSPROT Homolog: EC 1.3.1.42 12-oxophytodienoate reductase
  misc_feature (1)..(232): Pfam ID: Oxidored_FMN Pfam Description: NADH:flavin oxidoreductase / NADH oxidase family
MAAGGGDVGAAAVGEVERGGEDRRDRDTTLSKTLNPRVTYKIYGSTKVKTIYNLKPLGFDGVEIHAANGYLFDQFMKDSTNDRDDAYGGSLENRCRFTAEVTAAVAAEVGGDRLGVRLSPFADYMDCHDSDPEALGLHVIDKTLNPLGVLYCHMVEARMRVNPEDGNKMTLQQMLLPFRRAFRVTFIASGGYDREEGNAAIAHGYADLIAYGRMFLANPDLPARFAKKAALNKYDRSTFYTSDPVVGYTDYPFLDQF

SEQ ID NO: 19086 - DNA, 315 bp, Sorghum bicolor
  misc_feature: Ceres ANNOT ID no. 8717096
  misc_feature: Encodes the peptide sequence at SEQ ID NO 19087
atggctattggggcgccaccacccgccgaggaggccgtgctcgcctacgacagcaccgcgttccgcctccgcggggactccgccaggctcagcttccctgagctcaggcacggcggtcagcacctcagtccgccgctccatgccgcagtcgacgccaagctccacgccatctgcagtcgagagctcgttttccacagacggcggcgtgtatttgaggatgtggagtatttgaggggggcgcctgacatgtgggacccaacagtgggtactgctccaagcggtgcaggtggggttcacttcggctggcgcacctag

SEQ ID NO: 19087 - protein, 104 aa, Sorghum bicolor
  misc_feature: The sequence is a functional homolog of SEQ ID NO 1289 in the 10/374,780 US patent application
  misc_feature: The sequence is a functional homolog of SEQ ID NO 1435 in the 10/412,699 US patent application
  misc_feature: The sequence is a functional homolog of SEQ ID NO 1288 in the 10/374,780 US patent application
  misc_feature: The sequence is a functional homolog of SEQ ID NO 1434 in the 10/412,699 US patent application
  misc_feature: The sequence is a functional homolog of SEQ ID NO 116 in the 11/479,226 US patent application
  misc_feature: The sequence is a functional homolog of SEQ ID NO 1712 in the 10/412,699 US patent application
  misc_feature: The sequence is a functional homolog of SEQ ID NO 1948 in the 10/374,780 US patent application
  misc_feature: The sequence is a functional homolog of SEQ ID NO 256 in the 11/375,241 US patent application
  misc_feature: The sequence is a functional homolog of SEQ ID NO 6 in the 10/412,699 US patent application
  misc_feature: The sequence is a functional homolog of SEQ ID NO 722 in the 10/225,066 US patent application
  misc_feature: The sequence is a functional homolog of SEQ ID NO 906 in the 11/435,388 US patent application
  misc_feature: The sequence is a functional homolog of SEQ ID NO 198 in the 10/374,780 US patent application
  misc_feature: The sequence is a functional homolog of SEQ ID NO 52 in the 11/375,241 US patent application
  misc_feature: The sequence is a functional homolog of SEQ ID NO 642 in the 10/412,699 US patent application
  misc_feature: The sequence is a functional homolog of SEQ ID NO 860 in the 11/435,388 US patent application
  misc_feature: The sequence is a functional homolog of SEQ ID NO 996 in the 10/225,066 US patent application
  misc_feature: The sequence is a functional homolog of SEQ ID NO 179 in the 11/479,226 US patent application
  misc_feature: The sequence is a functional homolog of SEQ ID NO 1290 in the 10/374,780 US patent application
  misc_feature: The sequence is a functional homolog of SEQ ID NO 1436 in the 10/412,699 US patent application
  misc_feature: The sequence is a functional homolog of SEQ ID NO 212 in the 10/666,642 US patent application
  misc_feature: The sequence is a functional homolog of SEQ ID NO 2600 in the 10/374,780 US patent application
  misc_feature: The sequence is a functional homolog of SEQ ID NO 2706 in the 10/374,780 US patent application
  misc_feature: The sequence is a functional homolog of SEQ ID NO 294 in the 10/225,066 US patent application
  misc_feature: The sequence is a functional homolog of SEQ ID NO 352 in the 10/225,066 US patent application
  misc_feature: The sequence is a functional homolog of SEQ ID NO 1 in US patent 7253342
  misc_feature: Ceres ANNOT ID no. 8717096
MAIGAPPPAEEAVLAYDSTAFRLRGDSARLSFPELRHGGQHLSPPLHAAVDAKLHAICSRELVFHRRRRVFEDVEYLRGAPDMWDPTVGTAPSGAGGVHFGWRT

SEQ ID NO: 19088 - DNA, 1668 bp, Sorghum bicolor
  misc_feature: Ceres ANNOT ID no. 8717190
  misc_feature: Encodes the peptide sequence at SEQ ID NO 19089
atggctctacttcttgcttctgccatgaatcacactgcccatccagcaggccttagaagccatcccaataatgagagtttctcacggcaccacctatgttcttcaccacaaaacatcagtaagcgaaggtctaaccttagctttaggccacgagctcaaacgataagcagtgagtctgctggaatccacaggctgagcccctgggaaatccctaggagggactggttccctcctagctttctcttcggtgccgccacttcagcataccaaattgaaggtgcttggaatgaagatgggaaggggccaagcacatgggatcacttctgccacaattttccggaatggatagtggacaggagcaatggggatgttgcagcggattcgtaccatatgtacgctgaggatgtcaggttgctgaaggaaatgggcatggacgcctataggttctccatctcttggcccagaatactgccgaaggggacgctcgctggaggtattaacgagaaaggtgtcgagtactacaacaagttgatcgacttgttgttagagaacggcatagagccatatataacaattttccactgggacacgcctcaagcgctggtagacgcaaaagattacacagacttcgctaaagtgtgctttgaaaagtttggtaagaaggtgaaaaactggttgacctttaatgagccggagacattctgttctgtttcctatggaactggagtccttgccccggggcggtgctcaccgggagtaagttgtgccgttccaactggaaactcactcagcgagccatacattgttgcccacaaccttctccgagctcatgctgagactgttgatatttacaacaagtatcacaagggtgcggacggccgtatagggcttgcgttaaatgtatttggccgtgtgccatacacaaatacgtttcttgatcaacaggcccaagaaaggtccatggacaaatgcctaggatggttcttggagccagtggttcgtggtgactaccccttctccatgagagtgtcagcgagggaccgggtgccctacttcaaagaaaaagagcaagagaagctagttggttcttacgatatgatcgggataaactactacacctcaacgttctccaagcacatcgacctctcaccaaacaactcgccagtgctcaacactgacgacgcctatgccagtcaagaaaccaaagggcctgacgggaatgctattggtcctcctactggaaatgcgtggatcaatatgtaccctaaaggcctacacgatatccttatgaccatgaagaacaagtatggaaacccaccaatgtacatcactgagaacgggatgggggacattgacaagggcgatctacccaaaccagttgcgttggaagaccacacaaggctagattacatccagcgccacctctcagttcttaaacaatcaatagacttgggagcagacgtgcgcggctacttcgcgtggtctctgctggacaacttcgaatggtccagcggctacaccgagcgtttcggcatcgtctacgtcgatcgcgagaatggctgcgagcgcaccatgaagcgatcagccaggtggttgcaggagttcaatggagctgccaagaaggttgaaaataacaagattcttacgccggccggccagcttaactaa

SEQ ID NO: 19089 - protein, 555 aa, Sorghum bicolor
  misc_feature: Useful for making plants with altered cell wall content and/or composition
  misc_feature: Functional homolog of the protein sequence given in SEQ ID NO 14618
  misc_feature: Ceres ANNOT ID no. 8717190
  misc_feature (1)..(551): SWISSPROT Homolog: EC 3.2.1.21 Beta-glucosidase
  misc_feature (72)..(541): Pfam ID: Glyco_hydro_1 Pfam Description: Glycosyl hydrolase family 1
MALLLASAMNHTAHPAGLRSHPNNESFSRHHLCSSPQNISKRRSNLSFRPRAQTISSESAGIHRLSPWEIPRRDWFPPSFLFGAATSAYQIEGAWNEDGKGPSTWDHFCHNFPEWIVDRSNGDVAADSYHMYAEDVRLLKEMGMDAYRFSISWPRILPKGTLAGGINEKGVEYYNKLIDLLLENGIEPYITIFHWDTPQALVDAKDYTDFAKVCFEKFGKKVKNWLTFNEPETFCSVSYGTGVLAPGRCSPGVSCAVPTGNSLSEPYIVAHNLLRAHAETVDIYNKYHKGADGRIGLALNVFGRVPYTNTFLDQQAQERSMDKCLGWFLEPVVRGDYPFSMRVSARDRVPYFKEKEQEKLVGSYDMIGINYYTSTFSKHIDLSPNNSPVLNTDDAYASQETKGPDGNAIGPPTGNAWINMYPKGLHDILMTMKNKYGNPPMYITENGMGDIDKGDLPKPVALEDHTRLDYIQRHLSVLKQSIDLGADVRGYFAWSLLDNFEWSSGYTERFGIVYVDRENGCERTMKRSARWLQEFNGAAKKVENNKILTPAGQLN

SEQ ID NO: 19090 - DNA, 1623 bp, Sorghum bicolor
  misc_feature: Ceres ANNOT ID no. 8717312
  misc_feature: Encodes the peptide sequence at SEQ ID NO 19091
atggctctacttcttgcttctgccatgaatcacagtgcccatccagcaggccttagaagccaatccaataatcagagtttctcacggcaccacctttgttcttcaccaaaaaacatcagtaagcgaaggtgtaaacttagctttaggccacgagctgaaagagtaggcagtgagaatggaaaccataggctgagcccccgggaaatccctagaaaggactggttcccccctagctttctcgtcagtgccgccacttcagcataccatattgaaggtgcctggaatgaagatggaaaggggccaagcacttgggatcacttctgccacgagtatccagaacggatagcggacaggagcaatggggatgttgcagccgattcctaccatatgtacgctgacgatgtcaagttgctgaaggaaatgggcatggacgcctataggttctccatctcttggtccagaatactgccgaaggggacaatcgctggaggtattaacgagaaaggcgtcgagtactacaacaagttgatcgacttgttgctagagaacggcatagaaccatatataacaattttccactgggacacgcctcaagcgctggtagacgcgtacggcggcttcttagatgacaggattataacagattacacagacttcgctaaagtgtgcttccaaaagttcggtacgaaggtgaaaaactggttcacctttaatgagccggagacattttgttctgtttcctatggaactggagtccttgcccccgggcggtgctcacctggagtaaattgtgccgtcccaactggaaactcactcaccgagccatacaccgttgcccaccaccttctcctagctcatgctgagactgttgatctttacaacaagcatcacaagggtgcggacggccgtataggtcgtgtgccatacacaaatacgtttctcgatcaacaggcccaagaaaggtccatggacaactgcctaggatggttcttggagccagtggttcgtggtgactaccccttctccatgagagcgtcggcgaaggatcgcgtgccctacttcaaagaaatagagcaagagaagctagttggttcttacgacatgatcgggataaaactactacacctcaacgttctccaagcacatcgacatctcaccaaagggccagacggcaatgctattggtcctcctactggaaatgcgtggatcaatatgtaccctaaaggcctacacgatatcctcatgaccatgaagaacaagtatggaaacccacccatgtacatcactgagaacgggataggggacattgacaagggcgatctacccaaagcacttgcgttggaagaccacacaaggctagattacatccagcgccacctctcagttcttaaacaatcaatagacttgggagcaaacgtgcgcggctacttcgcgtggtctctgctggacaacttcgaatggtccagcggttacaccgagcgtttcggcatcgtctacgtcgatcgcgacaatggctgtgagcgcaccatgaagcgatcagcctggtggttgcaggagttcaatggagctgccatgaaggttcaaaacaacaagattcttacgccagccagcttaactaattaa

SEQ ID NO: 19091 - protein, 540 aa, Sorghum bicolor
  misc_feature: Useful for making plants with altered cell wall content and/or composition
  misc_feature: Functional homolog of the protein sequence given in SEQ ID NO 14687
  misc_feature: Useful for making plants with altered carbohydrate content
  misc_feature: Functional homolog of the protein sequence given in SEQ ID NO 14324
  misc_feature: Ceres ANNOT ID no. 8717312
  misc_feature (1)..(436): SWISSPROT Homolog: EC 3.2.1.21 Beta-glucosidase
  misc_feature (71)..(526): Pfam ID: Glyco_hydro_1 Pfam Description: Glycosyl hydrolase family 1
MALLLASAMNHSAHPAGLRSQSNNQSFSRHHLCSSPKNISKRRCKLSFRPRAERVGSENGNHRLSPREIPRKDWFPPSFLVSAATSAYHIEGAWNEDGKGPSTWDHFCHEYPERIADRSNGDVAADSYHMYADDVKLLKEMGMDAYRFSISWSRILPKGTIAGGINEKGVEYYNKLIDLLLENGIEPYITIFHWDTPQALVDAYGGFLDDRIITDYTDFAKVCFQKFGTKVKNWFTFNEPETFCSVSYGTGVLAPGRCSPGVNCAVPTGNSLTEPYTVAHHLLLAHAETVDLYNKHHKGADGRIGRVPYTNTFLDQQAQERSMDNCLGWFLEPVVRGDYPFSMRASAKDRVPYFKEIEQEKLVGSYDMIGIKLLHLNVLQAHRHLTKGPDGNAIGPPTGNAWINMYPKGLHDILMTMKNKYGNPPMYITENGIGDIDKGDLPKALALEDHTRLDYIQRHLSVLKQSIDLGANVRGYFAWSLLDNFEWSSGYTERFGIVYVDRDNGCERTMKRSAWWLQEFNGAAMKVQNNKILTPASLTN

SEQ ID NO: 19092 - DNA, 1710 bp, Sorghum bicolor
  misc_feature: Ceres ANNOT ID no. 8717338
  misc_feature: Encodes the peptide sequence at SEQ ID NO 19093
atgggcaactgctgcgtagcccggccgttgtcaggcaagcagcggcgaggcggcggccgcggtggcgctggcgctggcgggaaccgtggcgggcgtctcggcggcgcccacgtgcggtcctgctccacgctgtcctccatctcctccggcgcgcgcgccacgacgacggagcaggcgcggacgccgctgacggtgctggggaaaggcctcgccgcggaggccagcgcggaggagctgctccggcggtaccagctcggcgaggagctcgggcgcggcgagttcggcgtgacgcggcggtgcacggacacgtccacgggcgaggtgctcgcgtgcaagtccatcagcaagcgcaagctgcgcagcagcgtcgacatcgaggacgtccggcgggaggtgtccatcatggggtcgctgccggagcaccccaacgtcgtgcgcctgcgggaggccttcgaggacggcgacaccgtgcacctcgtcatggaggtctgcgagggcggcgagctctttgaccgcatcgtctcccgcggccactacaccgagcgcgcggcagcgaacgtcatgcgcaccattatggaagtcgtcctgcattgccacaagcatggcgtcatgcaccgggacctcaagcctgagaactttctgtacgccaacacatctgagaactcggctctcaaggtcatcgactttggtctctctgtgtgcttcaaaccaggtgacaggttcagtgagatcgttggatccccctactacatggctcctgaagtcctgaagaggaactatggacaagaagtagatatatggagtgcaggagtcatactctacatcttgctttgtggcgtcccaccattctgggcagagactgatgagggcatagcacaggctatcatccggtccagcatcgacttccagagagagccttggccaaaggtgtctgaaaatgcaaaagatcttgtgaggaagatgcttgatcccagcccctactctcggctgactgcccagcaggttctagagcatccttggatacagaatgccagtgcagctcccaatatcccactcggagaagcagtgaggtccaggctaaagcaattcactgttatgaacaagttcaagaagaaggccctgcttgtggtggcggattacctaccagccgaagagctggaagcaatcagggagttgtttcacatgctggacaccaacaaggatgggcatctgacaatcgaagaactcaggaagggactgcgattgatcgggcacaatgtccatgacacagatgtggatatgctcatggaagctgcagacatggacggcaatgggaccctggactgcaaagagtttgtgacagtctccattcacctgaagaaaatccgcagcgaggatcacctgcccaaggtgttcagctacttcgacaagaatgggagcgggtacattgagatcgaagagttgaaggaggccctctctccaagaggtgacgagaaggcgatcgacgacataatcctagacgtcgacaaagacaaggacgggaagataagctatgaggagtttgagctgatgatgaaagctggagtggactggaggaatacgtcgaggcagtactcgagagcggtttacaacaccctgagccgcaagatgttcaaggatgtgtccctgaagcttgacattaacaatggcccacttgctgcagccgtcaaagaacaacaagcggttgattga

SEQ ID NO: 19093 - protein, 569 aa, Sorghum bicolor
  misc_feature: The sequence is a functional homolog of SEQ ID NO 2 in US patent 7084323
  misc_feature: Ceres ANNOT ID no. 8717338
  misc_feature: Up-regulated in shoot tissues in response to salicylic acid treatment
  misc_feature (82)..(552): SWISSPROT Homolog: EC 2.7.11.1 Non-specific serine/threonine protein kinase
  misc_feature (83)..(341): Pfam ID: Pkinase Pfam Description: Protein kinase domain
  misc_feature (493)..(521): Pfam ID: efhand Pfam Description: EF hand
  misc_feature (388)..(416): Pfam ID: efhand Pfam Description: EF hand
  misc_feature (460)..(488): Pfam ID: efhand Pfam Description: EF hand
MGNCCVARPLSGKQRRGGGRGGAGAGGNRGGRLGGAHVRSCSTLSSISSGARATTTEQARTPLTVLGKGLAAEASAEELLRRYQLGEELGRGEFGVTRRCTDTSTGEVLACKSISKRKLRSSVDIEDVRREVSIMGSLPEHPNVVRLREAFEDGDTVHLVMEVCEGGELFDRIVSRGHYTERAAANVMRTIMEVVLHCHKHGVMHRDLKPENFLYANTSENSALKVIDFGLSVCFKPGDRFSEIVGSPYYMAPEVLKRNYGQEVDIWSAGVILYILLCGVPPFWAETDEGIAQAIIRSSIDFQREPWPKVSENAKDLVRKMLDPSPYSRLTAQQVLEHPWIQNASAAPNIPLGEAVRSRLKQFTVMNKFKKKALLVVADYLPAEELEAIRELFHMLDTNKDGHLTIEELRKGLRLIGHNVHDTDVDMLMEAADMDGNGTLDCKEFVTVSIHLKKIRSEDHLPKVFSYFDKNGSGYIEIEELKEALSPRGDEKAIDDIILDVDKDKDGKISYEEFELMMKAGVDWRNTSRQYSRAVYNTLSRKMFKDVSLKLDINNGPLAAAVKEQQAVD

SEQ ID NO: 19094 - DNA, 2610 bp, Sorghum bicolor
  misc_feature: Ceres ANNOT ID no. 8718092
  misc_feature: Up-regulated in shoot tissues in response to salicylic acid treatment
  misc_feature: Encodes the peptide sequence at SEQ ID NO 19095
atggcccgacctagcaacggtcgtgaaggaaagcccattaggttgctgtccaaccactttgctgtgaagcttagaggagttgatgctgttttctaccaatacagtgtctgcatcaaatctgaggatgataaggtggttgatggcaagggtattggccgaaaggtcatagacaaactattgcaaacatactgttctgagcttgatgggaaggattttgcatatgatggagagaaatgtctatttactgtgggacctcttccacagaataactttgagttcactgttatcttggaggaaacatcttcaagggctgttggtggaagtccggtgcatggaagccctactcaagctgagaaaaagcgagtcaagcgatcacatctggcaaaaaagttcagtgtaggcataagctatgccgcaaagattcctctaaggtcggttgctttggctcttcgaggaaccgagacagaacatgctcaagatgctctgagagtccttgacattgttttaaggcaacagcaggctaagcgaggttgtctacttgttaggcagtcatttttcagtgatgatagtcgaaaccttgttgatttaactggtggagttagtggctgtcgtggactccactctagtttccgtactacaattggtggtctttcactaaacatggatgtttcaaccactatggttgtaactcctggaccagttattgattttctcctcacaaatcaaaatgtcagagacatcagagatattgactggcccagggccaagaaaatgcttaaaaagctcagagttaaagctaagcacaacaacatggagtttccaatgaaagttcgaaatggaagcattgaaattcaaactgtggatatcactgttcacgattattttaagtccaagcaagttgaactaacgatgccttatctgccatgtcttgatgtgggaaaaccaaaacgccctaattatctcccaattgagttatgccacatgttatcacttcaacgttatacaaaggcactgtcttctcaacaaagggcaacgttggttgaaaagtcgcgacagaaacctcaagaaagaatgcgagttgttacagatgtgggtaaattctgtcaatgttattactcctccctgctttctccccttaacttggctgtaaaaagtaatatgtatgatgatgatccaatcttatcttcctgtggtattgaaattgacaaacaacttactcgtgttgacgctcgtgttctctctgcaccaacgctagttgtggggaacagtgaagactgcatcccgaacaggggcaggtggaactacaataataaggttgttactacactacttaggctattggatcccgtcaagattgagcgctgggctattgttaatttctctgctcgttgtgacatgagccgaatctcaagagagttgataaactgtggacgcagcaaaggcattctcattgaacgacctcacaccttggtggatgaggacagccagtctaggagatgttcacctgtggaaagggttgaaaagatgtttgaaaaagtcaaaacaagccttcccggtcctccagagtttctcctttgtgttttaccagagaggaagaattgtgatatttacgggccatggaagaagaaaaatcttcatgaaatgggtattgtcactcaatgcattgctcccagtaataagatgaatgatcaatatttcaccaatgttcttctgaaaattaatgctaagcttggtggaatgaactctaaactggcattggaacatcgtcaaatgataccagttgtgactcaaataccaacattaattcttggcatggatgtttcgcatggttctccaggtcgagcagatataccatcaattgctgcggttgtgggatctagatgctggccattgatatcacggtatagagcatcagtgcgtacccagtctccaaaggtagagatgattgattctctatttaaaccactggatgatgggaaggatgatggcataatgagggaacttctactagacttctaccaaaccagccagcaaagaaagcctaagcagataatcatcttcagggatggtgttagcgagtctcagtttagccaagtactgaacgttgagcttaatcaaatcataaaggcatatcagagtatgggacagggggaccttccaaagttcacagtgatcattgctcaaaagaatcaccacacaaaactcttccaagctgattcaccagagaacgttccacctgggactgttgtagactccggcattgttcatccaagacagtatgatttctacatgtgcgctcatgctggaccaattggtacttcaaggccaacccattaccatgtgttgcttgatgagatcggcttctccgcagataatctccagaagctagttctttcactttcatatgtgtaccagaggagcaccactgctatttctgtggtggcacctatctgttatgcccacctcgcagcagctcagatgggccagttcatgaaattcgaagagtttgcagatacatcgtcagggagtgtcaattcatcatcgtcagcatcaataccagaactgccacggctgcatgctgatgtctgcagttccatgttcttctgttga

SEQ ID NO: 19095 - protein, 869 aa, Sorghum bicolor
  misc_feature: The sequence is a functional homolog of SEQ ID NO 2 in the 11/375,241 US patent application
  misc_feature: The sequence is a functional homolog of SEQ ID NO 2562 in the 10/374,780 US patent application
  misc_feature: Ceres ANNOT ID no. 8718092
  misc_feature (523)..(832): Pfam ID: Piwi Pfam Description: Piwi domain
  misc_feature (232)..(353): Pfam ID: PAZ Pfam Description: PAZ domain
MARPSNGREGKPIRLLSNHFAVKLRGVDAVFYQYSVCIKSEDDKVVDGKGIGRKVIDKLLQTYCSELDGKDFAYDGEKCLFTVGPLPQNNFEFTVILEETSSRAVGGSPVHGSPTQAEKKRVKRSHLAKKFSVGISYAAKIPLRSVALALRGTETEHAQDALRVLDIVLRQQQAKRGCLLVRQSFFSDDSRNLVDLTGGVSGCRGLHSSFRTTIGGLSLNMDVSTTMVVTPGPVIDFLLTNQNVRDIRDIDWPRAKKMLKKLRVKAKHNNMEFPMKVRNGSIEIQTVDITVHDYFKSKQVELTMPYLPCLDVGKPKRPNYLPIELCHMLSLQRYTKALSSQQRATLVEKSRQKPQERMRVVTDVGKFCQCYYSSLLSPLNLAVKSNMYDDDPILSSCGIEIDKQLTRVDARVLSAPTLVVGNSEDCIPNRGRWNYNNKVVTTLLRLLDPVKIERWAIVNFSARCDMSRISRELINCGRSKGILIERPHTLVDEDSQSRRCSPVERVEKMFEKVKTSLPGPPEFLLCVLPERKNCDIYGPWKKKNLHEMGIVTQCIAPSNKMNDQYFTNVLLKINAKLGGMNSKLALEHRQMIPVVTQIPTLILGMDVSHGSPGRADIPSIAAVVGSRCWPLISRYRASVRTQSPKVEMIDSLFKPLDDGKDDGIMRELLLDFYQTSQQRKPKQIIIFRDGVSESQFSQVLNVELNQIIKAYQSMGQGDLPKFTVIIAQKNHHTKLFQADSPENVPPGTVVDSGIVHPRQYDFYMCAHAGPIGTSRPTHYHVLLDEIGFSADNLQKLVLSLSYVYQRSTTAISVVAPICYAHLAAAQMGQFMKFEEFADTSSGSVNSSSSASIPELPRLHADVCSSMFFC

SEQ ID NO: 19096 - DNA, 2610 bp, Sorghum bicolor; identical to SEQ ID NO: 19094
  misc_feature: Ceres ANNOT ID no. 8718095
  misc_feature: Encodes the peptide sequence at SEQ ID NO 19097

SEQ ID NO: 19097 - protein, 869 aa, Sorghum bicolor; identical to SEQ ID NO: 19095
  misc_feature: The sequence is a functional homolog of SEQ ID NO 2 in the 11/375,241 US patent application
  misc_feature: The sequence is a functional homolog of SEQ ID NO 2562 in the 10/374,780 US patent application
  misc_feature: Ceres ANNOT ID no. 8718095
  misc_feature (523)..(832): Pfam ID: Piwi Pfam Description: Piwi domain
  misc_feature (232)..(353): Pfam ID: PAZ Pfam Description: PAZ domain

SEQ ID NO: 19098 - DNA, 1317 bp, Sorghum bicolor
  misc_feature: Ceres ANNOT ID no. 8718332
  misc_feature: Encodes the peptide sequence at SEQ ID NO 19099
atggcgccgccgtcgagcatgtcgacggagaaggaggagaaggccatcgacgactggctgcccatcacctcgtccaggaatgccaagtggtggtactccgccttccacaacgtcacggccatggtcggcgccggcgtgctcagcctgccctacgccatgtccgagctcggatggggccccggcgttgtggccatgctcctgtcgtgggtgatcaccctgtacacgctgtggcagatggtcgagatgcacgagtgcgtcccggggaagcgcttcgaccgctaccacgagctgggccagcacgccttcggcgacaagctgggcctctggatcgtcgtcccgcagcagctcatcgtggaggtcggcgtctgcatcgtctacatggtcaccggcggcaagtccttcgagaagtgctacgccgtctcctgcccggactgcaagcccctcaacaccagctcctggatcatgatcttcgccgccatccacctgctcctctcgcagctcccaaacttcaactccatcacgctcgtctccctcgccgccgcagtcatgtcgctcagctactctacgatcgcatgggcggcgtcggcgcacaaggggcggcacgccgccgtggattacagcatgaaggcgtccacggcgacggggcagacgttcaattttctgagcgcgctgggggacgtggcgttcgcgtacgcggggcacaacgtggtgctggagatccaggccaccatcccgtccacgcccgacaagccgtccaagaagcccatgtggcagggcgtcgtcctcgcctacatcgtcgtcgccatctgctacctccccgtggcgttcgtcggctactacgtcttcggcaatgccgtcgacgacaacatcctcatcacactcgagaagccacgctggctcatcgccatggctaacatcttcgtcgtcgtccacgtcatcggcagctaccagatctacgccatgcccgtgtttgacatgctcgagacgttcctggtgaagaaactccggttcaggccaggcctgcctctccgtttgatagcgcgctcactctatgttgtgttcacagctctggttggcatcgccgtgccgttcttcggggggttgctagggttctttggtggctttgcatttgcgccgacaacctactatcttccctgcatcctatggctcaagattaagaagccaaagacgtttagcctctcatggttcatcaactggttttgcatcatagttggcgtgctcctgacggtgtttgcacccattggtggcctccggtcgatcatcgtcaacgcctccacctacaagttcttctcgtga

SEQ ID NO: 19099 - protein, 438 aa, Sorghum bicolor
  misc_feature: Useful for making plants with altered oil content
  misc_feature: Functional homolog of the protein sequence given in SEQ ID NO 13448
  misc_feature: Ceres ANNOT ID no. 8718332
  misc_feature (26)..(425): Pfam ID: Aa_trans Pfam Description: Transmembrane amino acid transporter protein
MAPPSSMSTEKEEKAIDDWLPITSSRNAKWWYSAFHNVTAMVGAGVLSLPYAMSELGWGPGVVAMLLSWVITLYTLWQMVEMHECVPGKRFDRYHELGQHAFGDKLGLWIVVPQQLIVEVGVCIVYMVTGGKSFEKCYAVSCPDCKPLNTSSWIMIFAAIHLLLSQLPNFNSITLVSLAAAVMSLSYSTIAWAASAHKGRHAAVDYSMKASTATGQTFNFLSALGDVAFAYAGHNVVLEIQATIPSTPDKPSKKPMWQGVVLAYIVVAICYLPVAFVGYYVFGNAVDDNILITLEKPRWLIAMANIFVVVHVIGSYQIYAMPVFDMLETFLVKKLRFRPGLPLRLIARSLYVVFTALVGIAVPFFGGLLGFFGGFAFAPTTYYLPCILWLKIKKPKTFSLSWFINWFCIIVGVLLTVFAPIGGLRSIIVNASTYKFFS

SEQ ID NO: 19100 - DNA, 1731 bp, Sorghum bicolor
  misc_feature: Ceres ANNOT ID no. 8719317
  misc_feature: Encodes the peptide sequence at SEQ ID NO 19101
atggcttggcctaggtcatcattagttttgccttttggtctcatcgccttggtgtttgcttgtgttgctcaagcttcgatcgtggagcacaccttcaacgttggaaacctttctataagccagctttgccagccaccaaggatcatcacggcggtgaacgggcagctccctggcccggccatccatgccagtgacggagacactgtggttgttcacctcgtgaaccagtcaccctacaatgtgaccattcattggcacggcatattccagcgtggcacaccttgggcagatgggccaacgatggtgacgcagtgccccgtgaagccgggcggcaactacacgtaccgcttcaacgtgacggagcaggaggggacgctgtggtggcatgcccacatctcctacctccgcgccaccgtgtacggcgccctggtcctccgccctcgtggcggcaccgaggcctacccgttcccaaccaagcccgacagggaggagacggtcatcctcggcgagtggtggaacgacaacgtctatgacctcgagcagctggcgttcctcaccggcttcacggcgcgcaacgccgatgcctacaccatcaacggcaagccgggagacttgtacaactgctccaacgctgaccagacgtacaagttccaggtgcagagcaacgagacgtacctgctgcggatcatcaacgcggcacttaacacgccgctcttcttcaaggtggccaaccacagcttcaacgtcgtgggcgtggacgcggcctataccacgccgtacgacaccgacgtggtggtgatcgcgcccgggcagaccgtggacgcgctcatggtcgcgggcgccaccgtcggccgctactacatggcggcgtccccctacgacagcgccatcccgcagggcccgcctttcagtgagaccacggcgactgccgtagtcgagtacatcggctcagaaggcgaggagacgccggtgctgccgtcgcggccagactacaacgacacggccacagccttccggttcctctccaacctgacggcgctggtgctccaggacaagccaacggtgccgctgtccgtggacactcgcatgttcgtcaccgtggggctcggcgtctccgactgccagccgaggcaggtgctgtgcaaccggagcaccaccgtgttctcctcgagcatgaacaacaactcctttgtgctgcctgccccaggcgcggtctccatgctccaggcccactacagcaacgcgacggcgggcctctacacccgcgacttccccgaccagccgccggtcatcttcgactacaccgccgatgccagcgacacggccatgttgcagtacacgcccaagtcgaccaaggtgaagacgctcaggtacaacgagacggtggagatggtgctgcagaacacgcgcctgatcgccaaggagagccaccccatgcacctccacggctacaacttcttcgtgctcgcgcagggctttggcaactacgacgaggcgacagcgacgcctcagttcaacctcgtcaacccgcaggagcgcaacaccgtcgctgtccccacgggcggctgggctgtcatccgcttcctcgcaaataaccctgggatgtggttcatgcactgccactttgatgcccatcttgatctggggctggggatggtgtttgaggtacaggacgggccgacggccgaaacgtcagtgccgccacctccagcagacctaccacattgctaa

SEQ ID NO: 19101 - protein, 576 aa, Sorghum bicolor
  misc_feature: Useful for making plants with altered cell wall content and/or composition
  misc_feature: Functional homolog of the protein sequence given in SEQ ID NO 14469
  misc_feature: Ceres ANNOT ID no. 8719317
  misc_feature (7)..(576): SWISSPROT Homolog: EC 1.10.3.2 Laccase
  misc_feature (33)..(150): Pfam ID: Cu-oxidase_3 Pfam Description: Multicopper oxidase
  misc_feature (423)..(560): Pfam ID: Cu-oxidase_2 Pfam Description: Multicopper oxidase
  misc_feature (163)..(317): Pfam ID: Cu-oxidase Pfam Description: Multicopper oxidase
MAWPRSSLVLPFGLIALVFACVAQASIVEHTFNVGNLSISQLCQPPRIITAVNGQLPGPAIHASDGDTVVVHLVNQSPYNVTIHWHGIFQRGTPWADGPTMVTQCPVKPGGNYTYRFNVTEQEGTLWWHAHISYLRATVYGALVLRPRGGTEAYPFPTKPDREETVILGEWWNDNVYDLEQLAFLTGFTARNADAYTINGKPGDLYNCSNADQTYKFQVQSNETYLLRIINAALNTPLFFKVANHSFNVVGVDAAYTTPYDTDVVVIAPGQTVDALMVAGATVGRYYMAASPYDSAIPQGPPFSETTATAVVEYIGSEGEETPVLPSRPDYNDTATAFRFLSNLTALVLQDKPTVPLSVDTRMFVTVGLGVSDCQPRQVLCNRSTTVFSSSMNNNSFVLPAPGAVSMLQAHYSNATAGLYTRDFPDQPPVIFDYTADASDTAMLQYTPKSTKVKTLRYNETVEMVLQNTRLIAKESHPMHLHGYNFFVLAQGFGNYDEATATPQFNLVNPQERNTVAVPTGGWAVIRFLANNPGMWFMHCHFDAHLDLGLGMVFEVQDGPTAETSVPPPPADLPHC

SEQ ID NO: 19102 - DNA, 129 bp, Sorghum bicolor
  misc_feature: Ceres ANNOT ID no. 8719391
  misc_feature: Encodes the peptide sequence at SEQ ID NO 19103
atggatggcactgtagttgacaggaatatctgccacacaatagaatttgatttcttcctgtgcaaccatgctgggatcaagttcattggcggtgatgggtccatggaggcacaaaggtggggtgtgtag

SEQ ID NO: 19103 - protein, 42 aa, Sorghum bicolor
  misc_feature: The sequence is a functional homolog of SEQ ID NO 152 in the 10/225,066 US patent application
  misc_feature: The sequence is a functional homolog of SEQ ID NO 238 in the 10/374,780 US patent application
  misc_feature: The sequence is a functional homolog of SEQ ID NO 2086 in the 10/374,780 US patent application
  misc_feature: The sequence is a functional homolog of SEQ ID NO 102 in the 10/286,264 US patent application
  misc_feature: The sequence is a functional homolog of SEQ ID NO 1579 in the 11/479,226 US patent application
  misc_feature: The sequence is a functional homolog of SEQ ID NO 2084 in the 10/374,780 US patent application
  misc_feature: The sequence is a functional homolog of SEQ ID NO 752 in the 10/412,699 US patent application
  misc_feature: The sequence is a functional homolog of SEQ ID NO 188 in the 10/666,642 US patent application
  misc_feature: Useful for making plants with modulated biomass
  misc_feature: Ceres ANNOT ID no. 8719391
MDGTVVDRNICHTIEFDFFLCNHAGIKFIGGDGSMEAQRWGV

SEQ ID NO: 19104 - DNA, 411 bp, Sorghum bicolor
  misc_feature: Ceres ANNOT ID no. 8720815
  misc_feature: Encodes the peptide sequence at SEQ ID NO 19105
atggcggcggcggcggcgcagcagaagatccggtggggggagctagaggaggacgacggaggtgacctcgacttcctcctcccgccgtgggtcatggttgggcccgatgagaacgggctcaagaaggtcatcgagtatcgcttcgacgacgacggcaacaaggtcagggtcaccaccaccacccgcgtccgcaagctcgcgcagccgtgcctctcccgcagcgccatcgagcgccgccagtggcccaagttcggcgatgccctcaaggaggacgcgggttccaggctcaccatggtctccaccgaggaggtcctcctcgagcgaccccgcgcaccaggtctcgatctgctttgctacctgcttccatttcgaacatcctcgtcgtctgttcgttcgattggtagctgctag

SEQ ID NO: 19105 - protein, 136 aa, Sorghum bicolor
  misc_feature: Useful for making plants with altered alkaloid content
  misc_feature: Functional homolog of the protein sequence given in SEQ ID NO 14575
  misc_feature: Ceres ANNOT ID no. 8720815
MAAAAAQQKIRWGELEEDDGGDLDFLLPPWVMVGPDENGLKKVIEYRFDDDGNKVRVTTTTRVRKLAQPCLSRSAIERRQWPKFGDALKEDAGSRLTMVSTEEVLLERPRAPGLDLLCYLLPFRTSSSSVRSIGSC

SEQ ID NO: 19106 - DNA, 804 bp, Sorghum bicolor
  misc_feature: Ceres ANNOT ID no. 8721104
  misc_feature: Encodes the peptide sequence at SEQ ID NO 19107
atggaggtgaaggatgctgcgaagccgaggctgccgccggggttcaggttccggcccacggacgaggagttgatcgttcactacctccggcgccgcgcgctggcctccccgctgccgcccgccgtcgacatcccggacgtccgcatcctggcgcacgacccttccgacctgctgcccccagggttcagcgagcaggagcgctacttcttcacgtgcaaggaggccaagtacgtgaagggccggcgcgccaaccgcgccacgggggccgggtactggaaggccacaggcaaggagaagccggtggccgtggcggtcccggcgactcggggcggccagggccaggccgtgcttgtgggcatgaagcgctcgttggtgttctaccgggggaagccaccgacggggagcaagacggactgggttatgcacgagtaccggctcgcgggcgccgggctcgccccgtgccgccgcgcgacagcgcagcaggacggcgacggcgacgcggcggtgtcgcggccggccgagggctgggtgctgtgccgcgtgttccggaagaagaagggctccgccgccgccgcgaggcctggcgaccggagcgacggcgacggcgatgagggcgaggaggccggcgagagcgagagcgcgggcgctggcgggccggggttcatcgacttcttcgcgcgcgcggacgcggcggggcggcggcgtcgcgcggcgtcgcccgtggtgtcgagcagctgcctgacggacgcgtcgcccgagcggcagcaggggcgggagcaggagaccaccagcagaggcgcgtga

SEQ ID NO: 19107 - protein, 267 aa, Sorghum bicolor
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 1012 in the 11/435,388 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Useful for making plants with altered lignin content
  misc_feature: Functional homolog of the protein sequence given in SEQ ID NO 13250
  misc_feature: Ceres ANNOT ID no. 8721104
  misc_feature (11)..(147): Pfam ID: NAM Pfam Description: No apical meristem (NAM) protein
MEVKDAAKPRLPPGFRFRPTDEELIVHYLRRRALASPLPPAVDIPDVRILAHDPSDLLPPGFSEQERYFFTCKEAKYVKGRRANRATGAGYWKATGKEKPVAVAVPATRGGQGQAVLVGMKRSLVFYRGKPPTGSKTDWVMHEYRLAGAGLAPCRRATAQQDGDGDAAVSRPAEGWVLCRVFRKKKGSAAAARPGDRSDGDGDEGEEAGESESAGAGGPGFIDFFARADAAGRRRRAASPVVSSSCLTDASPERQQGREQETTSRGA

SEQ ID NO: 19108 - DNA, 2439 bp, Sorghum bicolor
  misc_feature: Ceres ANNOT ID no. 8721170
  misc_feature: Encodes the peptide sequence at SEQ ID NO 19109
atggcggcggctgcaccggcggccggcggcggcggtggtgcggaagcgggatgcggaggaggcggagggaaggacccgctgttcgtcgagctgtggaaggcctgcgcggggccgctgtctagcgtgccgccgctcggggagaaggtctactacttcccgcagggccacatcgagcaggtggaggcatcgacgaaccagattgctgagcagcagggcacgcccctctacaacctgccatggaagattccatgcaagctcatgaacatcgagctgaaggctgagccggatactgatgaggtgtacgcccagctcaccctgctccctgataagaagcaagatgagaatacatctacaacagtggagaatgaggaggcagaggaggaggtggtgcctcatgcgccaccaacaaatgagggacctcggatccattccttttgcaagacattgactgcctcagacacaagcacgcatggtggtttctcagtgttgcgccggcatgcagatgagtgcctcccaccattggatatgagtcaacaccccccaaatcaagaattggtggccaaggacctgcatgggattgagtggcggttccgtcacatctttcgaggtcagccacggagacacctccttcagagtggttggagtgtttttgttagcgccaagcgtcttgttgcaggggatgccttcatatttctcagaggtgagaatggggagttacgtgttggggttcggcgtgcactgaggcaccaaaccactatcccatcttcagtcatatcaagccacagtatgcatcttggtgttcttgcgacagcatggcatgcagtcaacactgggagtatgttcactgtctactacaagccaaggactagtccagctgaatttgtggtctcgcgagataggtactatgaatcactgaaacgaaattattcaatagggatgagatttaagatgagatttgaaggtgaagaagcagcagagcaaagattcactggcacaatagttggaataggtgcttctgatccatctggttgggctgactcaaaatggcgttcccttaaggtgagatgggatgaagcttcttctgttcctcgtcctgaaagagtttctccttggcaaatagaacctgctattagcccatctcctgtgaaccctcttccagtcagattcaagaggtctcgttcaagtgttaatgcttcaccatctgacgtgcctactgtatccagagaaggtcgataccatgatagcagtgatgtgaagactgctcaggatcttaccatgtggtcttcaggaactgagcagcagagaaacaatattgctgcccagacaaagcgaagtctggagggatggacgcaatctagaactcctgaaggttacaatcagctgttctcggcatttcaaccactgaaagatacacataatccactttgtactttccctagtcaaatatctgggactcgctcaaatacctgggacacagccgatgctcgttatccagcccaacaagccaatcacaacatgttacatggcacatggccttttatgcctcatagcagtggttttaggacgaatcaacagaattatctagtgatgcctgaagctgcaaagtttactgggaaatcagctttcacttcacttcagggccatggcactgatcagtgctccacaggctggtttggacatattgagtcaagttcccgcacagaccatgcatcgtcaagttcgatcaggccccagcctttggttattggtaatgatgttcagaaaaccaaaggcacttcattcaaactatttgggattcctcttggcagcccggaaaaatctgaacctctggtatccccaccaagtgtcgcatatgacgggaaacttcaaacttctccatcagaaaaagggaatcagctagacatagttggagtggataattgttctgatccttcgaagactgtgaagccatttgatggtcctcaatcagattcgattacagagaataatcagccttgtccagaagctacccagaatattcagaacaaagtgcaaagtagttccaccagaagctgcaagaaggtccataagcaaggcagtgccctcggcagatcgattgatctaacaaagttcacttgctacgatgagctgattgctgaactggatcagatgtttgactttgatggtgagctgaagaatccatgcaaaaattggctggttgtctacactgacaatgaaggcgatataatgctggttggcgatgacccctggaatgaattctgcgacatggtccacaagatcttcatctacacaagggaggaagtggaaaggatgaacccaggtgccctaaactcaaggtccgaggatagtctgtctgactcgcagggaagagggttggcttccaaagagccgccccgaggtggcccgtctacttcgactcccaattccgagagctgctaa

SEQ ID NO: 19109 - protein, 812 aa, Sorghum bicolor
  misc_feature: The sequence is a functional homolog of SEQ ID NO 298 in the 10/412,699 US patent application
  misc_feature: The sequence is a functional homolog of SEQ ID NO 300 in the 10/412,699 US patent application
  misc_feature: Useful for biocontainment applications
  misc_feature: Useful for making plants with modulated flowering time
  misc_feature: Functional homolog of the protein sequence given in SEQ ID NO 13656
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: Ceres ANNOT ID no. 8721170
  misc_feature (271)..(353): Pfam ID: Auxin_resp Pfam Description: Auxin response factor
  misc_feature (144)..(249): Pfam ID: B3 Pfam Description: B3 DNA binding domain
  misc_feature (592)..(775): Pfam ID: AUX_IAA Pfam Description: AUX/IAA family
MAAAAPAAGGGGGAEAGCGGGGGKDPLFVELWKACAGPLSSVPPLGEKVYYFPQGHIEQVEASTNQIAEQQGTPLYNLPWKIPCKLMNIELKAEPDTDEVYAQLTLLPDKKQDENTSTTVENEEAEEEVVPHAPPTNEGPRIHSFCKTLTASDTSTHGGFSVLRRHADECLPPLDMSQHPPNQELVAKDLHGIEWRFRHIFRGQPRRHLLQSGWSVFVSAKRLVAGDAFIFLRGENGELRVGVRRALRHQTTIPSSVISSHSMHLGVLATAWHAVNTGSMFTVYYKPRTSPAEFVVSRDRYYESLKRNYSIGMRFKMRFEGEEAAEQRFTGTIVGIGASDPSGWADSKWRSLKVRWDEASSVPRPERVSPWQIEPAISPSPVNPLPVRFKRSRSSVNASPSDVPTVSREGRYHDSSDVKTAQDLTMWSSGTEQQRNNIAAQTKRSLEGWTQSRTPEGYNQLFSAFQPLKDTHNPLCTFPSQISGTRSNTWDTADARYPAQQANHNMLHGTWPFMPHSSGFRTNQQNYLVMPEAAKFTGKSAFTSLQGHGTDQCSTGWFGHIESSSRTDHASSSSIRPQPLVIGNDVQKTKGTSFKLFGIPLGSPEKSEPLVSPPSVAYDGKLQTSPSEKGNQLDIVGVDNCSDPSKTVKPFDGPQSDSITENNQPCPEATQNIQNKVQSSSTRSCKKVHKQGSALGRSIDLTKFTCYDELIAELDQMFDFDGELKNPCKNWLVVYTDNEGDIMLVGDDPWNEFCDMVHKIFIYTREEVERMNPGALNSRSEDSLSDSQGRGLASKEPPRGGPSTSTPNSESC

SEQ ID NO: 19110 - DNA, 1851 bp, Sorghum bicolor
  misc_feature: Ceres ANNOT ID no. 8721391
  misc_feature: Encodes the peptide sequence at SEQ ID NO 19111
atgggcaacgtctgcgtcgggtcccgattctccaagaacggcggcttcttcggcaacttctccctgtggccctcccgctcccgcagctccggcagcaccccctccaaccccaccaccacctcccgctccgtccccgtcgtccaggtccagcccagcgaatccgacgccaagccggagccagcacagatcacagagcccccggctcccattgtcatctccgagcaggcaccgcttcctcagccggagccgaagccgaagccaagcgaacccgacccgtcaccaccgccgccggcgccggcgtcgcaacagcccgcgcaaccgcagcagcagcagcagcaggcgccgccgcggcagcagtcccggaagaaagctgcgcacatcaagcgcatctccagcgcggggctccaggtggagtcggtgctccggcgcaagaccgacaacctcaaggacaagtacagcctggggcggaagctcgggcaggggcagttcggcaccacgtacctgtgcgtggacaaggcgacggggctggagtacgcgtgcaagtccatcgccaagcggaagctggtcaccgacgaggacgtggaggacgtccggcgcgagatccagatcatgcaccacctcgcgggccacccaaacatcatcggcatccgcggcgcgttcgaggacgccgtcgccgtgcacgtggtcatggagctctgcgccggcggggagctgttcgaccgcatcgtgcggaggggccactacacggagcggcaggccggcgagctggcccgcgtcatcgtcgccgtcgtggagtcgtgccactcgctcggcgtcatgcaccgggacctcaagccggagaacttcctcttcgtcggcaacgacgaggaatcgccgctcaagaccatcgacttcggcctctccatgttcttccggccaggcgaggagttcacggacgtcgtcgggagcccctactacgtggcgccggaggtgctgaagaagcggtacgggcaggaggccgacgtgtggagcgccggcgtgatcatctacatcctgctctgcggcgtgccgccgttctgggcggagacggagcagggcatcttcgagcaggtgctgcacggctcgctggacttcgagtccgacccctggcccagcgtgtcggagaacgccaaggacctgcttcggaaggtgctcgtcagggaccccaagaagcgcctcaccgcgcaccaagtcctctgccacccatggctgcagacgatcgcctctgcgcctgataagccgctggactcggcggtgctgtcccggctgaagcagttctccgcgatgaacaagctgaagaagatggcgctgagggtgattgcggagaacctgtcggaggaggagatcgcggggctcaaggagatgttcaagatgatggacaccgacaacagcgggcagatcaatttcgaggagctcaaggccggacttcagagggtcggcgctaacatgaaggagcccgagatatatcagcttatgcaggctgctgatatcgacaacagtggcaccatagattatggagagttcatagctgcaacactgcatctcaacaaagttgaaagggaagaccatctatttgctgccttccaatactttgacaaagatggcagtggatacatcacagctgatgagctgcagcaagcctgtgacgagtttggcatagaagatgtccgactcgaagacatgattggcgaagtggatcaagacaatgatgggcgcatagattacaatgagtttgtcgaaatgatgcaaaagtcaacaaccggatttggcaagaaaggtcatcagtacaaccttagcattggttttagggatgccttgaaggcaaatagctga

SEQ ID NO: 19111 - protein, 616 aa, Sorghum bicolor
  misc_feature: The sequence is a functional homolog of SEQ ID NO 2 in US patent 7084323
  misc_feature: Ceres ANNOT ID no. 8721391
  misc_feature (126)..(609): SWISSPROT Homolog: EC 2.7.11.1 Non-specific serine/threonine protein kinase
  misc_feature (152)..(410): Pfam ID: Pkinase Pfam Description: Protein kinase domain
  misc_feature (457)..(485): Pfam ID: efhand Pfam Description: EF hand
  misc_feature (563)..(591): Pfam ID: efhand Pfam Description: EF hand
  misc_feature (529)..(557): Pfam ID: efhand Pfam Description: EF hand
  misc_feature (493)..(521): Pfam ID: efhand Pfam Description: EF hand
MGNVCVGSRFSKNGGFFGNFSLWPSRSRSSGSTPSNPTTTSRSVPVVQVQPSESDAKPEPAQITEPPAPIVISEQAPLPQPEPKPKPSEPDPSPPPPAPASQQPAQPQQQQQQAPPRQQSRKKAAHIKRISSAGLQVESVLRRKTDNLKDKYSLGRKLGQGQFGTTYLCVDKATGLEYACKSIAKRKLVTDEDVEDVRREIQIMHHLAGHPNIIGIRGAFEDAVAVHVVMELCAGGELFDRIVRRGHYTERQAGELARVIVAVVESCHSLGVMHRDLKPENFLFVGNDEESPLKTIDFGLSMFFRPGEEFTDVVGSPYYVAPEVLKKRYGQEADVWSAGVIIYILLCGVPPFWAETEQGIFEQVLHGSLDFESDPWPSVSENAKDLLRKVLVRDPKKRLTAHQVLCHPWLQTIASAPDKPLDSAVLSRLKQFSAMNKLKKMALRVIAENLSEEEIAGLKEMFKMMDTDNSGQINFEELKAGLQRVGANMKEPEIYQLMQAADIDNSGTIDYGEFIAATLHLNKVEREDHLFAAFQYFDKDGSGYITADELQQACDEFGIEDVRLEDMIGEVDQDNDGRIDYNEFVEMMQKSTTGFGKKGHQYNLSIGFRDALKANS

SEQ ID NO: 19112 - DNA, 573 bp, Sorghum bicolor
  misc_feature: Ceres ANNOT ID no. 8721484
  misc_feature: Encodes the peptide sequence at SEQ ID NO 19113
atgcaggcggtgcgtccggccgcggagggggaggaggcacaggcacaggagcaggcggtgagggaggaggtggccgaggtgaagagggaggtggcgaaggcgcacgaggaggaggcggcgcctgaggagaaagacgtggcggttgtcggggaggaggctgacgccgaggcggaggcggaggcggagactgagggcgaggcggaggcggaggcggaggccggtgcgtctgccaagaagaaccgcatccaggtgtccaccaacaagaagccgctctatttctacgtcaatctcgccaagaggtacatgcagaactacgacgaggttgaactctctgctctggggatggccattggtaccgtcgtgactgtcgccgagatcctcaagaataatggcctcgccactgaaaagaagatcctgacatcaaccatcggcaccaaagacgagtccaagggccggcttgtccgtaaagccaagattgagattctgctgtgcaaatcagagaatttcaacagcatcatgtctagcaagaaatccgaccgcccgaaatccgccgaggaagagatcaaggtgtga

SEQ ID NO: 19113 - protein, 190 aa, Sorghum bicolor
  misc_feature: Useful for making plants with modulated nitrogen use efficiency
  misc_feature: Functional homolog of the protein sequence given in SEQ ID NO 13593
  misc_feature: Ceres ANNOT ID no. 8721484
  misc_feature (78)..(147): Pfam ID: Alba Pfam Description: Alba
MQAVRPAAEGEEAQAQEQAVREEVAEVKREVAKAHEEEAAPEEKDVAVVGEEADAEAEAEAETEGEAEAEAEAGASAKKNRIQVSTNKKPLYFYVNLAKRYMQNYDEVELSALGMAIGTVVTVAEILKNNGLATEKKILTSTIGTKDESKGRLVRKAKIEILLCKSENFNSIMSSKKSDRPKSAEEEIKV

SEQ ID NO: 19114 - DNA, 1533 bp, Sorghum bicolor
  misc_feature: Ceres ANNOT ID no. 8721897
  misc_feature: Encodes the peptide sequence at SEQ ID NO 19115
atggcgagttcccgcggtggcatcgacgagattctaggaattagtttggccacaatccagaaacacaacgaaccaagaatatcaaacaaggtttacatggctgcaagaaaggaaaggcctttgtttaccgctggccaagcaaccagtgtcagaataacaagatctcaggctgctgcaaatcgtacaagatctgggctggctccttatgtaccactacccctgaaaactgagtataaacatgcagtgaaaggaaagatgaaaagggaagcttcaggtgaaaatgctgatgctggagcttcagctcctcagcctaaaaggcgcacagttctcaagaatgtaactaacataagctgtgctaaaacttccaaaaggtgcaatactgtgactgggctgaagaaggttggacagagcataaacaagcaatgcacaaacaagatccccaagcttctccctctggctgttggggggagctcacttgtcaatgattctagtagtgctgaagaaacacaaaaggtagaccttttggcacagaaagagaagcagattgttttgcttaagggggctcagccattacacaatactgaacagaacaaagccggcgcttgtaatgagacattcgttgagggaagaaatgccaggaatgtacttgaaactgctgccttaaaggctggagtctctaatggtttaaacattgtagacattgacaaaaataatggtgatccccaaatgtgtgttacctacgttgcagagatatatagaaatctaatggcctcagagcttataagaagacctaggtcaaattacatggagactttgcaacaggacatcacagctagcatgcgaggtgttctaattgattggcttgttgaggtttctgaggaatataagcttgtggcagatacactttaccttgcagtacatcttattgaccaatttctttctcagaactgtattcagacacggaaactacaacttcttgggataactagtatgctgattgcctcgaaatatgaagagtattctgctcctagtgctgaagaattttgtaacataacagatagtacatatgcaaaggctgaggttctggaattggaacaacatgtgcttaatgatgtgggctttcatttatctgttccaacaacaaacacatttctcaggagattcctcagagcagcacaggcttcttgtatagctcctttggtccctttgacttatctggcgaattatctcgctgagttgactttaatcagctacggtttcctgaaatttcttccatcagtggtggcagcatcttcagttttccttgcaaaatggacgcttgaccaatctgaccatccttggaaccctactcttgagcactacacctcttacaaaagctccaatcttagaagttgcgtgcgggctctacaggaactgcagcacaataccagcaattgcccccttaacgccatccgtgaaaagtatgggcagcaaaagttcgagtgtgttgccaacctgaggtcaccggagctgctgcagtcactcttcagttga

SEQ ID NO: 19115 - protein, 510 aa, Sorghum bicolor
  misc_feature: Useful for making plants with modulated oxidative stress sensitivity
  misc_feature: Functional homolog of the protein sequence given in SEQ ID NO 13710
  misc_feature: Ceres ANNOT ID no. 8721897
  misc_feature (250)..(377): Pfam ID: Cyclin_N Pfam Description: Cyclin, N-terminal domain
  misc_feature (379)..(506): Pfam ID: Cyclin_C Pfam Description: Cyclin, C-terminal domain
MASSRGGIDEILGISLATIQKHNEPRISNKVYMAARKERPLFTAGQATSVRITRSQAAANRTRSGLAPYVPLPLKTEYKHAVKGKMKREASGENADAGASAPQPKRRTVLKNVTNISCAKTSKRCNTVTGLKKVGQSINKQCTNKIPKLLPLAVGGSSLVNDSSSAEETQKVDLLAQKEKQIVLLKGAQPLHNTEQNKAGACNETFVEGRNARNVLETAALKAGVSNGLNIVDIDKNNGDPQMCVTYVAEIYRNLMASELIRRPRSNYMETLQQDITASMRGVLIDWLVEVSEEYKLVADTLYLAVHLIDQFLSQNCIQTRKLQLLGITSMLIASKYEEYSAPSAEEFCNITDSTYAKAEVLELEQHVLNDVGFHLSVPTTNTFLRRFLRAAQASCIAPLVPLTYLANYLAELTLISYGFLKFLPSVVAASSVFLAKWTLDQSDHPWNPTLEHYTSYKSSNLRSCVRALQELQHNTSNCPLNAIREKYGQQKFECVANLRSPELLQSLFS

SEQ ID NO: 19116 - DNA, 630 bp, Sorghum bicolor
  misc_feature: Ceres ANNOT ID no. 8721881
  misc_feature: Encodes the peptide sequence at SEQ ID NO 19117
atgggtcgcggtcgcggcaaggtggaggtgcgtcggatcgacaacagcgtgagccggcaggtgactttctcgaagcggcggcgcgggctggccaagaaggcgcgggagctggccgtgctctgcgacgccgacgtcgcgctgctcatcttctccgacaagggcacgctccaccacttcgccgcgtacgccaggtacgggaacatgagctatgaccacgtcaagatgaggtccaaacttgaagctctacagaagagccaaaggaatctcatgggggagcaacttgagtccctgacattcagagaggtacagcagcttgagcaccagatagacagcgctctgaggaacatcagatcgaggaaggaaacatttctgatggaacaaaatagcattctagagaaggagaaggctgcactgggggcatcatccctgcacaccaccaacaccgcagattcctctacagcagtagcaacagctgcccttccaaacctcaacatctgtcccggcgacgactccgatgagccaggaagggcggcggcgccaccgccaccgggagcggcgatcagcttgccgtggtggatgctccagccaccacctgccgtcagccaacggcaagagcaggagcagcactga

SEQ ID NO: 19117 - protein, 209 aa, Sorghum bicolor
  misc_feature: The sequence is a functional homolog of SEQ ID NO 1701 in the 10/412,699 US patent application
  misc_feature: Ceres ANNOT ID no. 8721881
  misc_feature (11)..(61): Pfam ID: SRF-TF Pfam Description: SRF-type transcription factor (DNA-binding and dimerisation domain)
  misc_feature (51)..(153): Pfam ID: K-box Pfam Description: K-box region
MGRGRGKVEVRRIDNSVSRQVTFSKRRRGLAKKARELAVLCDADVALLIFSDKGTLHHFAAYARYGNMSYDHVKMRSKLEALQKSQRNLMGEQLESLTFREVQQLEHQIDSALRNIRSRKETFLMEQNSILEKEKAALGASSLHTTNTADSSTAVATAALPNLNICPGDDSDEPGRAAAPPPPGAAISLPWWMLQPPPAVSQRQEQEQH

SEQ ID NO: 19118 - DNA, 96 bp, Sorghum bicolor
  misc_feature: Ceres ANNOT ID no. 8722018
  misc_feature: Encodes the peptide sequence at SEQ ID NO 19119
atgtacaaagtccagtggaatcagtacaccgaagaggaggctatttgtaaaagagaagaggatctaagaaaaacatacccgcagtggtttgagtaa

SEQ ID NO: 19119 - protein, 31 aa, Sorghum bicolor
  misc_feature: The sequence is a functional homolog of SEQ ID NO 1584 in the 10/374,780 US patent application
  misc_feature: The sequence is a functional homolog of SEQ ID NO 1586 in the 10/374,780 US patent application
  misc_feature: The sequence is a functional homolog of SEQ ID NO 1585 in the 10/374,780 US patent application
  misc_feature: The sequence is a functional homolog of SEQ ID NO 1583 in the 10/374,780 US patent application
  misc_feature: Ceres ANNOT ID no. 8722018
MYKVQWNQYTEEEAICKREEDLRKTYPQWFE

SEQ ID NO: 19120 - DNA, 186 bp, Sorghum bicolor
  misc_feature: Ceres ANNOT ID no. 8722093
  misc_feature: Encodes the peptide sequence at SEQ ID NO 19121
atgggtcaaatcgagctggttcctatgggaccatacaagtaccaaagtgtcaccagcctgaacacgataacatactatggctacgccgagagcgtcttcaccattgaggtgaaaggtgagcaggatgttgtgatggtggagctcaggagcctcttatccaacattgtggaggtcccaagcaactga

SEQ ID NO: 19121 - protein, 61 aa, Sorghum bicolor
  misc_feature: Useful for biocontainment applications
  misc_feature: Functional homolog of the protein sequence given in SEQ ID NO 14361
  misc_feature: Ceres ANNOT ID no. 8722093
MGQIELVPMGPYKYQSVTSLNTITYYGYAESVFTIEVKGEQDVVMVELRSLLSNIVEVPSN

SEQ ID NO: 19122 - DNA, 1491 bp, Sorghum bicolor
  misc_feature: Ceres ANNOT ID no. 8722164
  misc_feature: Encodes the peptide sequence at SEQ ID NO 19123
atgtccgcgcgcccgccgccgccgccgcgcccgcgcctggcgctgccaccgcgctcggcggcggagtcgctcttcacgggcgccggcgacgccagcccgggcccgctcacgctcgcctcagcgctcttcccctcctctgacagcgacggcggcggaggcggaggcggaggcgccaactcctcctccggggccgcgacgaccttcacgcagctcctcaccggctccctcgcgccgcctccgcagcagcagcatgaggcggagaggggacgaggaggaggcggggtcgccagggccggcccggcgctctcggtggctccgccggcgtcggcgtccgctggcgcgtccgtcttcaccgtgccccccggcctcagcccctccggtttgctcgactcccctgggctgctcttctcgcccgccatggggggttttggaatgtcgcaccagcaggctctggctcaggtgacggcccaagcaacccattctccactcagaatgtttgatcaccttgaacagccatctttctccacagctgctacaacgtcgggagctctacagcatataaattctgcagccagtatggcaggaatttcagatatgacaatggcaacagcaaacaatgagaatgcatcatttcagtctgctgaggcatctcagaggtatcaagttaatgcccctgttgataagcctgctgatgatggctataactggcggaaatatggtcagaaggtggtaaagggcagtgattgtccaagaagctattacaaatgtactcatcccagttgtccggtcaagaaaaaggtagagcacgcagaggatggtcagatatctgagatcatatacaaaggcaaacacaatcaccaacgtccaccaaataagcgggcaaaagacggcaactcttcagcagctgatcaaaatgaacaatctaatgacaccacatctggcttgtcaggtgccaagagagatcaggacaatatatatgggatgtctgagcaagcatctggtttaagtgatggagatgatatggatgatggtgaatcaaggccacgcgaagcggatgatgctgataatgagagcaaaagaaggaatatacaaatttcttcacaaaggaccttgtcagagcctaagattattgttcaaacaaccagtgaggttgatcttttggatgatggttatagatggcgcaagtatggacagaaggtagtcaaagggaatcctcatccaaggagttactacaaatgcacatttgctggatgcaatgtcaggaagcacattgagagggcttcgtcagaccctaaggctgtcataacaacctatgaaggaaaacataaccatgaaccaccggttggtcggggcaacaaccagaatgcaggaatatcacaacagagagggcagaacaacatatctagtaatcaagcttcacttccgagaccagacttcagcaacactaaccagatgccgctagggatcttgcagttcaagagcgagcaatag

SEQ ID NO: 19123 - protein, 496 aa, Sorghum bicolor
  misc_feature: The sequence is a functional homolog of SEQ ID NO 202 in the 10/714,887 US patent application
  misc_feature: The sequence is a functional homolog of SEQ ID NO 202 in the 11/435,388 US patent application
  misc_feature: The sequence is a functional homolog of SEQ ID NO 86 in the 10/412,699 US patent application
  misc_feature: The sequence is a functional homolog of SEQ ID NO 140 in the 10/714,887 US patent application
  misc_feature: The sequence is a functional homolog of SEQ ID NO 140 in the 11/435,388 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8722164
  misc_feature: Up-regulated in shoot tissues in response to salicylic acid treatment
  misc_feature: Up-regulated in root tissues in response to salicylic acid treatment
  misc_feature (387)..(446): Pfam ID: WRKY Pfam Description: WRKY DNA -binding domain
  misc_feature (230)..(288): Pfam ID: WRKY Pfam Description: WRKY DNA -binding domain
MSARPPPPPRPRLALPPRSAAESLFTGAGDASPGPLTLASALFPSSDSDGGGGGGGGANSSSGAATTFTQLLTGSLAPPPQQQHEAERGRGGGGVARAGPALSVAPPASASAGASVFTVPPGLSPSGLLDSPGLLFSPAMGGFGMSHQQALAQVTAQATHSPLRMFDHLEQPSFSTAATTSGALQHINSAASMAGISDMTMATANNENASFQSAEASQRYQVNAPVDKPADDGYNWRKYGQKVVKGSDCPRSYYKCTHPSCPVKKKVEHAEDGQISEIIYKGKHNHQRPPNKRAKDGNSSAADQNEQSNDTTSGLSGAKRDQDNIYGMSEQASGLSDGDDMDDGESRPREADDADNESKRRNIQISSQRTLSEPKIIVQTTSEVDLLDDGYRWRKYGQKVVKGNPHPRSYYKCTFAGCNVRKHIERASSDPKAVITTYEGKHNHEPPVGRGNNQNAGISQQRGQNNISSNQASLPRPDFSNTNQMPLGILQFKSEQ

SEQ ID NO: 19124 - DNA, 351 bp, Sorghum bicolor
  misc_feature: Ceres ANNOT ID no. 8722172
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 19125
atggggcactccaacgtgtggaactcgcaccccaagaactacgggcccggatcccgcgtctgccgggtctgtgcgaaccctcatggattgatcaggaagtacgggctgatgtgctgcaggcagtgcttccgcagcaacgccaaggacattggcttcatcaaggattcatgtatgccacttaaaatgctgacaatcagctgtggtattttgttgaaatgtgccctatactttgctgctattcttttttataccgctgaaatcagctgggctaccagggtgaggtttggcatggaccctatgaggtcgaggtttgacatggaccctggtggtagatcaaggccgcaattttaa

SEQ ID NO: 19125 - protein, 116 aa, Sorghum bicolor
  misc_feature: Useful for making plants with modulated nitrogen use efficiency
  misc_feature: Functional homolog of the protein sequence given in SEQ ID NO 14091
  misc_feature: Ceres ANNOT ID no. 8722172
  misc_feature (3)..(56): Pfam ID: Ribosomal_S14 Pfam Description: Ribosomal protein S14p/S29e
MGHSNVWNSHPKNYGPGSRVCRVCANPHGLIRKYGLMCCRQCFRSNAKDIGFIKDSCMPLKMLTISCGILLKCALYFAAILFYTAEISWATRVRFGMDPMRSRFDMDPGGRSRPQF

SEQ ID NO: 19126 - DNA, 1020 bp, Sorghum bicolor
  misc_feature: Ceres ANNOT ID no. 8722246
  misc_feature: Encodes the peptide sequence at SEQ ID NO 19127
atgcggaatccaagagtgggaactgtgatgcttgggcagcaactgggcctgacggagtcctctctcctcacaaaatctaaccgcagagctgtacgaagcgatgatgtttctttgagaatctcgcactgtggagtctgttatgctgatgttatctggacacaaaacaaacatgagatagttggacaagtaacagaggttggatcagaagtcaagggcttcaaggttggtgaccatgtaggtgtgggaatctatgtaaactcgtgtggggactgtgaaaactgcaatagcttcacagagatccactgcccaaaaatggtggtcactttcaacggcatcgatgcggatggcactgtgacaatgggatgggaggatattccagtcacatatagtagtccgttctgcttcaaaatccctgatgatggctaccctttggctaaggctgggcctctgttatgtgctggaatcactgtatatactcccatgattcggcacaacatgaaccaacctggcaaatcacttggcgtgattggactgggtggattggggcacatggcagtgaaatttggaaaagcatttgggttgaaggtcaccgttttcagtacaagtgaatcaaagagagcccaagccattgatctccttggtgcagataattttgtattatcatccgacaagcaacagatggaggccctaaaaagctccctggacttcattattgacactgctgcgggtaaccacccgttcgatccctatctatcgcttctgaaagctggtggtataatgacgctagttggcttcccaagtgaaatcaatgtgcatcctggaagtgcacggaccctttctggcagtggaggtggaggaaccaagggggtccaagaaatgttgaacttttgtgcatcaaacaaaatatacccagaggttgaggtcattaaaatggactatatcaacgaggctctcaagaggcttataaaccgagatgtgaaataccgctttgtaatcgacatagagagctctttgaactag

SEQ ID NO: 19127 - protein, 339 aa, Sorghum bicolor
  misc_feature: Useful for making plants with altered cell wall content and/or composition
  misc_feature: Functional homolog of the protein sequence given in SEQ ID NO 13798
  misc_feature: Ceres ANNOT ID no. 8722246
  misc_feature (34)..(337): SWISSPROT Homolog: EC 1.1.1.195 Cinnamyl-alcohol dehydrogenase
  misc_feature (169)..(299): Pfam ID: ADH_zinc_N Pfam Description: Zinc-binding dehydrogenase
  misc_feature (33)..(137): Pfam ID: ADH_N Pfam Description: Alcohol dehydrogenase GroES-like domain
MRNPRVGTVMLGQQLGLTESSLLTKSNRRAVRSDDVSLRISHCGVCYADVIWTQNKHEIVGQVTEVGSEVKGFKVGDHVGVGIYVNSCGDCENCNSFTEIHCPKMVVTFNGIDADGTVTMGWEDIPVTYSSPFCFKIPDDGYPLAKAGPLLCAGITVYTPMIRHNMNQPGKSLGVIGLGGLGHMAVKFGKAFGLKVTVFSTSESKRAQAIDLLGADNFVLSSDKQQMEALKSSLDFIIDTAAGNHPFDPYLSLLKAGGIMTLVGFPSEINVHPGSARTLSGSGGGGTKGVQEMLNFCASNKIYPEVEVIKMDYINEALKRLINRDVKYRFVIDIESSLN

SEQ ID NO: 19128 - DNA, 1182 bp, Sorghum bicolor
  misc_feature: Ceres ANNOT ID no. 8722300
  misc_feature: Encodes the peptide sequence at SEQ ID NO 19129
atggctgctgctgcttcctgcatagcttgcaatggcggcagcgctgatgcgaaggaggagaagcacaagtgtgagctcatcaggtacgaagcactgccggagtggctcaaggacaacgagttcatccatggctactaccgctgcgagtggccgatgaaggagaccatcctcagcatcttctccatccacaacgagaccctcaatgtttggtcgcatttgatcgggttcctgctgttcctgtgcctgacaatcttcacagcaatggtgatcccaaggagcggcagcagcagcaggagcagcactgcataccagctgggagatctggtggagatggccagggccaacatgacggtagcgctgaggcatgaggcacttgcagcgtgtttcctgctgccaccatctgctgctgctgcttcagctgctttgtctgaagatggtcagcagatcccaaccagctgtccacccaacacttcctcctcctcctcccatcatcatgccatccagatccagggcagcactggtaatacgtcggtcaccaaggacgccggcgccgccatcgccaccgcggctgccgaccccatcacgcggtggccgctattcgcgtacctgggcggcgcgatggtgtgcctgctgacgagcagcgcgtgccacctgatcctgtgccactcggagcgcacggcgtacgtgacgctgcggctggactacgccggcatcgccgcgctgatcgtcacctccttctacccgctggcctactactccttcctctgcgcgccggcgctgcagcggctgtacatgggctccatcacggcgctgggggccgccgccgtgacggcgtcgctggtgccggcgttccaggcgcccgagctgcgcccgctccgcgccgcgctcttctcctgcatgggcgcgtcgggcgtcgtccccatcgcgcacaagctgctcctctacggcggcaccgcgccgggcgccgtggcgtcggcgggctacgaggcgctcatgggcgcgctctacgcgctcggcgtcgccgtgtacgccgcgcgcgtcccggagcggtgggcgccgggcaggttcgacctcgtcggacacagccaccagctgttccacctcttcgtcatcgccggcgcctacgcgcactacctcgccggagtcgagtacctcaagtggagggacgtcgacaaatgctag

SEQ ID NO: 19129 - protein, 393 aa, Sorghum bicolor
  misc_feature: Useful for making plants with altered cell wall content and/or composition
  misc_feature: Functional homolog of the protein sequence given in SEQ ID NO 13986
  misc_feature: Useful for making plants with altered carbohydrate content
  misc_feature: Functional homolog of the protein sequence given in SEQ ID NO 13987
  misc_feature: Ceres ANNOT ID no. 8722300
  misc_feature (60)..(378): Pfam ID: HlyIII Pfam Description: Haemolysin-III related
MAAAASCIACNGGSADAKEEKHKCELIRYEALPEWLKDNEFIHGYYRCEWPMKETILSIFSIHNETLNVWSHLIGFLLFLCLTIFTAMVIPRSGSSSRSSTAYQLGDLVEMARANMTVALRHEALAACFLLPPSAAAASAALSEDGQQIPTSCPPNTSSSSSHHHAIQIQGSTGNTSVTKDAGAAIATAAADPITRWPLFAYLGGAMVCLLTSSACHLILCHSERTAYVTLRLDYAGIAALIVTSFYPLAYYSFLCAPALQRLYMGSITALGAAAVTASLVPAFQAPELRPLRAALFSCMGASGVVPIAHKLLLYGGTAPGAVASAGYEALMGALYALGVAVYAARVPERWAPGRFDLVGHSHQLFHLFVIAGAYAHYLAGVEYLKWRDVDKC

SEQ ID NO: 19130 - DNA, 333 bp, Sorghum bicolor
  misc_feature: Ceres ANNOT ID no. 8722349
  misc_feature: Encodes the peptide sequence at SEQ ID NO 19131
atggcgatccaggggaaactgttatgtttgattcttcatgctaaactaattccatttacattctcccagactacttcaaggcgtcttgctgacaggaagagcgccaagttccagaagaacatcacaaagaggggttctgtgcctgagactacggtgaaaaagggaaatgactaccctgttggaccgatagtgcttggattcttcatttttgtggtcattggatcatgtaagcatcgcaccaagcctttgctagccttgaaactgtatctcttgcattttggagtttttttagtcttttcagcttatggttatttaaacgtcaacacatcataa

SEQ ID NO: 19131 - protein, 110 aa, Sorghum bicolor
  misc_feature: Useful for making plants with modulated nitrogen use efficiency
  misc_feature: Functional homolog of the protein sequence given in SEQ ID NO 13037
  misc_feature: Ceres ANNOT ID no. 8722349
  misc_feature (23)..(81): Pfam ID: RAMP4 Pfam Description: Ribosome associated membrane protein RAMP4
MAIQGKLLCLILHAKLIPFTFSQTTSRRLADRKSAKFQKNITKRGSVPETTVKKGNDYPVGPIVLGFFIFVVIGSCKHRTKPLLALKLYLLHFGVFLVFSAYGYLNVNTS

SEQ ID NO: 19132 - DNA, 1041 bp, Sorghum bicolor
  misc_feature: Ceres ANNOT ID no. 8722479
  misc_feature: Encodes the peptide sequence at SEQ ID NO 19133
atgacgccgacgtcgtcgccaccgctcgtcgtcgtccgcctccttgcgtcggccgtggcgacgatgctggtgctcgcgtccggcggcggcgtttgcgacggcgccgcgctgaaggcgcacttctaccggcgcagctgccccgcggcggaggctgtggtccgcgacatcgtggtggcgcgcgtcgccgccgaccccgccgcgctccccgccaagctgctccgcctcttcttccacgactgcttcgtcagggggtgcgacgcgtcggtgctgctggactcgacggcggggaacacggcggagaaggacgcggcgccgaacgggtcgctgggaggcttcgacgtgatcgacacggcgaaggccgtgctggaggccatctgcccaggcaccgtctcctgcgccgacatcgtggcgctcgccgccagggacgccgtgtcgctgcagctcgggcgggacctgtgggacgtgcagctggggcggcgcgacggcgtggtgtcgcgggcgtcggaggcgctggccgacatcccttcgccgtcggacaacttcaccaccctcgaggccagattcggcagcaaaggcctcgacgtcaaggacctcgtcatcctctcaggcgcgcacacgatcggcgtggcccactgcaacaccttcgcgtcacgcctctccggcttcggcagctccaactccggcgccgacccgacgctgaacgcggcgtacgcggcgcagctccggtcgcggtgcggtccggcgccggtggcctcgtcgaacaacgtgacggcggtgaccatggacccgggaagccccgcggggcggttcgacgcgcactactacgtgaacctgaagctggggcggggcctgttcgcgtccgacgccgcgctgctcgccgaccgccgcgccgccgccatgatccaccgcctcaccaggaagggctacttcctccaggagttcaggaacgccgttcgcaagatggggcgcgtcggcgtgcgcaccggcggccgcggggagatccgccggaactgcagggcggtcaactcagatgctatgtga

SEQ ID NO: 19133 - protein, 346 aa, Sorghum bicolor
  misc_feature: Useful for making plants with altered carbohydrate content
  misc_feature: Functional homolog of the protein sequence given in SEQ ID NO 13626
  misc_feature: Ceres ANNOT ID no. 8722479
  misc_feature (35)..(343): SWISSPROT Homolog: EC 1.11.1.7 Peroxidase
  misc_feature (53)..(307): Pfam ID: peroxidase Pfam Description: Peroxidase
MTPTSSPPLVVVRLLASAVATMLVLASGGGVCDGAALKAHFYRRSCPAAEAVVRDIVVARVAADPAALPAKLLRLFFHDCFVRGCDASVLLDSTAGNTAEKDAAPNGSLGGFDVIDTAKAVLEAICPGTVSCADIVALAARDAVSLQLGRDLWDVQLGRRDGVVSRASEALADIPSPSDNFTTLEARFGSKGLDVKDLVILSGAHTIGVAHCNTFASRLSGFGSSNSGADPTLNAAYAAQLRSRCGPAPVASSNNVTAVTMDPGSPAGRFDAHYYVNLKLGRGLFASDAALLADRRAAAMIHRLTRKGYFLQEFRNAVRKMGRVGVRTGGRGEIRRNCRAVNSDAM

SEQ ID NO: 19134 - DNA, 3678 bp, Sorghum bicolor
  misc_feature: Ceres ANNOT ID no. 8722889
  misc_feature: Encodes the peptide sequence at SEQ ID NO 19135
atgtcgcggcggctgtcgctgccggcggggtcgcaggtaacggtgacggtgtcaccgacgaggggcaaggcggcggagagccccggggatggggtgatcaagaggagcggcggcggcgggatcgggctcacgagcccggcgccgaggcactcgctcgggggagcgttggcgtcgtccaccaccgtcgccacgctgcagctctcgcccgtgcgccgcagctgggggagccgctacgcgtcgcttgacggcggagccggcgtgggcgacagcgccgagttcgtgcactacaccgtgcacatcccgcccacgccggagcggaacgtggcggcgtccgctgactccatcgacgagccggcgccggctgcgtaccaggacggcggcgcggcggcggaggtgcgcccgccgcagaggagctacatctccgggaccatcttcactggcgggctcaaccaggccacgcgcggccacgtgctcaacacctccggcaacagcaccgcggtcgcggcctccggtaacatgtcgtgcaagatgcgcggctgcgacatgccggcgttcctggcctccggcgccggcgccggcggcgggccgtgcgactgcggcttcatgatctgccgcgagtgctacgcggactgcgtcgcggccgcggggaactgccccggctgcaaggagccatactctgcggggagcgacactgatgacgacgacgtcgacggcgaggatgacgaggccgtctcctcgtctgaggagagggaccagctgccgctcacgtccatggcgaagcgcttctccatcatgcattccgtgaagattcccagcaacaacggcggcggcggcggcaagccggccgagttcgaccacgcgcgctggctcttcgagaccaagggcacctacggctacggcaacgcgctctggcccaaggacgggaacggcggcggcggcttcgctgggttcgaggagcccccgaacttcggctcccgctgccgccggccgctcaccaggaagaccagcgtctctcaggccatcctcagtccttacaggctgctgatcgcaatccgtctggtggcgctggggttcttcctgacatggcgcattcggcacccgaacccggaggcggtgtggctgtgggcgctgtcggtgacgtgcgaggtctggttcgccttctcctggcttctcgacagcctccccaagctctgcccgatccaccgggccgccgacctggacgtcctcgccgagcgcttcgagctgcccacggcgcgcaaccccaagggccactccgacctgcccggcatcgacgtcttcgtctccaccgccgacccggagaaggagccgccgctcgtcaccgccaacaccatcctctccatcctcgccgccgactacccggtcgagaagctcgcctgctacctctccgacgacggcggcgcgctgctcaccttcgaggcgctcgccgagaccgcaagcttcgcccgcacctgggtgccgttctgccgcaagcacggcgtcgagccgcgctgcccggaggcctacttcggccagaagagggacttcctcaggaacaaggtgcgcgtggatttcgtccgggagcggcggaaggtgaagcgggagtacgacgagttcaaggtgagggtgaactcgctgccagaggccatccgccggcgctccgacgcgtacaacgccggcgaggagctgcgtgccaggagaatgcagcaggaggaggccatggccgccggcacccttcccggagctttgcctgaggcagcggcggccgtgaaggcgacatggatgtccgacggctcgcagtggcctggcacttggctcacctctgcgccagatcactcccgtggtgaccacgccggcatcattcaggcaatgcttgcgcctccgacttcagagcctgtgctgggcgcggagccggcggagtccggcgggctgatcgacacgacgggcgtggacatccggctgccgatgctggtgtacgtgtcccgcgagaagcgcccggggtacgaccacaacaagaaggccggcgccatgaacgcgctggtgcgcacgagcgccatcatgtcgaacgggcccttcatcctcaacctggactgcgaccactacgtgcacaactcggcggcgctccgggaagggatgtgcttcatgctggaccgcggcggcgaccgcgtctgctacgtccagttcccgcagcggttcgagggcatcgaccccaacgaccggtacgccaaccacaacctcgtcttcttcgacgtcgccatgcgcgccatggacgggctgcagggccccatgtacgtcggcacgggctgcgtcttccgccgcaccgcgctgtacgggttcagcccgccgcgcgccacggagcaccacggctggctcgggaggaagaagatcaagctgttcctgaggaagcccaccatggggaagaagacggacagggagaacaacaacgacagggagatgatgctgccgccgatcgaggacgacgccttccagcagctcgacgacatcgagtcgtccgcgctgctcccgcggcggttcggcagctcggcaacgttcgtggcgtccatccccgtggcggagtaccaggggcggctcctgcaggacacgcccggcgcgcaccagggccgccccgccggcgcccttgccgtgccccgcgagccgctcgacgcggcgaccgtcgccgaggccatcagcgtcatctcgtgcttctacgaggacaagacggagtgggggcggcgcatcgggtggatctacgggtcggtgacggaggacgtggtgacggggtaccggatgcacaaccgcgggtggcggtccgtgtactgcgtgacgcggcgcgacgcgttccggggcacggcgcccatcaacctcaccgaccgcctccaccaggtgctccggtgggcgacggggtccgtggagatcttcttctcccgcaacaacgcgctgttcgcgtcgccgcggatgaagctcctccagcgggtggcctacttcaacgtcggcatgtacccgttcacctccgtcttcctcctcgtctactgcgtgctcccggccgtctccctcttctccggcaagttcatcgtgcagtcgctcaacgccacgttcctggcgctgctgctcgtcatcaccgtcacgctctgcatgctggcgctgctggagatcaagtggtccgggatcacgctgcacgagtggtggcggaacgagcagttctgggtgatcggcggcaccagcgcgcacccggcggccgtgctgcagggcctcctcaaggtgatcgccggcgtggacatctccttcacgctgacgtccaagccggggggcgccggcgacgacggcgaggaggaggcgttcgcggagctgtacgaggtgcggtggagcttcctgatggtgccgcccgtgacgatcatgatggtgaacgcggtggcggtggcggtggcgtcggcgcgcacgctgtacagcgagttcccgcagtggagcaagctgctgggcggcgccttcttcagcttctgggtgctgtgccacctctacccgttcgccaagggactcctgggccgccgcggccgtgtgccgaccatcgtgttcgtctggtcggggctcatctccatgaccatctcgctgctctgggtctacatcagccctcctgcgggcgccagggagctcatcggcggcggcggcggattcagcttcccgtag

SEQ ID NO: 19135 - protein, 1225 aa, Sorghum bicolor
  misc_feature: Useful for making plants with altered cell wall content and/or composition
  misc_feature: Functional homolog of the protein sequence given in SEQ ID NO 14688
  misc_feature: Useful for making plants with altered carbohydrate content
  misc_feature: Functional homolog of the protein sequence given in SEQ ID NO 13628
  misc_feature: The sequence is a functional homolog of SEQ ID NO 6 in US patent 7285702
  misc_feature: Useful for making plants with modulated plant growth and development
  misc_feature: Functional homolog of the protein sequence given in SEQ ID NO 13629
  misc_feature: Ceres ANNOT ID no. 8722889
  misc_feature (642)..(1208): SWISSPROT Homolog: EC 2.4.1.12 Cellulose synthase (UDP-forming)
  misc_feature (330)..(1216): Pfam ID: Cellulose_synt Pfam Description: Cellulose synthase
MSRRLSLPAGSQVTVTVSPTRGKAAESPGDGVIKRSGGGGIGLTSPAPRHSLGGALASSTTVATLQLSPVRRSWGSRYASLDGGAGVGDSAEFVHYTVHIPPTPERNVAASADSIDEPAPAAYQDGGAAAEVRPPQRSYISGTIFTGGLNQATRGHVLNTSGNSTAVAASGNMSCKMRGCDMPAFLASGAGAGGGPCDCGFMICRECYADCVAAAGNCPGCKEPYSAGSDTDDDDVDGEDDEAVSSSEERDQLPLTSMAKRFSIMHSVKIPSNNGGGGGKPAEFDHARWLFETKGTYGYGNALWPKDGNGGGGFAGFEEPPNFGSRCRRPLTRKTSVSQAILSPYRLLIAIRLVALGFFLTWRIRHPNPEAVWLWALSVTCEVWFAFSWLLDSLPKLCPIHRAADLDVLAERFELPTARNPKGHSDLPGIDVFVSTADPEKEPPLVTANTILSILAADYPVEKLACYLSDDGGALLTFEALAETASFARTWVPFCRKHGVEPRCPEAYFGQKRDFLRNKVRVDFVRERRKVKREYDEFKVRVNSLPEAIRRRSDAYNAGEELRARRMQQEEAMAAGTLPGALPEAAAAVKATWMSDGSQWPGTWLTSAPDHSRGDHAGIIQAMLAPPTSEPVLGAEPAESGGLIDTTGVDIRLPMLVYVSREKRPGYDHNKKAGAMNALVRTSAIMSNGPFILNLDCDHYVHNSAALREGMCFMLDRGGDRVCYVQFPQRFEGIDPNDRYANHNLVFFDVAMRAMDGLQGPMYVGTGCVFRRTALYGFSPPRATEHHGWLGRKKIKLFLRKPTMGKKTDRENNNDREMMLPPIEDDAFQQLDDIESSALLPRRFGSSATFVASIPVAEYQGRLLQDTPGAHQGRPAGALAVPREPLDAATVAEAISVISCFYEDKTEWGRRIGWIYGSVTEDVVTGYRMHNRGWRSVYCVTRRDAFRGTAPINLTDRLHQVLRWATGSVEIFFSRNNALFASPRMKLLQRVAYFNVGMYPFTSVFLLVYCVLPAVSLFSGKFIVQSLNATFLALLLVITVTLCMLALLEIKWSGITLHEWWRNEQFWVIGGTSAHPAAVLQGLLKVIAGVDISFTLTSKPGGAGDDGEEEAFAELYEVRWSFLMVPPVTIMMVNAVAVAVASARTLYSEFPQWSKLLGGAFFSFWVLCHLYPFAKGLLGRRGRVPTIVFVWSGLISMTISLLWVYISPPAGARELIGGGGGFSFP

SEQ ID NO: 19136 - DNA, 1566 bp, Sorghum bicolor
  misc_feature: Ceres ANNOT ID no. 8722935
  misc_feature: Encodes the peptide sequence at SEQ ID NO 19137
atggcggccacctccgccgccgttctgtccgccgccgcccgcctgatctcacgctcggcggcggcggcggccagctctggcggttgcgctcatctgctgtccgccgccaaacggatgatgtcgtcgcgctcggcgtcctccatcatcacgcgcgaggtgacggggcaccacaacctgaccatcagcggctacgcggcgacgaggaaggcccccgtggagtggatcgcgtcgtcgcaggcgttcgacgcggcgggctaccgctggcggatcaagtacgaccccaacggcaacagctggaacgagtccaacgagtgcatctccatcttcgtcgagctcgcccacgacaacaggggcccccgccaggaggtcaaggaccccgtccagttcaagctcagcctgctggaccgcgccggcaacccgtcccccaagtactgccgctccaacgacgccagcttcttcgtcgacgggcaggcgcggttccaggacttcatccgctggaaggacctcgaggagtccggctgcctcaaagacgacagcttcatcgtccgctgcgacatcaccgtcatcaggaagtgggccgagggcgacgacggcagcgtcggcgtcggcggcgtcgacggcgcgtcgtcgtcccgcgtcgtcgtgccgccgtccgacctgcacaaggacctctacgacatgctgtggaagaagcagggcgtggacgtcgcgatcgacgtcgccggggagacgttcgaggcgcacgggtggctgctggcggcgcggtccccggccttcgaggcggagctgctcgccgcgcccaaggagaaggagaaggcggctgcgtccggcggggccgtccgtcgccgcgtcgagatccgcggcatggagccccaggtgttcaaggcgctgctccacttcatgtacaccgacgcgctgccggcgtccatgatggaggcggcgcaggacaagcagcgcgccgtgggaatggcccgggatctgatcgcggcggcgcaccggtacaagctcgagaggctcaagctcttgtgcgaggagatgctgtgccggcgcatcgacgtggacacggtggccgggaccatggccgtggcggagcagcacggctgcggcgctctcgaggcagcgtgcgccgaattcctcgcgcggccggggaacctgaaagccgtcatggagacggaagggtacgagaagataaaagccaaccccactatgatggatcttatcatgaagcaattggggcacgtccaacatggtggaaatcaggtgtgcaagtggcaaatccaagcactgcttgggttcctctgcctcgacacgcatacaacggcggtggttggatctcgtgtgctggggcgctctagtggctggatcctggggcatggcctgctacctggcgacgggatctcaaagtgtaagctagggaggggcaaggttgacataaagtgcatcgagaacacgatgaaccagcatgtcaccttttgcaagtgtcgcaacggcgcctatgagctctcggtgctctgcaattccgaggttgtgctcatcgtcttatccagcagtggcttcctctactag

SEQ ID NO: 19137 - protein, 521 aa, Sorghum bicolor
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: Ceres ANNOT ID no. 8722935
  misc_feature (224)..(351): Pfam ID: BTB Pfam Description: BTB/POZ domain
  misc_feature (479)..(521): Pfam ID: SRF-TF Pfam Description: SRF-type transcription factor (DNA-binding and dimerisation domain)
MAATSAAVLSAAARLISRSAAAAASSGGCAHLLSAAKRMMSSRSASSIITREVTGHHNLTISGYAATRKAPVEWIASSQAFDAAGYRWRIKYDPNGNSWNESNECISIFVELAHDNRGPRQEVKDPVQFKLSLLDRAGNPSPKYCRSNDASFFVDGQARFQDFIRWKDLEESGCLKDDSFIVRCDITVIRKWAEGDDGSVGVGGVDGASSSRVVVPPSDLHKDLYDMLWKKQGVDVAIDVAGETFEAHGWLLAARSPAFEAELLAAPKEKEKAAASGGAVRRRVEIRGMEPQVFKALLHFMYTDALPASMMEAAQDKQRAVGMARDLIAAAHRYKLERLKLLCEEMLCRRIDVDTVAGTMAVAEQHGCGALEAACAEFLARPGNLKAVMETEGYEKIKANPTMMDLIMKQLGHVQHGGNQVCKWQIQALLGFLCLDTHTTAVVGSRVLGRSSGWILGHGLLPGDGISKCKLGRGKVDIKCIENTMNQHVTFCKCRNGAYELSVLCNSEVVLIVLSSSGFLY

SEQ ID NO: 19138 - DNA, 576 bp, Sorghum bicolor
  misc_feature: Ceres ANNOT ID no. 8722987
  misc_feature: Encodes the peptide sequence at SEQ ID NO 19139
atggcggcggcggtggcggcgtcggcgtcgacgccgcagggggtggcggagcggcggggcatcccggcggcggcgttcgtcgaggacgtcgaggcctacctccgacaggccgggctcgacgtcaactccgccctcgccttcctccaggaaaggttgcagcagtacaaaatagtggagatgaagcttctagcacaacaaagggatcttcaggcaaagattcctgatatagagaagtgcttggatattgttgcaacattacaagctaaaaaggatttgggtgaggcactcatagctgatttcgaattatctgagggaatctactcccgtgcgaaaattgaggataccgactcggtgtgcctttggttaggtgcaaatgtgatgctggagtactcttgcgacgaggccaatgccctcttgaagaaaaacttggaaaatgccaaggccagcttagaagtccttgttgctgatcttcagttcttgcgagaccaacaaaccatcactcaggttacaattgctcgggtattcaactgggatgtacaccaacggagaagcaaacaagccataaaagaaacttga

SEQ ID NO: 19139 - protein, 191 aa, Sorghum bicolor
  misc_feature: Useful for making plants with modulated nitrogen use efficiency
  misc_feature: Functional homolog of the protein sequence given in SEQ ID NO 14689
  misc_feature: Ceres ANNOT ID no. 8722987
  misc_feature (55)..(177): Pfam ID: Prefoldin Pfam Description: Prefoldin subunit
MAAAVAASASTPQGVAERRGIPAAAFVEDVEAYLRQAGLDVNSALAFLQERLQQYKIVEMKLLAQQRDLQAKIPDIEKCLDIVATLQAKKDLGEALIADFELSEGIYSRAKIEDTDSVCLWLGANVMLEYSCDEANALLKKNLENAKASLEVLVADLQFLRDQQTITQVTIARVFNWDVHQRRSKQAIKET

SEQ ID NO: 19140 - DNA, 786 bp, Sorghum bicolor
  misc_feature: Ceres ANNOT ID no. 8723115
  misc_feature: Encodes the peptide sequence at SEQ ID NO 19141
atgggtcgcgtgatccgcgcgcagcgtaagggtgcggggtccgtcttcaagtcccacacccaccaccgcaagggccccgcccggttccgctccctcgacttcggcgagcgcaacgggtacctcaagggcgtcgtcaccgacgtcatccacgacccgggccgcggcgcgccgctcgccaaggtcaccttccgccaccccttcaggtacaagcaccagaaggagctcttcgtcgccgccgagggcatgtacacgggccagttcgtctactgcggccgccgcgccacgctctccatcggcaacgtcctgccgctccgcgggatccccgagggtgccgtcgtctgcaacgtcgagcaccacgtcggtgaccgtggtgtcttcgccagggcctctggggactacgccatcgtgatcagccacaaccctgacaacggcacctcgaggattaagctaccctctggtgccaagaagattgtccccagcagctgccgtgccatgattgggcaggtcgctggtggaggcaggactgagaagccgatgctgaaggctggtaacgcgtaccacaagtaccgtgtgaagaggaactgctggcctaaggtgcgtggtgtggccatgaaccctgtggagcatccccacggaggaggtaaccaccagcacattggtcacgcctccaccgtccgccgtgacgctccccctggccagaaggtcggtctcattgctgccaggaggactggaaggctcaggggacaggctgctgccactgccgccaaggctgacaaggccacctag

SEQ ID NO: 19141 - protein, 261 aa, Sorghum bicolor; identical to SEQ ID NO: 15913
  misc_feature: Useful for making plants with modulated nitrogen use efficiency
  misc_feature: Functional homolog of the protein sequence given in SEQ ID NO 14286
  misc_feature: Ceres ANNOT ID no. 8723115
  misc_feature (96)..(231): Pfam ID: Ribosomal_L2_C Pfam Description: Ribosomal Proteins L2, C-terminal domain
  misc_feature (11)..(90): Pfam ID: Ribosomal_L2 Pfam Description: Ribosomal Proteins L2, RNA binding domain

SEQ ID NO: 19142 - DNA, 1950 bp, Sorghum bicolor
  misc_feature: Ceres ANNOT ID no. 8723145
  misc_feature: Encodes the peptide sequence at SEQ ID NO 19143
atggccggcaagggagacgggccggcgatcggcatcgacctcggcacgacctactcgtgcgtcggcgtgtggcagcacgaccgtgtcgagatcatcgccaacgaccaggggaaccgcaccacgccctcgtacgtcgccttcaccgactccgagcgcctcatcggagatgcggccaagaaccaggtcgccatgaaccccatcaacaccgtctttgatgccaagcggctcatcggcaggaggttctctgatgcttctgtccagagtgatatcaagctctggcccttcaaggtcatttctgggcctggtgagaagccaatgattgttgtccagcacaagggtgaggagaagcagtttgcagctgaggagatctcctctatggttctcatcaagatgcgtgagatcgctgaagcttaccttggcagcacgatcaagaatgctgttgtcacagtccctgcctacttcaacgactcacagaggcaggccacaaaggatgctggggtgattgctggcctcaacgtcctccgtatcatcaatgagccaactgctgctgctatcgcctatggtcttgacaagaaggcaaccagtgttggcgagaagaatgtcctcatctttgaccttggaggtggtaccttcgatgtctccctcctcaccattgaggaaggcatctttgaggtcaaggccacagctggtgacacccatctgggtggtgaggactttgacaacaggatggtgaaccacttcgtccaggagttcaagaggaagaacaagaaggacatcactggcaacccgagggctctcaggaggctgaggactgcttgtgagagggcgaagaggactctatcttccactgctcagaccaccattgagatcgactctctgtacgagggcatcgacttctactccaccatcacccgtgccaggtttgaggagctcaacatggacctgttcaggaagtgcatggagcccgtggagaagtgcctgagggatgccaagatggacaagagcagcgtgcacgacgttgtccttgttggtggctccacccgtatccccagggtgcagcagctgctccaggacttcttcaacggcaaggagctgtgcaagaacatcaaccccgatgaggccgtcgcctacggtgccgctgtccaggccgccatcctgagcggcgagggcaacgagaaggtgcaggacctgcttctgctggacgtcacccctctctcccttggcctggagaccgccggaggagtgatgaccgtgctgatcccgaggaacaccaccatccccaccaagaaggagcaggtgttctccacctactcggacaaccagcctggtgtcctgatccaggtgtacgagggcgagaggacacggacccgcgacaacaacctgctgggcaagttcgagctctccggcatcccccctgcgccccgtggtgtgccccagatcacggtgtgcttcgacatcgacgccaacggcatcctgaacgtctcggccgaggacaagacgaccgggcagaagaacaagatcaccatcaccaacgacaagggccgtctgtccaaggaggagatcgagaagatggtgcaggacgcggagaagtacaagtcggaggacgaggagcacaagaagaaggtggaggccaagaactcgctggagaactacgcctacaacatgcgcaacacgatcaaggacgagaagatcgcgtccaagctggccggcgacgacaagaagaagatcgaggacgccatcgacgcggccatctcgtggctggacgccaaccagctcgccgaggcggacgagttcgaggacaagatgaaggagctcgagtcgctgtgcaaccccatcatcgccaagatgtaccagggcgcgggcgccgacatgggcggcgccggcggcatggacgaggacgcacccgcgggcagcggcggccctggccccaagatcgaggaggtcgactaa

SEQ ID NO: 19143 - protein, 649 aa, Sorghum bicolor
  misc_feature: Useful for making plants with modulated drought sensitivity
  misc_feature: Useful for making plants with modulated heat sensitivity
  misc_feature: Functional homolog of the protein sequence given in SEQ ID NO 14080
  misc_feature: Ceres ANNOT ID no. 8723145
  misc_feature: Down-regulated in root tissues in response to methyl jasmonate treatment
  misc_feature: Up-regulated in root tissues in response to salicylic acid treatment
  misc_feature: Down-regulated in shoot tissues in response to aminocyclopropane carboxylic treatment
  misc_feature: Down-regulated in shoot tissues in response to salicylic acid treatment
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (9)..(618): Pfam ID: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQHKGEEKQFAAEEISSMVLIKMREIAEAYLGSTIKNAVVTVPAYFNDSQRQATKDAGVIAGLNVLRIINEPTAAAIAYGLDKKATSVGEKNVLIFDLGGGTFDVSLLTIEEGIFEVKATAGDTHLGGEDFDNRMVNHFVQEFKRKNKKDITGNPRALRRLRTACERAKRTLSSTAQTTIEIDSLYEGIDFYSTITRARFEELNMDLFRKCMEPVEKCLRDAKMDKSSVHDVVLVGGSTRIPRVQQLLQDFFNGKELCKNINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKMVQDAEKYKSEDEEHKKKVEAKNSLENYAYNMRNTIKDEKIASKLAGDDKKKIEDAIDAAISWLDANQLAEADEFEDKMKELESLCNPIIAKMYQGAGADMGGAGGMDEDAPAGSGGPGPKIEEVD

SEQ ID NO: 19144 - DNA, 1761 bp, Sorghum bicolor
  misc_feature: Ceres ANNOT ID no. 8723180
  misc_feature: Down-regulated in root tissues in response to methyl jasmonate treatment
  misc_feature: Up-regulated in root tissues in response to salicylic acid treatment
  misc_feature: Down-regulated in shoot tissues in response to aminocyclopropane carboxylic treatment
  misc_feature: Down-regulated in shoot tissues in response to salicylic acid treatment
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 19145
atggcgggcgtgcaagcatcggcggtgctgcgggccggcaggtggctcctgccgctcaccatcccagcgtgctgcgtcgtgtggatgctcctcgtcttctcgcctccgacgcccgagctcgacgcgggccaccgccagagtttccacgtgatcgtcggggagaccgtggccgcgattgagcgtcggggcacgccgcccgtgctcgagcgtgtacaagagtcaccgccgccggcggagcttctagcaagaacaaaaaccccatcgtcgtcgccgccaccgtcgccggagagcgaagagaccattgacacgtctccgccgtctccggaacgccgaccaagagcacagcccaaacaaccgctgccgccggagcgtgaacggatccttgacgcgtcgtcacagccggagctggctccagtgcggcaatcaagaacagggattccagcttcgccaccgccgccgcagccgtctcatcagcatttgtcgagggcccagacgaagccggcggccgtgtccgatcggtgcgccggccggtacatctacgtccaggacctgccaagccggttcaacgccgacctgctccgcgactgccgttcactctcggagtggacggacatgtgcaggcacgtcgccaacgccggcatgggcccgcggctgacgcgcaccggcggcgtgctcccgcccacgggctggtacgacacgaaccagttcaccctcgaggtcatcttccacaacaggatgcggcagtacggctgcctcaccgccgacgcctcccgcgcgtccgcggtctacgtgccctactacgcggggctcgacgtcggccggcacctgtgggggttcagcaacgacgtgcgcgacgccctcgccgaggacctcgtgggctggctccggtcgtcgcccgcgtgggcggcgcacggcgggcgtgaccacttcctcgtcggcggccgcatcgcgtgggacctccgtcgcgaggacggcggcgagtggggcagccgcctgctgttcctcccggaggcgaggaacatgacggcgctggtgctcgagtccggcccgtggcacgtcggcgacgtgggcgtgccgtacccgacctacttccacccgtcgcgcgccgccgaggtggcctcctggcagcggacactccggcgcgcgcggcggccctggctgttcgcgttcgtcggcgcgcggcgtcccggcgacacactgcgcgacagcgtgatggaccagtgcgcgcggtcccggcggtgcgggctgctgcagtgcggccgggggcggcgtagggactgctacgcccccggcaacgtcatgcgccatctcaagagcgcggccttctgcctgcagccgccgggggactcgtacacgcggcggtcggcgttcgacgccatgctcgccggctgcgtgccggtgttcttccacccgggctcggcttacacgcagtacaggtggcacctgccggccgaccacaccaggtactcggtgtttgtgccgggggacagcgtgcgcaacggcaccgtgcgcgtggtggacgtgctccggcggttcggccggtcacaagtggcggcgatgagggagcaggtgatccggatgatacccggcatcgtgtacagggacccgagggctccctccggggagttcagggacgcctttgatgtggcggtcgacggcttaatcaggagggtcagcagaatcaagcaggggctgcctccaggggaggaggaggacgacgacggcagccgccattgggatggctacttcgacacgcggtga

SEQ ID NO: 19145 - protein, 586 aa, Sorghum bicolor
  misc_feature: Useful for making plants with altered cell wall content and/or composition
  misc_feature: Functional homolog of the protein sequence given in SEQ ID NO 14690
  misc_feature: Ceres ANNOT ID no. 8723180
  misc_feature (179)..(524): Pfam ID: Exostosin Pfam Description: Exostosin family
MAGVQASAVLRAGRWLLPLTIPACCVVWMLLVFSPPTPELDAGHRQSFHVIVGETVAAIERRGTPPVLERVQESPPPAELLARTKTPSSSPPPSPESEETIDTSPPSPERRPRAQPKQPLPPERERILDASSQPELAPVRQSRTGIPASPPPPQPSHQHLSRAQTKPAAVSDRCAGRYIYVQDLPSRFNADLLRDCRSLSEWTDMCRHVANAGMGPRLTRTGGVLPPTGWYDTNQFTLEVIFHNRMRQYGCLTADASRASAVYVPYYAGLDVGRHLWGFSNDVRDALAEDLVGWLRSSPAWAAHGGRDHFLVGGRIAWDLRREDGGEWGSRLLFLPEARNMTALVLESGPWHVGDVGVPYPTYFHPSRAAEVASWQRTLRRARRPWLFAFVGARRPGDTLRDSVMDQCARSRRCGLLQCGRGRRRDCYAPGNVMRHLKSAAFCLQPPGDSYTRRSAFDAMLAGCVPVFFHPGSAYTQYRWHLPADHTRYSVFVPGDSVRNGTVRVVDVLRRFGRSQVAAMREQVIRMIPGIVYRDPRAPSGEFRDAFDVAVDGLIRRVSRIKQGLPPGEEEDDDGSRHWDGYFDTR

SEQ ID NO: 19146 - DNA, 633 bp, Sorghum bicolor
  misc_feature: Ceres ANNOT ID no. 8723281
  misc_feature: Encodes the peptide sequence at SEQ ID NO 19147
atgacaactcttccaaatctgaatctcatgttgccatttcaatttgttttgcaaactaagtccaattcatccattggcagaacggttgaatgtacatcctcagtgttgcaggctttgttattatttggggattttaattcagagtaccgaagtaaagaaataaaagaaaatgttaacaaagctgccatatttattgagagcaatcaaaacaaggatggatcctggtacggcacttggggaatatgttttgtctatgggaccctctatgctataaaaggcttagttgctgctgggagaaattatgagaacagtatttgcattaggaaagcatgtaattttttgctctcaatacaactcaaaactggtggctgggcagagagctatcgttcctgtgaaacacaggtctatgtagagggtcttagcactcatgctgtacaaactgcttgggcgatgctagctttgatttatgctggacagatggaccgggacccaacacccttacatcgagcagcaaaagtattgattaatatgcaactggagacaggagactatcctcaacaagtgagttttccaaacatcgttatgatgcaaaaaaatgtactttctctcatcgtagatataagtctgttttag

SEQ ID NO: 19147 - protein, 210 aa, Sorghum bicolor
  misc_feature: The sequence is a functional homolog of SEQ ID NO 15 in US patent 7186884
  misc_feature: The sequence is a functional homolog of SEQ ID NO 6 in US patent 7122717
  misc_feature: The sequence is a functional homolog of SEQ ID NO 4 in US patent 7135624
  misc_feature: Ceres ANNOT ID no. 8723281
  misc_feature (29)..(187): SWISSPROT Homolog: EC 5.4.99.8 Cycloartenol synthase
  misc_feature (105)..(158): Pfam ID: Prenyltrans Pfam Description: Prenyltransferase and squalene oxidase repeat
  misc_feature (56)..(98): Pfam ID: Prenyltrans Pfam Description: Prenyltransferase and squalene oxidase repeat
MTTLPNLNLMLPFQFVLQTKSNSSIGRTVECTSSVLQALLLFGDFNSEYRSKEIKENVNKAAIFIESNQNKDGSWYGTWGICFVYGTLYAIKGLVAAGRNYENSICIRKACNFLLSIQLKTGGWAESYRSCETQVYVEGLSTHAVQTAWAMLALIYAGQMDRDPTPLHRAAKVLINMQLETGDYPQQVSFPNIVMMQKNVLSLIVDISLF

SEQ ID NO: 19148 - DNA, 276 bp, Sorghum bicolor
  misc_feature: Ceres ANNOT ID no. 8723323
  misc_feature: Encodes the peptide sequence at SEQ ID NO 19149
atggggattgtttggtcgatgtgtacgctaatcaactggaattcgctgatcaccgtctccctgccgtctggcgtcacaggcaaaaaaatttcacgcttgaagaacgcgcacctgagggcgctccccggcgcggcggagaggttgacgctgtgcaaggccgacttgctcgactacgacgtgctgcggtcggccgttgccggctgccacagcgtcttccacaccgcgtcgcccgtatccgatccggtacgtatacgtgtaacctatagtagtacttga

SEQ ID NO: 19149 - protein, 91 aa, Sorghum bicolor
  misc_feature: Useful for making plants with altered carbohydrate content
  misc_feature: Functional homolog of the protein sequence given in SEQ ID NO 14118
  misc_feature: Useful for making plants with altered lignin content
  misc_feature: Functional homolog of the protein sequence given in SEQ ID NO 14119
  misc_feature: Useful for making plants with altered cell wall content and/or composition
  misc_feature: Functional homolog of the protein sequence given in SEQ ID NO 14120
  misc_feature: Ceres ANNOT ID no. 8723323
  misc_feature (34)..(78): SWISSPROT Homolog: EC 1.1.1.219 Dihydrokaempferol 4-reductase
MGIVWSMCTLINWNSLITVSLPSGVTGKKISRLKNAHLRALPGAAERLTLCKADLLDYDVLRSAVAGCHSVFHTASPVSDPVRIRVTYSST

SEQ ID NO: 19150 - DNA, 1641 bp, Sorghum bicolor
  misc_feature: Ceres ANNOT ID no. 8723331
  misc_feature: Encodes the peptide sequence at SEQ ID NO 19151
atggcctcaacgcaccacctcaccagccccgccgccgccgccgcaacctccgccaccaccttctccagggcggctctcatcaagcatgcctacgctaggccctcttgctcccttctccacgccccgctcctccgcgccgccccccggcccgcgctcctctcctccgcccccgcccccgccgccgcggtatccaccaccgccgcccccgcggccgcggccgacgctatggacgccgtggaggactgggggctgaggccgctgagcgaggtggacccggaggtgtacgacctaatcgagcgcgagaagcggcggcagcgttcgggcatcgagctcatcgcgtcggagaatttcacctcgctcgccgtcatggaggcgctgggttccccgctcacaaacaagtactcggagggcatgccgggtgcgcgctactacggcgggaacgaggtcatcgacgaggtggaggagctctgccgggcgcgcgcgctcgccgcgttccgcctggacccggaacggtggggcgtcaacgtgcagccttactcggggtcccccgccaacttcgcggcgtacacggggctgctccagccgcacgacaggatcatggggctcgacctgccctccgggggacacctcacccacgggtactacacggcgggcggcaagaagatttcggcgacctccatctacttccagagcctgccgtataaggtcagctccgacactgggtatgtcgactacgacaagctggaggagaaggccatggatttccgcccaaagcttatcatctgtggtggtagtgcgtaccctcgggagtgggattatgcaaggctcagggccatcgcagacaagtgcggggccatgttgctctgtgacatggctcatatcagtggtcttgtcgctgcgcaggaggctttgaatccttttgagtactccgatgtggttaccactacgacccacaagagtcttagaggaccaaggtctggtatgattttctacaggaagggcccaaagcctccgaaaaagggccagcctgagggtgctctgtatgactatgaggacaagatcaactttgctgtattcccatcactccaggggggccctcacaatcaccagattgctgctctagctgtagccttgaaacaggccatgtcacctggattcaaggcctatatccagcaggtcaaggcaaacacagttgcccttggtaaccatttgatgagcaagggctacaagttggttactgatggaacagagaaccaccttgttctctgggatctccgtcctcttggcttgactggtaataaagttgagatgctatgtgacctatgcaacattacactgaacaaaaatgctgtctttggtgacagcagtgcaatgacacctggcggtgttcgcatcggtacacctgctatgacctcaaggggtttggttgagaaggactttgtgcagattgctgagtaccttcaccaagccgtgaccatctgcttgagcatccaggaggagcatggcaagcttctcagggacttcaaaaagggcttggtgggaaacaaggacatagagaacctgagggcggaggtcgagaagttcgccacttcgtttgagatgcctggcttcagggtgtctgacatgaagtacacagattag

SEQ ID NO: 19151 - protein, 546 aa, Sorghum bicolor
  misc_feature: Useful for making plants with modulated nitrogen use efficiency
  misc_feature: Functional homolog of the protein sequence given in SEQ ID NO 13702
  misc_feature: Ceres ANNOT ID no. 8723331
  misc_feature (86)..(544): SWISSPROT Homolog: EC 2.1.2.1 Glycine hydroxymethyltransferase
  misc_feature (87)..(487): Pfam ID: SHMT Pfam Description: Serine hydroxymethyltransferase
MASTHHLTSPAAAAATSATTFSRAALIKHAYARPSCSLLHAPLLRAAPRPALLSSAPAPAAAVSTTAAPAAAADAMDAVEDWGLRPLSEVDPEVYDLIEREKRRQRSGIELIASENFTSLAVMEALGSPLTNKYSEGMPGARYYGGNEVIDEVEELCRARALAAFRLDPERWGVNVQPYSGSPANFAAYTGLLQPHDRIMGLDLPSGGHLTHGYYTAGGKKISATSIYFQSLPYKVSSDTGYVDYDKLEEKAMDFRPKLIICGGSAYPREWDYARLRAIADKCGAMLLCDMAHISGLVAAQEALNPFEYSDVVTTTTHKSLRGPRSGMIFYRKGPKPPKKGQPEGALYDYEDKINFAVFPSLQGGPHNHQIAALAVALKQAMSPGFKAYIQQVKANTVALGNHLMSKGYKLVTDGTENHLVLWDLRPLGLTGNKVEMLCDLCNITLNKNAVFGDSSAMTPGGVRIGTPAMTSRGLVEKDFVQIAEYLHQAVTICLSIQEEHGKLLRDFKKGLVGNKDIENLRAEVEKFATSFEMPGFRVSDMKYTD

SEQ ID NO: 19152 - DNA, 993 bp, Sorghum bicolor
  misc_feature: Ceres ANNOT ID no. 8723382
  misc_feature: Encodes the peptide sequence at SEQ ID NO 19153
atggcctccgtgcttgccgccacggcattgctcattggagccttggccttggcgtccatcccaacagcggtgcaatccatcggcgtgtgctacggcacccagggcgacggcctaccgtcggcagccgacgtggtccagctctaccagtccaagggaatcggcgccatgcgcatctactccccagacgccaccattctgcaggccctgcgcggctccggcatcgacgtcatcgtcgacgagaccaacctcgacgcgctcatctccgacgccggcagctgggtgcaggccaacgtgcagccgtacatcggcgacgtgaagttcaagtacatcgccgtcggcaacgaggtggaaggcagcgacacgcagaagatcctcccggccatgcagagcctcgccggcgcgctctccgcggcagggttcggcgacatcaaggtgtccacggccgtcaagatgagcgtgctcgccacgtcctcgccgccgtccagcggcgcgttcaaggactcctccgtcatgggccccgtcgtcaggttcctcgccggcagcggcgcgccgctgctggccaacgtctacccctacttcgcctaccgggacgccggcggatcgatcgacctcggcttctcgctcttcgagcagagctcgacgacggtgaacgacgacggacatgtctacaccaacctcttcgacgccatggccgacgcgatctactcggccatggagaaggaaggtgagtccggtgtgcccatcgtcgtgtcggagagcgggtggccgtcggacggcggcggcttgggggcgtcggtggacaacgcgcagacctacaaccagaacctgatcaaccatgtcggcaatggcacgcccaagaggtccgggccgctggaaacctacatattcgccatgttcaacgagaacaagaagcagggggacgagacggagaagcactttgggctcttcaacgggcaggacaagtccccggtgtaccctattagtttctcatga

SEQ ID NO: 19153 - protein, 330 aa, Sorghum bicolor
  misc_feature: Useful for making plants with altered carbohydrate content
  misc_feature: Functional homolog of the protein sequence given in SEQ ID NO 14494
  misc_feature: Useful for making plants with altered cell wall content and/or composition
  misc_feature: Functional homolog of the protein sequence given in SEQ ID NO 14489
  misc_feature: Ceres ANNOT ID no. 8723382
  misc_feature (19)..(329): SWISSPROT Homolog: EC 3.2.1.39 Glucan endo-1,3-beta-D-glucosidase
  misc_feature (27)..(329): Pfam ID: Glyco_hydro_17 Pfam Description: Glycosyl hydrolases family 17
MASVLAATALLIGALALASIPTAVQSIGVCYGTQGDGLPSAADVVQLYQSKGIGAMRIYSPDATILQALRGSGIDVIVDETNLDALISDAGSWVQANVQPYIGDVKFKYIAVGNEVEGSDTQKILPAMQSLAGALSAAGFGDIKVSTAVKMSVLATSSPPSSGAFKDSSVMGPVVRFLAGSGAPLLANVYPYFAYRDAGGSIDLGFSLFEQSSTTVNDDGHVYTNLFDAMADAIYSAMEKEGESGVPIVVSESGWPSDGGGLGASVDNAQTYNQNLINHVGNGTPKRSGPLETYIFAMFNENKKQGDETEKHFGLFNGQDKSPVYPISFS

SEQ ID NO: 19154 - DNA, 2616 bp, Sorghum bicolor
  misc_feature: Ceres ANNOT ID no. 8723396
  misc_feature: Encodes the peptide sequence at SEQ ID NO 19155
atggacaagctgctgctcgaccagctggccggcgaggccctgcgggaggtgctgcacgcggtgcagggcaccctgttctgccgctctacggccgagcgcctgcgccggagcgtcgagccgctgctgccgctcgtccagggcctgggcccgcacgccacccagcgctcggcgggtgagctcggcgagctcgcggcgcgggtcagggaggcgctcgacctggcccgccgcgccgcggcctccccgcgctggaacgtctaccgcgccgcgcagctgtcgcgccggatggaggccgccgaccgcggcatcgcgcgctggctcgagcgccacgccccagcgcacgtcatcggtggagtccgcaggctccgcgacgaggccgacgcccgcatcggccgcctcgagcgccgcgtcgaggagatcgccgccgccgcgcagccgccgccgcccccagccctctccgtccccgtcatcgcgccgccgccgcacaagggcgtgcccatgccgatggaagcacctctcgccaagcccgccttcgccgctgtgccgatggaggtgccgccgcacaagggcatggctatgtccgtgccgatgccggtgaaggcggcgcccgccaaggccggggtgatggccatggacatggacctcatcgagggacacgaagaagaggggatggttggtgccggcgtcaaggtggccaaggaaaaggtgaaggagatggttatgagcggcggcggcggctgggaggtggttggtatctccggcatgggcggcagcggcaagaccacgctcgccatggagatcttcagggatcacaaggtccgagcctacttcaatgataggatcttctttgagacgatctcacaatctgcaaatttggagacaatcaagatgaagctgtgggagcagataagcggcaacctcgtgcttggtgcatacaaccagatcccagaatggcagctcaagttaggaccaagggaccgaggacctgtccttgtaatccttgatgatgtttggtctctcccacagcttgaggagctcattttcaagttccctgggtgcaagactctagttgtatcgagattcaagttccccacgttggtaaaacagacatatgaaatgcagttgctagatgaggcagcggctttgtctgtcttctgccgtgctgctttcgatcaggagtctgttccgcagactgctgacaagaaattggtcaggcaggtctctgcagagtgcagaggtcttcctctggctctgaaggttattggtgcatcgttgcgcgatcaacctcctaagatatggctcagcgccaagaaccggttgtctcgaggagaggctatttctgactcccatgagaccaagcttctagagagaatggcggcaagcgtcgagtgcttgtcagagaaggttagagattgtttccttgatctgggctgcttcccagaggataagaagatcccccttgatgtcttgatcaacatctggatggagattcatgatcttgatgaaccagatgcttttgccatcttggttgagctttcaaacaagaaccttcttacccttgtcaatgatgcacagaacaaggctggagatttgtacagtagctaccatgactactcggtgacacaacatgatgtgttgagagatcttgctcttcacatgagtgggcgtgaccctctgaacaagcggaggcggttggtgatgccaagaagggaagaaacacttcccagggattggcagaggaataaggatactccgtttgaagctcagatagtttccattcatacaggtgaaatgaaagaatcggactggttccagatgagcttccctaaggcagaagtgctgatcctcaacttcgcctcaagcttgtactacctcccaccgttcatcgcgacaatgcagaacctgaaagctctggtgctgatcaactacggcaccagcagcgctgcccttgacaacctatccgcgttcaccactctcaacggcctgaggagtctctggctggagaaaatcaggctcccgccgctgccaaagaccaccatcccgctgaagaacctgcacaagatctccctcgtcctctgcgagctgaacagcagcctaagaggatcaacgatggacctgtcgatgacgtttccgcgcctctccaacctcacaatcgaccactgcatagacctgaaggagctgccatcaagcatctgcgagatcagctcgctggagaccatctccatctccaactgccacgacctcaccgagcttccctacgagctgggcaagctgcactgcctgagcatcctccgtgtctacgcctgcccggcgctctggcggctcccagcgtcggtgtgcagcctgaagaggctcaagtacctcgacatctcgcagtgcatcaacctgaccgacctcccggaggagctcggccacctgacgagcctggagaagatcgacatgcgcgagtgctcccgcctgaggagcctcccgcggtcgtcgtcgtcgctcaagtccctcggccacgtcgtatgcgacgaggagacggcgctgctgtggagggaggccgagcaggtcatccctgacctccgggttcaggtggccgaagagtgctacaacctggactggctagcggactga

SEQ ID NO: 19155 - protein, 871 aa, Sorghum bicolor
  misc_feature: Useful for making plants with modulated drought sensitivity
  misc_feature: Functional homolog of the protein sequence given in SEQ ID NO 14691
  misc_feature: Useful for making plants with modulated water use efficiency
  misc_feature: Functional homolog of the protein sequence given in SEQ ID NO 14692
  misc_feature: Ceres ANNOT ID no. 8723396
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (211)..(501): Pfam ID: NB-ARC Pfam Description: NB-ARC domain
MDKLLLDQLAGEALREVLHAVQGTLFCRSTAERLRRSVEPLLPLVQGLGPHATQRSAGELGELAARVREALDLARRAAASPRWNVYRAAQLSRRMEAADRGIARWLERHAPAHVIGGVRRLRDEADARIGRLERRVEEIAAAAQPPPPPALSVPVIAPPPHKGVPMPMEAPLAKPAFAAVPMEVPPHKGMAMSVPMPVKAAPAKAGVMAMDMDLIEGHEEEGMVGAGVKVAKEKVKEMVMSGGGGWEVVGISGMGGSGKTTLAMEIFRDHKVRAYFNDRIFFETISQSANLETIKMKLWEQISGNLVLGAYNQIPEWQLKLGPRDRGPVLVILDDVWSLPQLEELIFKFPGCKTLVVSRFKFPTLVKQTYEMQLLDEAAALSVFCRAAFDQESVPQTADKKLVRQVSAECRGLPLALKVIGASLRDQPPKIWLSAKNRLSRGEAISDSHETKLLERMAASVECLSEKVRDCFLDLGCFPEDKKIPLDVLINIWMEIHDLDEPDAFAILVELSNKNLLTLVNDAQNKAGDLYSSYHDYSVTQHDVLRDLALHMSGRDPLNKRRRLVMPRREETLPRDWQRNKDTPFEAQIVSIHTGEMKESDWFQMSFPKAEVLILNFASSLYYLPPFIATMQNLKALVLINYGTSSAALDNLSAFTTLNGLRSLWLEKIRLPPLPKTTIPLKNLHKISLVLCELNSSLRGSTMDLSMTFPRLSNLTIDHCIDLKELPSSICEISSLETISISNCHDLTELPYELGKLHCLSILRVYACPALWRLPASVCSLKRLKYLDISQCINLTDLPEELGHLTSLEKIDMRECSRLRSLPRSSSSLKSLGHVVCDEETALLWREAEQVIPDLRVQVAEECYNLDWLAD

SEQ ID NO: 19156 - DNA, 1074 bp, Sorghum bicolor
  misc_feature: Ceres ANNOT ID no. 8723397
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 19157
atggcgaggacgccggcagcagcggcggcggggtcagcggtggggatggagatgccgataatgcacgacggggacaggtacgagcccgtgcgggacatcgggtcgggaaacttcggcgtcgcgcgcctcatgcgcaaccgcgccaccggcgacctcgtcgccgtcaagtacatcgaccgcggcgacaagatcgacgagaacgtgcagcgggagatcatcaaccaccgctcgctgcgccaccccaacatcatccgcttcaaggaggtcatcctgaccaagactcacctagccatcgtcatggagtacgcctccggcggggagctcttcaaccgcatctgcaatgccggccggttcagcgaggacgagctgatttcaggggttagctactgccactccatgcaagtatgccaccgtgatttgaagctcgagaacactctgctggatggaagcactgcgcctcgcctcaagatatgcgacttcggttattcaaagtcatctgttcttcactcccaaccaaagtccactgtgggaactccagcatacattgctcctgaaattttgctgaacaaggaatacgacggcaagattgccgatgtctggtcatgcggtgtgaccctctacgtgatgctggttggcgggtatccttttgaggatcctgaagaccctaagaatttcaaaaagacaattcagaaaatactgggtgttcagtacgcgattcctgactacgtctgtgtatctccagaatgccgggatctgatatcaaggatttttgttgccaacccagcagataggatcacgatgcctgagatcaagagccatccatggttcgtcaagaacctcccagctgacctcgtgggcgacggcacggtgagctacgaggagccggaccagccgatgcagaacatgaacgagatcatgcagatactggctgaggcaacagtgccggccgatggcgcccgtggaacgacccagcttttgtgcgacgaccttgatgactttgacgacgatatggacctggactcggacctggacctcgacatcgagagcagtggagagatagtgtatgccatgtaa

SEQ ID NO: 19157 - protein, 357 aa, Sorghum bicolor
  misc_feature: Useful for biocontainment applications
  misc_feature: Useful for making plants with modulated biomass
  misc_feature: Useful for making plants with modulated time to senescence
  misc_feature: Functional homolog of the protein sequence given in SEQ ID NO 14093
  misc_feature: Useful for making plants with modulated water use efficiency
  misc_feature: Functional homolog of the protein sequence given in SEQ ID NO 14094
  misc_feature: Ceres ANNOT ID no. 8723397
  misc_feature (14)..(357): SWISSPROT Homolog: EC 2.7.11.1 Non-specific serine/threonine protein kinase
  misc_feature (27)..(276): Pfam ID: Pkinase Pfam Description: Protein kinase domain
MARTPAAAAAGSAVGMEMPIMHDGDRYEPVRDIGSGNFGVARLMRNRATGDLVAVKYIDRGDKIDENVQREIINHRSLRHPNIIRFKEVILTKTHLAIVMEYASGGELFNRICNAGRFSEDELISGVSYCHSMQVCHRDLKLENTLLDGSTAPRLKICDFGYSKSSVLHSQPKSTVGTPAYIAPEILLNKEYDGKIADVWSCGVTLYVMLVGGYPFEDPEDPKNFKKTIQKILGVQYAIPDYVCVSPECRDLISRIFVANPADRITMPEIKSHPWFVKNLPADLVGDGTVSYEEPDQPMQNMNEIMQILAEATVPADGARGTTQLLCDDLDDFDDDMDLDSDLDLDIESSGEIVYAM

SEQ ID NO: 19158 - DNA, 810 bp, Sorghum bicolor
  misc_feature: Ceres ANNOT ID no. 8723449
  misc_feature: Encodes the peptide sequence at SEQ ID NO 19159
atgcccatgcgaaccaatgaaattacccgcttgtgccattcctcaaatacccccgccccccgcacgcaaccctcggcatccttgccggctgccccaccgtgtcccccccgttcctcttcctccccacccgtccccctccccgtccgtctctcgcctgccttcgcacgggtgcgccgcccggtcgacggccacgtcacgccgcgccgcgctgcccagctgatccggcacccgctcttcctcgccgagctccggatcgacgcctcccgcgcccgttccgggctccccatccgccgcctccccattctgcagcaggagaccagcacccgcgccttccccctcgccgtcgcgcgccccacgctcaattttactatgtctgggatggcatctgatgatgcacctgctcaagtgagtgttgaaggagatgtttcagataaaaaagtagaagttcaagaccagaatgaagtgagtgggatgccctcacgacaagaggaggaggcggtaattaagaaaaagtatggaggaatattacccagaaagactccacttatatctaaggaccatgaacgagcttactttgattctgctgattgggctctaggaaagcaaggtggtgtccccaacaagcctaaaggtcctcttgaagcacttcgaccaaagcttcagcctactcaacagaatgcccgtgcccgtcgaacttcatatgcatctgcggacagtgatgagactttgaacttgtctcctgaggatctgatcccgcaaggagagcccagccagcaaggagaacctgtcgaggacaagaacaaggaataa

SEQ ID NO: 19159 - protein, 269 aa, Sorghum bicolor
  misc_feature: Useful for biocontainment applications
  misc_feature: Functional homolog of the protein sequence given in SEQ ID NO 14200
  misc_feature: Ceres ANNOT ID no. 8723449
  misc_feature (169)..(268): Pfam ID: Lg106 Pfam Description: Lg106-like protein
MPMRTNEITRLCHSSNTPAPRTQPSASLPAAPPCPPRSSSSPPVPLPVRLSPAFARVRRPVDGHVTPRRAAQLIRHPLFLAELRIDASRARSGLPIRRLPILQQETSTRAFPLAVARPTLNFTMSGMASDDAPAQVSVEGDVSDKKVEVQDQNEVSGMPSRQEEEAVIKKKYGGILPRKTPLISKDHERAYFDSADWALGKQGGVPNKPKGPLEALRPKLQPTQQNARARRTSYASADSDETLNLSPEDLIPQGEPSQQGEPVEDKNKE

SEQ ID NO: 19160 - DNA, 1440 bp, Sorghum bicolor
  misc_feature: Ceres ANNOT ID no. 8723432
  misc_feature: Encodes the peptide sequence at SEQ ID NO 19161
atggagaagaagacggtggtgctgtacccgggcgtcggcgtcggccacctcgcgccgatgctcgagctggccaaggcgttcctccgccacggcggggaccaggtcgacgtcgccatcgcggtcttcgagccgcccgtctacgccaacggcttcgccgccacggtcgcgcgcgccaaggcctccaacacctccgtcgccttgcacgtgcttcccccgccgccgccgccggcctccgacggcggcgacgacgccgatcctgatgtacccttggcccggatgctccgcttcctccgcgccacgaacgcgccgctccgcgacttcctccgcgcgctgtcgtcgtcgcgccgcgtccaggcgatcgtgctcgacatgttctgcgccgacgcgctcgacgtcgcggccgagctcggcctgcccgcctacttcttcttcccctcgggcaccgccggcctcgcctgcttcctcggcctccccgccatgcgcgccagcgtgggcaccagcttcgcggcgctcggggactccgccgtcctgtcgttcccgggcgttcctccgttcacggtcgcggacctggcgcaggggctggcggacgacggcgaggcgtgcaagggcatcatcggcgtggctgcccggatgccggaagcccgcggcatcctcatcaactccttcgagtcgctggagccgcgcgcgatgcgggcgctcagggacgggctgtgcgtgccggaccgccccacgccgccggtctactgcgtcgggccggtggtctcgcccggcggcgacaaagaccacgactgcgactgcctccgctggctggacgcgcagccggaccgcagcgtcgtgttcctctgcttcgggagcatgggcgcgttccccaagaagcagctggaggagatcgccgtcggtctggagaggtccgggcagaggtttctctgggtcgtgcgaggccctcccggcgccgccgccgacgacgacgacgtcggcgcgctcctcccggccgggttccaggagcgcaccgaggacagggggttcgtcgtcaagaactgggcgccgcaggtggacgtgctgcgccacagagcggccggcgcattcgtgacgcactgcgggtggaactcgacgctggagggcgtcgcggcggggctgccgctgctgtgctggccgctgtacgcggagcagaagatgaacaaggtgcgcatcgtggaggagatgaagctaggggtggagatgaggaggagggacgacgacgacgtggtgacggctgaagaggtggaggcgaaggtgaggtgggtgatggaggactccgacggcgcgcgggcgctccgggagcgcgcggcggcggcgagggacagcgcggccgaggcgctcgcggaaggggggccgtcgtgtgcagctttcctcgagttcctcgaagacctgttggcttcggaaggcatggttaatgtttga

SEQ ID NO: 19161 - protein, 479 aa, Sorghum bicolor
  misc_feature: Useful for making plants with altered carbohydrate content
  misc_feature: Functional homolog of the protein sequence given in SEQ ID NO 14447
  misc_feature: Ceres ANNOT ID no. 8723432
  misc_feature (104)..(403): SWISSPROT Homolog: EC 2.4.1.218 Hydroquinone glucosyltransferase
  misc_feature (5)..(474): Pfam ID: UDPGT Pfam Description: UDP-glucoronosyl and UDP-glucosyl transferase
MEKKTVVLYPGVGVGHLAPMLELAKAFLRHGGDQVDVAIAVFEPPVYANGFAATVARAKASNTSVALHVLPPPPPPASDGGDDADPDVPLARMLRFLRATNAPLRDFLRALSSSRRVQAIVLDMFCADALDVAAELGLPAYFFFPSGTAGLACFLGLPAMRASVGTSFAALGDSAVLSFPGVPPFTVADLAQGLADDGEACKGIIGVAARMPEARGILINSFESLEPRAMRALRDGLCVPDRPTPPVYCVGPVVSPGGDKDHDCDCLRWLDAQPDRSVVFLCFGSMGAFPKKQLEEIAVGLERSGQRFLWVVRGPPGAAADDDDVGALLPAGFQERTEDRGFVVKNWAPQVDVLRHRAAGAFVTHCGWNSTLEGVAAGLPLLCWPLYAEQKMNKVRIVEEMKLGVEMRRRDDDDVVTAEEVEAKVRWVMEDSDGARALRERAAAARDSAAEALAEGGPSCAAFLEFLEDLLASEGMVNV

SEQ ID NO: 19162 - DNA, 1530 bp, Sorghum bicolor
  misc_feature: Ceres ANNOT ID no. 8723490
  misc_feature: Encodes the peptide sequence at SEQ ID NO 19163
atggatggacctgttgatgaccctgtggagaacaacctcaccggaggtcctagtatccttggcaatgaggaagaagccaatacttatgctgatgtgcaagtcaaggaagaaccagaaaagctctatgacgaggaatccaaggacctaatgcaagatgagttgggtaaccaagagcatgcgaacatgaacaatgaagatgtgggaggtcagaacaaagaggaccaagctacccccacagaccacggtgtggaagctggggtgaagcagcaggatgctacagttcctgatgacaagaagtggcctggatggcctggagagagtgttttccgtatactggttcctaccacaaaggttggtgccgtcattgggcgcaaaggggatttcatcaagaaaatgtgtgaggaatcaagagctcgcatcaaggttcttgagggaccaccagctgtgccagaaagagtggtaatgatttcagcaaaggatgaactagacacagtgctacctccagctgttgatgggctgcttagagttcataaaaggataacagatggtttagatggtgaaactgatcagcctcaacgagctactgtcaccgctgggcccacaaggctactggtcccagcttcccaagctggcagcctgattgggaagcaaggagcaactattaaatcaatacaggatgcttcaaagtgtgttctccggattgttgagaatgttccacctgttgcattgaatgatgacagagttgtagagatacagggtgaacctcttgatgctcacaaagccgtggagctgattgcaagtcatttaagaaaatttcttgttgaccgtagtgtcctccctttgtttgaaacacagatgaaagtgcacagtgtgcacagagagcaacctatgcctcctccacaggcatggggtccccctccaccctcaccctggggtcatccaccaccaaaccttcctcctcctggtggcccaggttatggtgggaacccacagtacatgcctccacctccacggccacaagagagctattatcctccgcctgatgtgccccctgtagaaaagcaaccacactatggaatttcttcatatggacgcgatgcacctccgagtgttcccccagggaatcaaaaccaagcacatgggtcttctcaggtgacacacagcatgcaagttcctctttcctatgctgatgctgtgataggatcagccggtgccagtatcagctacatccgcaggcatagtggagcaactataagtattcaagaaggtgctcctggggagatgacagtggagataacaggaagtgcttcacaagtacagactgctcaacagctaatcaagaacttcatggctgaagcttccccccagggaccaccggctccagctccacccgctcaaccagtggacacaggttacagctcgtatccaccttacggtggagcatcatatggatctcctcctggcgccccagctccagctcctcacaacggcggaagctatggcgcgtacccaccgagctatggatactaa

SEQ ID NO: 19163 - protein, 509 aa, Sorghum bicolor
  misc_feature: Useful for making plants with modulated flowering time
  misc_feature: Functional homolog of the protein sequence given in SEQ ID NO 14693
  misc_feature: Ceres ANNOT ID no. 8723490
  misc_feature (200)..(265): Pfam ID: KH_1 Pfam Description: KH domain
  misc_feature (386)..(446): Pfam ID: KH_1 Pfam Description: KH domain
  misc_feature (108)..(162): Pfam ID: KH_1 Pfam Description: KH domain
MDGPVDDPVENNLTGGPSILGNEEEANTYADVQVKEEPEKLYDEESKDLMQDELGNQEHANMNNEDVGGQNKEDQATPTDHGVEAGVKQQDATVPDDKKWPGWPGESVFRILVPTTKVGAVIGRKGDFIKKMCEESRARIKVLEGPPAVPERVVMISAKDELDTVLPPAVDGLLRVHKRITDGLDGETDQPQRATVTAGPTRLLVPASQAGSLIGKQGATIKSIQDASKCVLRIVENVPPVALNDDRVVEIQGEPLDAHKAVELIASHLRKFLVDRSVLPLFETQMKVHSVHREQPMPPPQAWGPPPPSPWGHPPPNLPPPGGPGYGGNPQYMPPPPRPQESYYPPPDVPPVEKQPHYGISSYGRDAPPSVPPGNQNQAHGSSQVTHSMQVPLSYADAVIGSAGASISYIRRHSGATISIQEGAPGEMTVEITGSASQVQTAQQLIKNFMAEASPQGPPAPAPPAQPVDTGYSSYPPYGGASYGSPPGAPAPAPHNGGSYGAYPPSYGY

SEQ ID NO: 19164 - DNA, 735 bp, Sorghum bicolor
  misc_feature: Ceres ANNOT ID no. 8723561
  misc_feature: Encodes the peptide sequence at SEQ ID NO 19165
atggaggtcgccgcagcatcagcagcagcgagcttcggcttgaaggccgccgacgacgtggacaacctcagggccacggagctcaggctcggcctgccaggcacggaggaggagccccagcaggtccacaaggcgacggcggcggcggcggcggtggagctgccgctgctgccggccgcgacgacgccgccggcgccgtctacgcctaggggcaagaagcgcgacgtcgtcggaagcgggaacgaggacgcgcccaagaagcgcgacggcaacgccgacgccgcgccgcccgccgccaaggctcaggtggtgggatggccgccggtgaggtcgtacaggaagagctgcttccagcagcagcagcagcaggcggcggccaagagcaagcccgcgccagcggcgccggcggaggaggccccggcgaccgggctgttcgtgaaggtgagcatggacggcgccccctacctcaggaaggtggacctcaagatgtacaagggctaccgcgagctccgggaggcgctggaggccatgttcctctgcttctccgggtccggcggatccgccgacgcgcccgccgtcaacccctccgacttcgccgtcacctacgaggacaaggacggcgacctcatgctcgtcggcgacgtgcccttcgacatgttcatcagcacctgcaagaggctgaggatcatgaagggatctgaagccagaggactcggatcagtcaagaacaactga

SEQ ID NO: 19165 - protein, 244 aa, Sorghum bicolor
  misc_feature: The sequence is a functional homolog of SEQ ID NO 648 in the 11/479,226 US patent application
  misc_feature: The sequence is a functional homolog of SEQ ID NO 652 in the 11/479,226 US patent application
  misc_feature: The sequence is a functional homolog of SEQ ID NO 739 in the 10/374,780 US patent application
  misc_feature: The sequence is a functional homolog of SEQ ID NO 656 in the 11/479,226 US patent application
  misc_feature: The sequence is a functional homolog of SEQ ID NO 636 in the 11/479,226 US patent application
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: Useful for making plants with altered terpenoid content
  misc_feature: Functional homolog of the protein sequence given in SEQ ID NO 13610
  misc_feature: The sequence is a functional homolog of SEQ ID NO 667 in the 11/479,226 US patent application
  misc_feature: The sequence is a functional homolog of SEQ ID NO 738 in the 10/374,780 US patent application
  misc_feature: The sequence is a functional homolog of SEQ ID NO 736 in the 10/374,780 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
  misc_feature: Ceres ANNOT ID no. 8723561
  misc_feature (22)..(241): Pfam ID: AUX_IAA Pfam Description: AUX/IAA family
MEVAAASAAASFGLKAADDVDNLRATELRLGLPGTEEEPQQVHKATAAAAAVELPLLPAATTPPAPSTPRGKKRDVVGSGNEDAPKKRDGNADAAPPAAKAQVVGWPPVRSYRKSCFQQQQQQAAAKSKPAPAAPAEEAPATGLFVKVSMDGAPYLRKVDLKMYKGYRELREALEAMFLCFSGSGGSADAPAVNPSDFAVTYEDKDGDLMLVGDVPFDMFISTCKRLRIMKGSEARGLGSVKNN

SEQ ID NO: 19166 - DNA, 954 bp, Sorghum bicolor
  misc_feature: Ceres ANNOT ID no. 8723559
  misc_feature: Encodes the peptide sequence at SEQ ID NO 19167
atggcgacgacggacctggggttcgaggagacggagctccgtctgggcctgcccggcggcgggggagaggtggtcggcgaagggaggagctctgtcgtctcctccgggaagaggggcttcgcagagaccatcgacctcaagctgaagctggagccggcgactcccgcggccgtattgaaggcggcggaggcggacgagcatcaggacggtgttgccgccgccaaggaagacgccggctgcgtggccgccgcggaggaggccgccgtcggcgggaagatgaagaggtccccgagccagagcagcgtcgtcaccgccgccgccgtgcaggctgaccccgccgagaagccgcgcgcccccaaggctcaggtggtgggatggccaccggtccggtcgttccggaagaacatcatgtccgtgcagtccgacaagggcgccggcggcagcaaagacgccgacaagtcctcgccggcggcggcagctggcggtggtgcggcgttcgtgaaggtgagcttggacggcgcgccgtacctgcgcaaggtggacctcaagatgtacaagagctaccaggagctgtccaaggcgctcgagaagatgttcagctccttcaccattggaagctgtgggtctcaagggatgaacggcatgaacgagagcaagctggtggatctgctcaacggctccgagtacgtgccgacctacgaggacaaggacggcgactggatgctcgtcggcgacgtgccgtgggaaagagaagccatgaacatgtacctgtcctataacaatgtctttttgcactacctgttctctcctcctcttctttttttttggtggctcaaaatgcaaaggcaccctgctcctaatcaaggggcccttttgcatcttgtccatcaaaagttgtttaattataattaccacggtgtgtcagtggaacaaataactgtttcaagctgttaa

SEQ ID NO: 19167 - protein, 317 aa, Sorghum bicolor
  misc_feature: Useful for making plants with altered terpenoid content
  misc_feature: Functional homolog of the protein sequence given in SEQ ID NO 13610
  misc_feature: The sequence is a functional homolog of SEQ ID NO 2006 in the 10/374,780 US patent application
  misc_feature: The sequence is a functional homolog of SEQ ID NO 288 in the 10/412,699 US patent application
  misc_feature: The sequence is a functional homolog of SEQ ID NO 664 in the 11/479,226 US patent application
  misc_feature: Useful for making plants with modulated nitrogen use efficiency
  misc_feature: Functional homolog of the protein sequence given in SEQ ID NO 13612
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: Useful for making plants with altered alkaloid content
  misc_feature: Functional homolog of the protein sequence given in SEQ ID NO 13611
  misc_feature: The sequence is a functional homolog of SEQ ID NO 739 in the 10/374,780 US patent application
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: Ceres ANNOT ID no. 8723559
  misc_feature (6)..(258): Pfam ID: AUX_IAA Pfam Description: AUX/IAA family
MATTDLGFEETELRLGLPGGGGEVVGEGRSSVVSSGKRGFAETIDLKLKLEPATPAAVLKAAEADEHQDGVAAAKEDAGCVAAAEEAAVGGKMKRSPSQSSVVTAAAVQADPAEKPRAPKAQVVGWPPVRSFRKNIMSVQSDKGAGGSKDADKSSPAAAAGGGAAFVKVSLDGAPYLRKVDLKMYKSYQELSKALEKMFSSFTIGSCGSQGMNGMNESKLVDLLNGSEYVPTYEDKDGDWMLVGDVPWEREAMNMYLSYNNVFLHYLFSPPLLFFWWLKMQRHPAPNQGALLHLVHQKLFNYNYHGVSVEQITVSSC

SEQ ID NO: 19168 - DNA, 1014 bp, Sorghum bicolor
  misc_feature: Ceres ANNOT ID no. 8723684
  misc_feature: Encodes the peptide sequence at SEQ ID NO 19169
atggcccaggtcgggtcggccactgcctcggagaggccgccgccgcaggacgcatgggtcgtcgagctccgcagtctcctcccgcagtgggagtcgctgcgggattcctccaaggtcattatcccgatttcaatatctagggtgaaccagtttgatgctgcaaggctagatgtcgagatgtcggcagtgttgaaagagcagctagtcaaagtgttctccttgatgaagccaggactcttattccaatatgagcctgaacttgatgctttcctcgagttcctcatctggaggttctcaatttgggttgacaagccaacccctggcaatgcactgatgaacctgaggtatagagatgagcgggcagcacccttgactggaaaagaagttagaacaggtttggaaggacctgggctttctgtttctcaaaagatattttattgtattagctttgttggtggccaatatatatggtcacgattacagtctttttctgctttccgtcgatggggtgattctgaacagagaccactagcaggccgtgcttgggcattaatgcagaatgctgaagtattgtatagggctgcttcattctttaacctattattgtttctttatggtgggaggtacaaaactattgtagaaaggattctgaaggcaagacttgtttatgggagccccaacatgaatagagctgttagctttgagtacatgaatcgccagctggtctggaatgagttttcggaaatgttgcttttgcttcttccccttctaaactcatcctcagtaaagaagttccttctccccttctccaaagataagtcggcaggttcttctggtgatgaggcagactgtcctatatgtcggtccagtcctagtattccatttattgctcttccatgtcagcacaggtattgctactattgcctacgcacgcgttgttctgctacaaattcctatagatgcacacgttgtaacgaggtggttgttgcaattcaaagattaggatcagtttag

SEQ ID NO: 19169 - protein, 337 aa, Sorghum bicolor
  misc_feature: Useful for making plants with modulated flowering time
  misc_feature: Useful for making plants with modulated low light sensitivity
  misc_feature: Functional homolog of the protein sequence given in SEQ ID NO 13382
  misc_feature: Ceres ANNOT ID no. 8723684
  misc_feature (53)..(272): Pfam ID: Pex2_Pex12 Pfam Description: Pex2 / Pex12 amino terminal region
  misc_feature (284)..(324): Pfam ID: zf-C3HC4 Pfam Description: Zinc finger, C3HC4 type (RING finger)
MAQVGSATASERPPPQDAWVVELRSLLPQWESLRDSSKVIIPISISRVNQFDAARLDVEMSAVLKEQLVKVFSLMKPGLLFQYEPELDAFLEFLIWRFSIWVDKPTPGNALMNLRYRDERAAPLTGKEVRTGLEGPGLSVSQKIFYCISFVGGQYIWSRLQSFSAFRRWGDSEQRPLAGRAWALMQNAEVLYRAASFFNLLLFLYGGRYKTIVERILKARLVYGSPNMNRAVSFEYMNRQLVWNEFSEMLLLLLPLLNSSSVKKFLLPFSKDKSAGSSGDEADCPICRSSPSIPFIALPCQHRYCYYCLRTRCSATNSYRCTRCNEVVVAIQRLGSV

SEQ ID NO: 19170 - DNA, 1008 bp, Sorghum bicolor
  misc_feature: Ceres ANNOT ID no. 8723766
  misc_feature: Encodes the peptide sequence at SEQ ID NO 19171
atgggggagagaggagcggtgggggagagaggcaccatgggagagaggggagtggtgggggagaggctcgcgactggtgaaaccgttgttagaaatcctccaggagacccaagttattggtggagacacagatcaaaaggctcatggacactttcaactgtagataatggttgggcttcaagtgactgtactgcagaagcaactaagacattgatgctgctttcaaagatatatcctaagctccatgagaatcaagaggaagacgagtggctcttaaatgctgttgattgccttctttcctttatgaacaaagatggttcagtttgtacatatgaatgccaaaggacttattcgtggctagagattttaaatccattggagagctttcggaatattatggctgattacccaacggttgaatgtacttcctcagtgatggaagctctgatactatttagggaggtaaatccagtgtaccacagtgaagagataagagagtatgtcaccaaagctgccatgtttatagagaataatcaaaagaaggatggatcctggtatggcacttggggcatctgtttcatatatgggaccctgtttggaataaaaggcttagttgctgctgggagaaattacgagaacagtatttgtattaggaaagcatgtgagtttttgctgtcaacacaactcagaacaggtggttggggagagagctatctttcttgtgaaagacaggtctatgtagagggtcctaatactcatgcagtacaaactgcttgggcaatgctagctctgatatatgctgggcagatggaacgagacccaacaccattaaacggtgctgcaaaagtattgatcaatatgcaaatggagacaggagattatcctcagcaggaacacgttggaaacaccaactcttctgtttatttcaactaccccaactaccgcaatttataccctatttgggctctcggagagtatcgacggagactatttgctaagaatgaatga

SEQ ID NO: 19171 - protein, 335 aa, Sorghum bicolor
  misc_feature: The sequence is a functional homolog of SEQ ID NO 15 in US patent 7186884
  misc_feature: The sequence is a functional homolog of SEQ ID NO 6 in US patent 7122717
  misc_feature: Ceres ANNOT ID no. 8723766
  misc_feature (29)..(327): SWISSPROT Homolog: EC 5.4.99.8 Cycloartenol synthase
  misc_feature (215)..(268): Pfam ID: Prenyltrans Pfam Description: Prenyltransferase and squalene oxidase repeat
  misc_feature (166)..(208): Pfam ID: Prenyltrans Pfam Description: Prenyltransferase and squalene oxidase repeat
MGERGAVGERGTMGERGVVGERLATGETVVRNPPGDPSYWWRHRSKGSWTLSTVDNGWASSDCTAEATKTLMLLSKIYPKLHENQEEDEWLLNAVDCLLSFMNKDGSVCTYECQRTYSWLEILNPLESFRNIMADYPTVECTSSVMEALILFREVNPVYHSEEIREYVTKAAMFIENNQKKDGSWYGTWGICFIYGTLFGIKGLVAAGRNYENSICIRKACEFLLSTQLRTGGWGESYLSCERQVYVEGPNTHAVQTAWAMLALIYAGQMERDPTPLNGAAKVLINMQMETGDYPQQEHVGNTNSSVYFNYPNYRNLYPIWALGEYRRRLFAKNE

SEQ ID NO: 19172 - DNA, 1734 bp, Sorghum bicolor
  misc_feature: Ceres ANNOT ID no. 8723764
  misc_feature: Encodes the peptide sequence at SEQ ID NO 19173
atgtggaggctaaagacctcagaggggggagggtcatggatgcagacagtgagtggtttccatggccggcagggggtgtgggagttcgaccccggcgccggcacccaagaggagcgcaccaaggtggagcagcttcgccaggagttcactgagaaccgcttccgaaggagggaatcacaggatctcctcatgcgtatgcagttcactggacaaaaacacctgcatgccgatatgcccgcggccaccaagctagaagatggcgatgaggtgacggaagaaattgtgcaggagtctctgagactggcgctcggttggatgtctgctctccaagctgaagatggtcactggcctggtgatttcagtggcatcatgtacatcctgcccttctggatcttcgcgctgcacatcacaggatcgatcgatgttgtcctatcaaaagagcataaacgcgagatatgccgtcatatttacaaccatcagaacgaggatggtggatggggcttcaacattttggatgacagtgccatgtttggtacgtgcttaaattacgtcaccttgaggcttctcggggaggtacaaaaggatgagaatgatgggctagcaaagggccgagcttggatcttatcccatggcaccgcagctgcagggccacagtgggcaaaaatattactctcggttattggtgtatacgactggtccggaaataatcctatgatccctgaactatggttggtcccacgatttctaccaattcatccaggacgattctggtgcttcacaaggatggtttatatgtcaatagctttcctttatggcaagaaatttgtcggtcccattacaccaactatattagcactaagggatgaactctatagtttgccatataccaagattgattggaataaagctcgtaatacttgtgcgaaggaggacacacgctatcaaccatcagcaatattcagtgtcattgcaagttgtttgaacacgtttgtggagccattcttaaactgttggccgcttaacaagctaagaaaaagagcactgagtcacatcctagaacatatccagtacgaggacgaaactactcaatatgttggcctaagtccagttaacaaggcactgaacattatttgccgttgggtagaaaatccaaatccagatgtgctcaagcgacatattacaaggataaatgattatttgtggattgctgaagatggcatgaagaccaaaggtgcgagtgaggttgacggccatctccatggatcgtgggaggtggcataccaccgcctctcggagctcgtgtcgcagggcatggacgaagtggctgacttggtgtttctcgctgttgaggtcgatgcagcgagcgtaagcgatgaagttgtcaatgtagtcattcatgtggaagtcatggcgaggggtgccatatcattgttggtgtcatggttggggccaaagttgcttgtgatgctgttggtgaagtgcatccatttggttataggcgtcgccattgtggtcgacgaggtgctccatgcgtgccaaccatggtgttggatccttggagccatcatatcttggagtgatggttctggtcatgagagtgggtgctctgtatggtgtgcaaacaccaagagttacattgaacgacatgtcgaacctattgctcggtgtcaggctgctgctgtagtggtacctccaatattaaaggagctattggatctggagcttgtgtcatag

SEQ ID NO: 19173 - protein, 577 aa, Sorghum bicolor
  misc_feature: The sequence is a functional homolog of SEQ ID NO 15 in US patent 7186884
  misc_feature: The sequence is a functional homolog of SEQ ID NO 6 in US patent 7122717
  misc_feature: Ceres ANNOT ID no. 8723764
  misc_feature (1)..(411): SWISSPROT Homolog: EC 5.4.99.8 Cycloartenol synthase
  misc_feature (147)..(190): Pfam ID: Prenyltrans Pfam Description: Prenyltransferase and squalene oxidase repeat
MWRLKTSEGGGSWMQTVSGFHGRQGVWEFDPGAGTQEERTKVEQLRQEFTENRFRRRESQDLLMRMQFTGQKHLHADMPAATKLEDGDEVTEEIVQESLRLALGWMSALQAEDGHWPGDFSGIMYILPFWIFALHITGSIDVVLSKEHKREICRHIYNHQNEDGGWGFNILDDSAMFGTCLNYVTLRLLGEVQKDENDGLAKGRAWILSHGTAAAGPQWAKILLSVIGVYDWSGNNPMIPELWLVPRFLPIHPGRFWCFTRMVYMSIAFLYGKKFVGPITPTILALRDELYSLPYTKIDWNKARNTCAKEDTRYQPSAIFSVIASCLNTFVEPFLNCWPLNKLRKRALSHILEHIQYEDETTQYVGLSPVNKALNIICRWVENPNPDVLKRHITRINDYLWIAEDGMKTKGASEVDGHLHGSWEVAYHRLSELVSQGMDEVADLVFLAVEVDAASVSDEVVNVVIHVEVMARGAISLLVSWLGPKLLVMLLVKCIHLVIGVAIVVDEVLHACQPWCWILGAIISWSDGSGHESGCSVWCANTKSYIERHVEPIARCQAAAVVVPPILKELLDLELVS

SEQ ID NO: 19174 - DNA, 1392 bp, Sorghum bicolor
  misc_feature: Ceres ANNOT ID no. 8723846
  misc_feature: Encodes the peptide sequence at SEQ ID NO 19175
atgagtggattggatgatgccatcgtgccaagtggtgtgctatcatgccttcgctatctaaagcggatggagtcagatgtggtccgaggtgccttgatgtgggcgtgtgcgttccaacttccaacttccaactccaagcattatgactctagttccaggctggaagggggcagcgcagctctggaaaactgcagcgccaccgagttcttagggtcaaattcttcttttggttatcagtgcacagcagactatggacgacggcagaatggcgacacagacacaatctgcaggatgataacctgtgtgcgctctgggcacacggtgtcgagacgacggatcacttgcttgcaggctgcgtattcttcagagaactctggaccagagggtcctccatggtcttcagttggccgtgccggtgtcgtccatggatgttcagttagtccgctggtgagcgtggctccatccaagcagatgagcagccccatcaccgacggtgccaggctgcggcgagcggcgtcgtccttccccgcggcggcaccggcctcggcaaggcccgtcacggcgccgcgcttcatccagcacaagaaggaggccttatggttctaccgcttcatctccatcggctacgaccgcgtcttcaacccggaacaatacaccgaggacatgcgcgacgacgcgctggagcccgccggcctcctctacagccgccacctcaaggtcgtcgacgtcggcggcggcacggggttcaccacgctcggcatcgtcaagcacgtcgacccggagaacatcacgctgctcgaccagtcgccggaccagctccagaaggcacggcagaaggaggccctcaaggaggtcaccatcatggagggcgacgccgaggacctcccgttccctaccgactccttcgaccgatatgtctccgccggcagcatagagtactggcctgacccacagcgagggatcaaagaagcatacagggtgttgaggtctggtggggtagcttgtgtgattggcccggtgtacccaaccttctggctgtcccgcttcttcgccgacatgtggatgctcttccccaaggaggaagagtatatcgagtggtttcagaaggctgggtttaaggatgtcgagctgaagaggattggaccaaagtggtaccgtggtgttcgaaggcatggcctcatcattggttgctctgtcacaggtgtcaagagagcgagtggagactctcccttgaagcttggtcctaaggcggaggatgtcagcaatccagtgaatccgatcatcttcttctttcgcttcctcgtaggaacaatatgtgctgcatactatgttctggtgcctatttatatgtggataaaggaccagatcgtgccaaatggcatgccaatctga

SEQ ID NO: 19175 - protein, 463 aa, Sorghum bicolor
  misc_feature: The sequence is a functional homolog of SEQ ID NO 16 in US patent 7262339
  misc_feature: Useful for making plants with altered tocopherol content
  misc_feature: Functional homolog of the protein sequence given in SEQ ID NO 14694
  misc_feature: Ceres ANNOT ID no. 8723846
  misc_feature (263)..(337): SWISSPROT Homolog: EC 2.1.1.17 Phosphatidylethanolamine N-methyltransferase
  misc_feature (241)..(336): Pfam ID: Methyltransf_11 Pfam Description: Methyltransferase domain
MSGLDDAIVPSGVLSCLRYLKRMESDVVRGALMWACAFQLPTSNSKHYDSSSRLEGGSAALENCSATEFLGSNSSFGYQCTADYGRRQNGDTDTICRMITCVRSGHTVSRRRITCLQAAYSSENSGPEGPPWSSVGRAGVVHGCSVSPLVSVAPSKQMSSPITDGARLRRAASSFPAAAPASARPVTAPRFIQHKKEALWFYRFISIGYDRVFNPEQYTEDMRDDALEPAGLLYSRHLKVVDVGGGTGFTTLGIVKHVDPENITLLDQSPDQLQKARQKEALKEVTIMEGDAEDLPFPTDSFDRYVSAGSIEYWPDPQRGIKEAYRVLRSGGVACVIGPVYPTFWLSRFFADMWMLFPKEEEYIEWFQKAGFKDVELKRIGPKWYRGVRRHGLIIGCSVTGVKRASGDSPLKLGPKAEDVSNPVNPIIFFFRFLVGTICAAYYVLVPIYMWIKDQIVPNGMPI

SEQ ID NO: 19176 - DNA, 1050 bp, Sorghum bicolor
  misc_feature: Ceres ANNOT ID no. 8723849
  misc_feature: Encodes the peptide sequence at SEQ ID NO 19177
atggcgatggcctccacctacgcgccaggcggcggcgcgggggcgctcgcgccgggaaagggcagggtccgcggccccgctgggctcggcttcctcagcccatccaaggtcggcggcctcccccgccctctcgccctcgccaagcggagtcccgtcgcggccaggctgcggtgcgcggcgtcgtcgtcctcccccgcggccccggcggcgcggcccgtcacggcgccgcgcttcatccagcacaagaaggaggccttctggttctaccgcttcctctccatcgtgtacgaccacgtcatcaacccgggccactggaccgaggacatgcgcgacgacgcgctggagcccgccgagctctacagccgccacctcaaggtcgtcgacgtcggcggcggcaccggcttcaccacgctcggcatcgtcaagcacgtcaacccggagaaagtcacgctgctcgaccagtccccgcaccagctcgagaaggcgcgccagaaggaggcactcaagggggtcaccatcatggagggcgacgctgaggacctcccgttccccaccgactccttcgaccgatacatctccgccggcagcatcgagtactggccagacccacagcgggggatcaaggaagcctacagggtgttgaggtttggtgggctagcttgtgtgattggcccagtgtacccaaccttctggctgtcccgcttcttcgccgacatgtggatgctcttccccaaggaggaagagtacatcgagtggttcaccaaggccgggtttaaggatgtcaagctgaaaaggatcggaccaaagtggtaccgcggtgtccgaaggcatggcctcatcatgggttgctctgtcacaggcgtcaagagacagagcggagactctcccttagagcttggtcccaaggcggaggatgtcagcaagccagtgaatccgatcaccttcttctttcgcttcctcgtaggaacaatatgtgctgcgtactatgttctggtgcctatttacatgtggataaaggaccagatcgtgccaaaaggcatgccaatttga

SEQ ID NO: 19177 - protein, 349 aa, Sorghum bicolor
  misc_feature: The sequence is a functional homolog of SEQ ID NO 16 in US patent 7262339
  misc_feature: Useful for making plants with altered tocopherol content
  misc_feature: Functional homolog of the protein sequence given in SEQ ID NO 14694
  misc_feature: Ceres ANNOT ID no. 8723849
  misc_feature (149)..(223): SWISSPROT Homolog: EC 2.1.1.17 Phosphatidylethanolamine N-methyltransferase
  misc_feature (127)..(222): Pfam ID: Methyltransf_11 Pfam Description: Methyltransferase domain
MAMASTYAPGGGAGALAPGKGRVRGPAGLGFLSPSKVGGLPRPLALAKRSPVAARLRCAASSSSPAAPAARPVTAPRFIQHKKEAFWFYRFLSIVYDHVINPGHWTEDMRDDALEPAELYSRHLKVVDVGGGTGFTTLGIVKHVNPEKVTLLDQSPHQLEKARQKEALKGVTIMEGDAEDLPFPTDSFDRYISAGSIEYWPDPQRGIKEAYRVLRFGGLACVIGPVYPTFWLSRFFADMWMLFPKEEEYIEWFTKAGFKDVKLKRIGPKWYRGVRRHGLIMGCSVTGVKRQSGDSPLELGPKAEDVSKPVNPITFFFRFLVGTICAAYYVLVPIYMWIKDQIVPKGMPI

SEQ ID NO: 19178 - DNA, 2382 bp, Sorghum bicolor
  misc_feature: Ceres ANNOT ID no. 8723863
  misc_feature: Encodes the peptide sequence at SEQ ID NO 19179
atggcgaaggtggcgtcgaacggggcgttccagggagagaacccgctggacttcgcactgccgctcatcatcctgcagatctgcctcgtcctcgtcgtcacccgcggcctcgcctaccttctccgcccgctccggcagccccgcgtcatcgccgagatcatcggaggcatcctgcttggcccgtcggcgctgggccggagcaccaagttcctgcacaccgtcttcccgccggcgagcatgacggtgctggacacgctggcgaacctgggcctgctcttcttcctcttcctcgtgggtctcgagctcgacatctccgccatccgccgcaccgggaggaaggccctggccatctccctctccggcatcgcgctcccgttcgcgctcggcgtcggcacgtccttcgcgttccgcgccaccgtcgtcaaggacgccccgcacgctccgttcctcgtgttcatgggcgtcgcgctctccatcaccgcgttccctgtgctcgcgcgcatcctcaccgagctcaagctcctgaccaccgacctcggccgcatggcgctgtccgccgccgccgtcgacgacgtcatggcgtggatcctcctcgcgctcgccatcgcgctctcgggctccagctcgccgatcatctcgctctgggtcctgctcaccgcctccgcctttgtcgccgccgcgttcctgcttctcaaaccggtgctcgcgtggatgtctcgccagtgccgcgacggtgagcccatcaaggagctccacgtctgcgcgaccctcggcatcgtcctcgccgccggcttcaccaccgacgtcatcggcatccacgcgctgttcggcgggttcgtcgtcggtgtggtcgtccccaaggacggtccgttcgccggcatgctcatcgagaaggtggaggacctcgtctcggggctcttcctcccgctctacttcgtctccagcggcctcaagaccaatgtcgccaccatcagcggggccaagtcatggggcttgctcgtgctcgtcatcgcgaacgcgtgcctcggcaagatcggcggcgcggtcaccaccgcactgctcgtcaagatccccgtccgtgaggcggtcacccttggcttcctgatgaacaccaaggggctcgtcgagctcgtcgtgctcaacatcggccgggaccgcaaggtcctcaacgacgaggcgttcgccatcatggtgctcatggcgctcttcaccaccttcatcaccacgcccatcgtcatggcggtctacaagccggcgcggccggcggcgccgtacaagcgccgcaccgtggagtgcgcgcccggcgacgacaccagcgagctgcgcgtgctggcctgcttccacgccagccgcagcatcccgacgctgctcaacctcgtcgaggcgtcgcgcggcacggggcggcgccgcctcgtcatgtacgccatgcacctcgtggagctctcggagcggtcgtcgtcgatcaccatggtccagcgcgcccgccgcaacggcgcgccgttcttcaacagcgccgacaggccggagggccagatggtggtggcgtttgaggctttccagcagctgagctccgtgagggtgcgcgccatgacggcgatctcggacatggacacccaccgggacgtcatcgacagcgccgccggcaagcgtgcggccatcgtcgtcatgccgtaccacaaggcgctccagcaggacggctccttggtgtcgctggggtcggcgtaccacgccatcaacaagcgcgtgctccgcgaggcgccctgctccgtcgccgtcctcgtcgaccgtggcctcggtggccccgcgcaggtgtccgccaagaacgtgtccttctccgtcgcgacgctcttcttcggcgggcccgacgaccgtgaggcgctcgcctacacgacgcgcatggcggagcatccgggtgtcgccgtcacgctggcaaggttccgtccgcactcctccggcgaggagagcgccgacgacgaggcggcggtcgaggctttcaagtcgaagctcggcatggtgaaggatggatcggtgcacttcgaggagcggcaggggtacacgaaggaggaggtgctggagaccatcaacgcgctgtccaagttcaatgtgttcgtcgtgggaaggatgccgccgacggcggcgctggtggagaatcccgacgagctgggcccagtgggcagctacctggcgtcgccggagttcaggacgtcggcgtccgttctggtgatcaagagatacgacccggcgacgaacccgaagagcaagaggttcgaccccagcgcgaggccgccggcagcgacggaggaggacgtgctggatgaggagatgggaagcaggtccactgtggtgccagtgccatggtcgccgacgagcgacgcggcctga

SEQ ID NO: 19179 - protein, 793 aa, Sorghum bicolor
  misc_feature: Useful for making plants with modulated heat sensitivity
  misc_feature: Functional homolog of the protein sequence given in SEQ ID NO 13975
  misc_feature: Ceres ANNOT ID no. 8723863
  misc_feature (27)..(414): Pfam ID: Na_H_Exchanger Pfam Description: Sodium/hydrogen exchanger family
MAKVASNGAFQGENPLDFALPLIILQICLVLVVTRGLAYLLRPLRQPRVIAEIIGGILLGPSALGRSTKFLHTVFPPASMTVLDTLANLGLLFFLFLVGLELDISAIRRTGRKALAISLSGIALPFALGVGTSFAFRATVVKDAPHAPFLVFMGVALSITAFPVLARILTELKLLTTDLGRMALSAAAVDDVMAWILLALAIALSGSSSPIISLWVLLTASAFVAAAFLLLKPVLAWMSRQCRDGEPIKELHVCATLGIVLAAGFTTDVIGIHALFGGFVVGVVVPKDGPFAGMLIEKVEDLVSGLFLPLYFVSSGLKTNVATISGAKSWGLLVLVIANACLGKIGGAVTTALLVKIPVREAVTLGFLMNTKGLVELVVLNIGRDRKVLNDEAFAIMVLMALFTTFITTPIVMAVYKPARPAAPYKRRTVECAPGDDTSELRVLACFHASRSIPTLLNLVEASRGTGRRRLVMYAMHLVELSERSSSITMVQRARRNGAPFFNSADRPEGQMVVAFEAFQQLSSVRVRAMTAISDMDTHRDVIDSAAGKRAAIVVMPYHKALQQDGSLVSLGSAYHAINKRVLREAPCSVAVLVDRGLGGPAQVSAKNVSFSVATLFFGGPDDREALAYTTRMAEHPGVAVTLARFRPHSSGEESADDEAAVEAFKSKLGMVKDGSVHFEERQGYTKEEVLETINALSKFNVFVVGRMPPTAALVENPDELGPVGSYLASPEFRTSASVLVIKRYDPATNPKSKRFDPSARPPAATEEDVLDEEMGSRSTVVPVPWSPTSDAA

SEQ ID NO: 19180 - DNA, 915 bp, Sorghum bicolor
  misc_feature: Ceres ANNOT ID no. 8724072
  misc_feature: Encodes the peptide sequence at SEQ ID NO 19181
atggaggaggagaaaaagccatctcaaaggatcaccaagaaggagaatggtggcagagcagacgacagaaacgaagaggatgatttggtgttcccgggcttccggttccatccaaccgatcaggagctcgtgggattctacctgaagaggaaagtggagaagaagagcttcagtattgacatcatcagggagattgatatctacaagcatgacccctgggatcttccaaatgaagctcgggatatggtgcagggcacaggagacaaggactgctacttcttctgcctgcgtggccggaagtaccggaacagcatccggcccaaccgcgtcactggctctggcttctggaaggccaccggcatcgacaagccaatacacgatggtgctggtgaatgcgtcgggctcaagaagtctctcgtctactaccgcggcagtgccggcaggggaaccaagactgactggatgatgcacgagttccgactcccctccacggagttggttgagctccatgatgctgaaatatggactatatgccggatcttcaagaggagcacatcgtacaaccggaggtgccagcagcagcagaagcaggaacaaggcagcaagcgaaaccaccaccagcagcaacagttgcagtactactatgactactaccgctaccaccagcagcagcagcaccattacttccactcatccgaggcggcttatgctgcaactgagcaccaccagcccttcctgctacgcggtttccatggttcatcgccgtcatcaaccgagatgacggtgtcatcaggattcatgggagtgggacctccattgccaccatcgacatcgaatctcgggtggagcgatgtgacatgcttacaggacagtggcagcacctgggacgagcttgggaggatcatggagatctga

SEQ ID NO: 19181 - protein, 304 aa, Sorghum bicolor
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 310 in the 10/666,642 US patent application
  misc_feature: The sequence is a functional homolog of SEQ ID NO 2592 in the 10/374,780 US patent application
  misc_feature: The sequence is a functional homolog of SEQ ID NO 288 in the 10/225,066 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: Useful for making plants with modulated light quality response
  misc_feature: Functional homolog of the protein sequence given in SEQ ID NO 13870
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with altered terpenoid content
  misc_feature: Functional homolog of the protein sequence given in SEQ ID NO 13966
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: Ceres ANNOT ID no. 8724072
  misc_feature (30)..(162): Pfam ID: NAM Pfam Description: No apical meristem (NAM) protein
MEEEKKPSQRITKKENGGRADDRNEEDDLVFPGFRFHPTDQELVGFYLKRKVEKKSFSIDIIREIDIYKHDPWDLPNEARDMVQGTGDKDCYFFCLRGRKYRNSIRPNRVTGSGFWKATGIDKPIHDGAGECVGLKKSLVYYRGSAGRGTKTDWMMHEFRLPSTELVELHDAEIWTICRIFKRSTSYNRRCQQQQKQEQGSKRNHHQQQQLQYYYDYYRYHQQQQHHYFHSSEAAYAATEHHQPFLLRGFHGSSPSSTEMTVSSGFMGVGPPLPPSTSNLGWSDVTCLQDSGSTWDELGRIMEI

SEQ ID NO: 19182 - DNA, 1974 bp, Sorghum bicolor
  misc_feature: Ceres ANNOT ID no. 8724153
  misc_feature: Encodes the peptide sequence at SEQ ID NO 19183
atggctacttattactcgagccagggcagtgaaagggactcacagaacatgtattctagagaacccagcaatgcatcctatcctatgtcgtcggctctagggaacttgctttatctgaacaatcctgcttctggaccatacacagagttcagtggcattctacagtcccagcagaattgcatggagatgcctgaacctggccatccttcagtgatgtcccaagactcatctgcaagggagtccgacatgcttggttcccaccagggtcagcgctctttcggcctagtcaaagatatgaagaacgagatgttgatgcatatgatggatgggtcacagagcagtacagctgatctcatccatgatgatgcccaaaatggtatccagcttgattttggtgttctgaacaaccacggctcgtcgaacattccctcagtgcaaggccaaggtttatctctcagcctcaacacacaaatcctggcaccttccttgccatactggtctgtcaaaccagatatgttgtcgccacactcttaccatgacagtcttcgagtcgatgacatccgaatgaagagtatgcagtctgagtcctcacgagcaatccggaactcaaggtatctgaaagcagcacaagagctgcttgatgaagttgtgaacgtttggaagaacattaagcagaaagcccagaaagaacaggtagaagcaggaaagacggatggcaaagagaccgagggagggccgaaaagtgagggtgtgtcctctaatccgcaggaatctggtgccaatgcagcaccggagctttctactgctgagaagcaagagcttcagaacaagatggcaaagctgatggcaatgttggatgaggtggaccggaaatacaagcactactaccatcaaatgcagagtgttgtttcgtcttttgatatggtagctgggcctggagctgccaagccttacactgcagttgctctccagacaatctcacgacacttccggtgcctgaaggatgctatcaatgatcagatcaatgtcatcaggaagaagctcggggaggaggaaagttcatctggcaaggagggcaaactaactcgtctccggtacatcgatcaacagctcaggcaacaacgagctttccaacagtatggcatgatcccacaaaatgcttggaggccacagagagggcttcctgaaaactctgttaccattcttcgtgcttggctctttgagcatttccttcacccgtaccctaaagattctgaaaaattgatgctagcaaggcaaacaggcttgacaaggagccagatttcaaactggttcatcaacgcccgtgtccgtctctggaaaccgatgatcgaggacatgtacaaagaagagattggagatatcgagcaagactccaactcttcctccgacaacacgccaagaagcaagggcaagatggtatcttctgaagacaaggaagacccgaggagttgtacgcctcgggtctgcgagagcagtcagctgagcgagtcaagaggcagcatgaggaccatgaacgccgtcggcggtggagcagccatgggattccagaacgagcccaaccctgacgacaccttcatgaacctgatgctgaaggaccaacgatcaaacggagaagaagatggcggcctcctcctccacaatgccgtggcgcagcatcaagatgagaacgcccggttcatggcgtaccacctggcggaacttgggaggtacgggaacggcaatgtgtcgctcaccctggggctgcagcactccagcagcagcagcctctcggttcccaacgcccagcagagctttcctggtgtcggtgtcggtgtcggagacgatgacatctacaacgccgccgccgctcccctcggtgtcagcgtggcgtcgtcggactacgagacgatgaaccagatggatcaacggcaacggttcgagcagtcaccccttctgcatgattttgtggcctga

SEQ ID NO: 19183 - protein, 657 aa, Sorghum bicolor
  misc_feature: The sequence is a functional homolog of SEQ ID NO 1877 in the 11/479,226 US patent application
  misc_feature: The sequence is a functional homolog of SEQ ID NO 436 in the 10/666,642 US patent application
  misc_feature: The sequence is a functional homolog of SEQ ID NO 820 in the 11/435,388 US patent application
  misc_feature: Ceres ANNOT ID no. 8724153
  misc_feature: Down-regulated in root tissues in response to salicylic acid treatment
  misc_feature (198)..(339): Pfam ID: POX Pfam Description: Associated with HOX
MATYYSSQGSERDSQNMYSREPSNASYPMSSALGNLLYLNNPASGPYTEFSGILQSQQNCMEMPEPGHPSVMSQDSSARESDMLGSHQGQRSFGLVKDMKNEMLMHMMDGSQSSTADLIHDDAQNGIQLDFGVLNNHGSSNIPSVQGQGLSLSLNTQILAPSLPYWSVKPDMLSPHSYHDSLRVDDIRMKSMQSESSRAIRNSRYLKAAQELLDEVVNVWKNIKQKAQKEQVEAGKTDGKETEGGPKSEGVSSNPQESGANAAPELSTAEKQELQNKMAKLMAMLDEVDRKYKHYYHQMQSVVSSFDMVAGPGAAKPYTAVALQTISRHFRCLKDAINDQINVIRKKLGEEESSSGKEGKLTRLRYIDQQLRQQRAFQQYGMIPQNAWRPQRGLPENSVTILRAWLFEHFLHPYPKDSEKLMLARQTGLTRSQISNWFINARVRLWKPMIEDMYKEEIGDIEQDSNSSSDNTPRSKGKMVSSEDKEDPRSCTPRVCESSQLSESRGSMRTMNAVGGGAAMGFQNEPNPDDTFMNLMLKDQRSNGEEDGGLLLHNAVAQHQDENARFMAYHLAELGRYGNGNVSLTLGLQHSSSSSLSVPNAQQSFPGVGVGVGDDDIYNAAAAPLGVSVASSDYETMNQMDQRQRFEQSPLLHDFVA

SEQ ID NO: 19184 - DNA, 486 bp, Sorghum bicolor
  misc_feature: Ceres ANNOT ID no. 8724159
  misc_feature: Down-regulated in root tissues in response to salicylic acid treatment
  misc_feature: Encodes the peptide sequence at SEQ ID NO 19185
atgacgagctcgtcctctccttcccgaaaggcgctgagcaagatcgcttgcaatcggctgcagaaggagctcgcggagtggcagctcaacccccccgccgggttcaagcacaaggtctccgataatcttcaaaggtgggtaattgaggttaccggagcggcgggcactctttacgccggcgagacctaccagttgcaggttgactttcctgagcattaccctatggaggcacctcaggtcatttttctcaatccagcgccaatgcatccacacatttacagcaatgggcacatctgcttagatattttgtatgactcgtggtcaccagcgatgaccgtgagctctgtctgcatcagtatcctgtctatgttgtccagttcgccagcaaagcaacgcccagcggacaatgaccgctatgttaggaactgccgcaacgggaggtctccgaaggagactagatggtggttccatgacgacacagtgtaa

SEQ ID NO: 19185 - protein, 161 aa, Sorghum bicolor
  misc_feature: Useful for making plants with modulated oxidative stress sensitivity
  misc_feature: Functional homolog of the protein sequence given in SEQ ID NO 13045
  misc_feature: Ceres ANNOT ID no. 8724159
  misc_feature (1)..(161): SWISSPROT Homolog: EC 6.3.2.19 Ubiquitin--protein ligase
  misc_feature (19)..(158): Pfam ID: UQ_con Pfam Description: Ubiquitin-conjugating enzyme
MTSSSSPSRKALSKIACNRLQKELAEWQLNPPAGFKHKVSDNLQRWVIEVTGAAGTLYAGETYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDTV

SEQ ID NO: 19186 - DNA, 516 bp, Sorghum bicolor
  misc_feature: Ceres ANNOT ID no. 8724183
  misc_feature: Encodes the peptide sequence at SEQ ID NO 19187
atggatcatcatccacagcagcagcagagtggcaagaatacggcggagcttgacccggtgctgcactcgatggggttcgagatcgaggaggtgtcgccgtcgcaggtgaccggacgactccccatcacatccaagtgctgccaggtgctccacggcggcgtgtcggcgctggtggcggagggccttgccagcatgggcgcgcacatggcgtcgggcttccggcgggtggccggcgtcagcttgagcatcaaccacttccgcagcgccaaggtgggagacgtcgtcctcgtccgcgctgccccgctccacatcggccgctcaacccaggtgtgggatgtgaagctatggaagcaggatccgttgacgcaggggaagaaggggcctcagatctccgagtcaagggtcacgctgctttgcaatctgcccgtgccggacaacctcaagaacgccgccgatgcactcaagaagtacgccgccgccgcagccaaatccaccaccgccaccagcagattgtag

SEQ ID NO: 19187 - protein, 171 aa, Sorghum bicolor
  misc_feature: Useful for making plants with modulated biomass
  misc_feature: Functional homolog of the protein sequence given in SEQ ID NO 13187
  misc_feature: Ceres ANNOT ID no. 8724183
  misc_feature (47)..(124): Pfam ID: 4HBT Pfam Description: Thioesterase superfamily
MDHHPQQQQSGKNTAELDPVLHSMGFEIEEVSPSQVTGRLPITSKCCQVLHGGVSALVAEGLASMGAHMASGFRRVAGVSLSINHFRSAKVGDVVLVRAAPLHIGRSTQVWDVKLWKQDPLTQGKKGPQISESRVTLLCNLPVPDNLKNAADALKKYAAAAAKSTTATSRL

SEQ ID NO: 19188 - DNA, 1278 bp, Sorghum bicolor
  misc_feature: Ceres ANNOT ID no. 8724191
  misc_feature: Encodes the peptide sequence at SEQ ID NO 19189
atgaagcccctcgcgcactccctccacgcggccgtcgaccgccgttggctactccctctggccatcggctccgcgctctcgctcctcctcctcgtcgcgctcaccaccttcccctcgcccttcccctccacctccacgccctcctcctcctcgtcgctcttcgtggagcacaagctcgcccccaccccgccgtcccccgccgccggctcaccgccccgcatcgccttcctcatctccggatccgcgggggacgcctccgcgctccgccgcgtcctcctcgcgctctaccaccccaggaaccgctacatcttgcacctcgatgccgaggcgcccgactccgaccgcaccagcctcgccgccgacctcgcctcccaccccgccatcgccgccgccgccaacgtccgcgtcgtcgaccgtgctaacctcgtcacgtaccgtggacccaccatggtcgccaacacgctccacgccgccgccgccttcttgtggggtcacgccggcgacggcggctcacaatgggattggttcatcaacctctccgcctccgattacccgctcgtcacgcaggatgatctgatacatgtattctccaagctgccgcgtgatctcaacttcatcgaccacaccagcgacattggatggaaggagttccagagggcgaagccggtcatcattgatccagggctctacatgaagaagaaggccgacgtgttctggataccgcagaggcggagcgtccctacagcattcaagctattcactggttctgcttggatggcactgtcgaggccctttgtcgaatactgcatatggggctgggataacctacctcgcacagtgctcatgtactattccaatttcatctcctcgcctgaaggatacttccacactgtggtctgcaacgccgatgaattcaagaacacgaccgtgaaccatgacctgcattacatctcatgggacaaccctccaaaacagcacccgcactacctgacggttgaagacttggaccgcatggttgccagtgacgcgccatttgctcggaagttccacgaggatgatctggtgctggacaagatagatgaggagatcctgggtcgtggcgtggacatgccgactcctggaggctggtgtgctggaacgcgggagaacgggagcgacccttgcacgatgattggaaacaccagcctcctccagcctggccgtggagctgtgcgactgcagcggctgatcacgttgttgctgtcggaggagaagttccacccaaggcagtgcaagtag

SEQ ID NO: 19189 - protein, 425 aa, Sorghum bicolor
  misc_feature: Useful for making plants with altered carbohydrate content
  misc_feature: Functional homolog of the protein sequence given in SEQ ID NO 13727
  misc_feature: Ceres ANNOT ID no. 8724191
  misc_feature: Down-regulated in shoot tissues in response to aminocyclopropane carboxylic treatment
  misc_feature (173)..(380): SWISSPROT Homolog: EC 2.4.2.26 Protein xylosyltransferase
  misc_feature (74)..(304): Pfam ID: Branch Pfam Description: Core-2/I-Branching enzyme
MKPLAHSLHAAVDRRWLLPLAIGSALSLLLLVALTTFPSPFPSTSTPSSSSSLFVEHKLAPTPPSPAAGSPPRIAFLISGSAGDASALRRVLLALYHPRNRYILHLDAEAPDSDRTSLAADLASHPAIAAAANVRVVDRANLVTYRGPTMVANTLHAAAAFLWGHAGDGGSQWDWFINLSASDYPLVTQDDLIHVFSKLPRDLNFIDHTSDIGWKEFQRAKPVIIDPGLYMKKKADVFWIPQRRSVPTAFKLFTGSAWMALSRPFVEYCIWGWDNLPRTVLMYYSNFISSPEGYFHTVVCNADEFKNTTVNHDLHYISWDNPPKQHPHYLTVEDLDRMVASDAPFARKFHEDDLVLDKIDEEILGRGVDMPTPGGWCAGTRENGSDPCTMIGNTSLLQPGRGAVRLQRLITLLLSEEKFHPRQCK

SEQ ID NO: 19190 - DNA, 3309 bp, Sorghum bicolor
  misc_feature: Ceres ANNOT ID no. 8724211
  misc_feature: Down-regulated in shoot tissues in response to aminocyclopropane carboxylic treatment
  misc_feature: Encodes the peptide sequence at SEQ ID NO 19191
atggggggcgatggtgttcctgagcctgacgacgcggtgctcttcgttggggtgtcgctggtgctgggcatcgcctcccgccacctcctccgcgggacccgcgtcccctacaccgtcgcccttctcgtcctcggagtcgcgcttgggtccctcgaatacggaacacaacatggtctaggcaaacttggagctggaattcgtatctgggctaacataaaccctgatcttctgctggctgtctttttacctgccctcctctttgaaagctccttctccatggaagtacaccaaataaagagatgtatggcacagatggtgttacttgctggaccaggtgtggtagtatcaacagttttacttggtgctgccgtaaagctcacttttccttacaactggagctggaaaacatcattgttgcttggcggactgcttagtgcaactgatccagttgctgtggttgcactgctaaaagaactcggagcaagtaaaaagcttagtacaatcattgagggtgaatccttaatgaatgatgggaccgctatcgttgtctatcagttattctatcgaatggtgcttggaagaacctttgatgctggctcaataataaagttcttgtctgaagtttcacttggagctgttgctctgggccttgcatttggaatcatgtcaatactgtggctaggctttatttttaatgatacaatcatagagattgcacttactcttgctgtcagctatatagctttcttcactgcgcaagactcactcgaggtctctggtgttttgaccgtcatgacactgggaatgttctatgcagcttttgcaaaaactgcttttaagggtgaaagtcagcaaagtttacaccatttctgttcatggggcttccttctgctgctctatgtctttgtacagatatctcgacttatagttgttggtgttttgtaccctttgttgcgtcagtttgggtatgggttggactggaaagaggccatgattcttgtttggtcagggctgcgaggggctgttgctctgtcactatcattatctgttaagcgtaccagcgatgcagttcaaccttaccttaaaccagaagttggaacaatgtttgtgttcttcactggtggcatcgtgtttctgacattgatttttaatggctcaaccacacaatttttgctacatatgctcagcatggacaaattgtcggccacaaagcttcgtatattgaaatatacaagatatgaaatgctaaacaaagcattagagtcttttggtgagctaagggatgacgaggaacttggacctgctgactggattactgtaaagaaatatatcacatgtttgaatgacctagacaatgagccagagcatccccatgatgtcagtggcaaagatgatcacatgcatatcatgaacttaacagatatccgagtgcggcttttgaatggtgtgcaagctgcttactggggaatgcttgaagaaggacgaataactcaagctacagcaaatattctgatgagatccgttgatgaagctatggatcttgtttccgaacaaaaattatgtgattggaaaggtttaaagtctaatgtccagttcccaaattactataggttccttcagatgagtaggttaccacgaaagcttgtcacatacttcacagtcgaaagattagagtctggatgttacatctgtgctgcatttcttcgtgctcacagaattgcaaggcgacagctacatgattttcttggcgatagtgaggttgcaagaactgttattgatgaaagtaacgctgagggagaggaagctagaaaattcttggaagatgttcgagttacattcccgcaggtgctacgagtgctaaagacacgacaagtcacatattctgtgctgacacacttgagtgagtatattcaaaacctccagaagactgggctgctggaagagaaggaaatggtccagttagatgatgctctgcagacagacttgaagaagttgcagaggaatccaccaatagtgaaaatgccaagagtcagtgaccttctgaacactcatcctttagttggcgcgctgcctgctgctgtgcgtgatcctttgctaagtaatacaaaggaaaccgtgcgaggacagggcacaaccctgtatagggaaggctccaggccaaccggtatatggcttgtttctattggtgtagtaaagtggacgagtcagagattaagcagaaggcattgcttagatccaattctatcacatggaagcactttgggactgtatgaggtgctgattggaaagccatatatctgtgacatgaccacggattcagtggcacactgtttcttcatcgaaactgaaaagatagaagagctgcgccattcagatccttcgattgaggttttcctgtggcaggaaagcgctctggttcttgccaggcttttgctccctcgcatattcgagaaaatgggaatgcatgagatgagggttctcattgctgaaaggtcgaccatgaacatatacatcaagggagaagacttggaagtggaggagaattgcattggcattttgctggaaggattcttgaagaccgacaacctgactctaatcacgcctccagcggtgcttctgccatccgatgctgacttgggtctcgagtcctcagactactgtcatactgcacctaggtatcaggtggaagctagagcacggatcatcttcttggaggaggcagaggcccatcttcatcgaagtgcgtcgcggctgctgctgccccaagggcaaggaggaggtcatgagccaacacggagcatgagcaaggagcacagcggcttgctcagctggcccgagagcttccggaggtcccgtggcaacctaggcctagcagctgagatgctgccgggcggcttgtcttccagggccctgcaactgagcatgtacggcagcatggtgatcctctcctccggccagggccactctcaccggcggcaggggcgtcatcgcgtgcaggcgacgacaacagaccagaagcaaagctcgtcctacccaaggatgccatccatatccaaagaacggcctctgctctccgtgcaatcagagggctccaacatgaagcgagtggcagctctacctctcagagacgacgctgctgaggttgaggctccggcagcccagcagcggcggcggcggaaggctatgcacttgcaggaggacaactcaagcgacgactccgccggcgaagaagtcattgtcagagttgactcgcccagcatgctctctttccgtcagtcagccgccgcacctccgccgcaggaccagtag

SEQ ID NO: 19191 - protein, 1102 aa, Sorghum bicolor
  misc_feature: Useful for making plants with modulated salt sensitivity
  misc_feature: Functional homolog of the protein sequence given in SEQ ID NO 13433
  misc_feature: Ceres ANNOT ID no. 8724211
  misc_feature (13)..(394): Pfam ID: Na_H_Exchanger Pfam Description: Sodium/hydrogen exchanger family
  misc_feature (704)..(794): Pfam ID: cNMP_binding Pfam Description: Cyclic nucleotide-binding domain
MGGDGVPEPDDAVLFVGVSLVLGIASRHLLRGTRVPYTVALLVLGVALGSLEYGTQHGLGKLGAGIRIWANINPDLLLAVFLPALLFESSFSMEVHQIKRCMAQMVLLAGPGVVVSTVLLGAAVKLTFPYNWSWKTSLLLGGLLSATDPVAVVALLKELGASKKLSTIIEGESLMNDGTAIVVYQLFYRMVLGRTFDAGSIIKFLSEVSLGAVALGLAFGIMSILWLGFIFNDTIIEIALTLAVSYIAFFTAQDSLEVSGVLTVMTLGMFYAAFAKTAFKGESQQSLHHFCSWGFLLLLYVFVQISRLIVVGVLYPLLRQFGYGLDWKEAMILVWSGLRGAVALSLSLSVKRTSDAVQPYLKPEVGTMFVFFTGGIVFLTLIFNGSTTQFLLHMLSMDKLSATKLRILKYTRYEMLNKALESFGELRDDEELGPADWITVKKYITCLNDLDNEPEHPHDVSGKDDHMHIMNLTDIRVRLLNGVQAAYWGMLEEGRITQATANILMRSVDEAMDLVSEQKLCDWKGLKSNVQFPNYYRFLQMSRLPRKLVTYFTVERLESGCYICAAFLRAHRIARRQLHDFLGDSEVARTVIDESNAEGEEARKFLEDVRVTFPQVLRVLKTRQVTYSVLTHLSEYIQNLQKTGLLEEKEMVQLDDALQTDLKKLQRNPPIVKMPRVSDLLNTHPLVGALPAAVRDPLLSNTKETVRGQGTTLYREGSRPTGIWLVSIGVVKWTSQRLSRRHCLDPILSHGSTLGLYEVLIGKPYICDMTTDSVAHCFFIETEKIEELRHSDPSIEVFLWQESALVLARLLLPRIFEKMGMHEMRVLIAERSTMNIYIKGEDLEVEENCIGILLEGFLKTDNLTLITPPAVLLPSDADLGLESSDYCHTAPRYQVEARARIIFLEEAEAHLHRSASRLLLPQGQGGGHEPTRSMSKEHSGLLSWPESFRRSRGNLGLAAEMLPGGLSSRALQLSMYGSMVILSSGQGHSHRRQGRHRVQATTTDQKQSSSYPRMPSISKERPLLSVQSEGSNMKRVAALPLRDDAAEVEAPAAQQRRRRKAMHLQEDNSSDDSAGEEVIVRVDSPSMLSFRQSAAAPPPQDQ

SEQ ID NO: 19192 - DNA, 2322 bp, Sorghum bicolor
  misc_feature: Ceres ANNOT ID no. 8724238
  misc_feature: Encodes the peptide sequence at SEQ ID NO 19193
atgccggacctcccctgcgacggcgatggcgtctgcatggtctgccgcgccgcctccccgccggaggtcgacctcctccgctgctccacctgcgccacgccctggcactccccgtgcctctccaagccccccgccctcgccgacgccgccagctggagctgccccgactgctcccccgaccccgccgccgccgccgctccctccggccccgccaacaccctcgtcgccgccatccgcgccatcgaggccgacaccaccctctccgaccacgagaaggcgcgccgccgccaggccctcctcgccggcgacgcccacgacgacgacgacgatgacgacgccgcggcagacgatgccctcgagatcgtcggcaagaacttcagctgcgtcttctgcatgaagctcccggaccgacccgtcacgacaccatgtggccataacttctgcttgaagtgcttccagaagtggattcagaacaggaagaggacctgtgcgaaatgtagggcacagatcccggccaaaatggctgagcagccaagaatcaactcagctctagttgaagttatcaggatggctaagatttcaaagaatcctaactctgctggctctgcagttccgtatcactacatacgaaatgatgataggcctgataaggcatttacaactgacagggctaagaagtctggaaaagcaaacgcatcaagtggccagatctttgtgaccattgcacctgatcattttggccccattcttgcagaaaatgacccacgcaggagtattggtgttcgagttggggaaacatgggaggaccgacttgagtgcagacaatggggcgctcactttcctcatgtggctggtattgctggccagtccacgtatggtgctcagtcagtagctctttcaggaggatatgaagatgacgaagatcatggagagtggtttctttacactggaagtggtgggagggatctaagtgggaacaagcggacgaacaaggaacagtcatctgatcaaaaatttgagaagctgaatgctgctttacgcattagttgcttgaagggctacccggtcagggttgtgcggtcgcacaaagagaagcgatcctcatatgctcctgaaagcggtgtaaggtatgatggggtttacagaattgagaagtgctggaggaagattggtattcagggtaagttcaaggtctgcaggtatctctttgtacgctgtgataatgaaccagctccttggaccagtgatgatcacggtgatcgtccaagacccttgccaaagataaaggagctgcaaggtgcaactgatataacagagaggaaagggcgtccttcatgggattatgatgagaaagatggctggaaatggatggtgcctccgccagtcagcaagaagcctgttctctctggggatcctgagactgacaagcaaatccggagatcaacaaagcgtgctcatttgtctgttgctgaaaggctgcttaaagagtttggttgttctatctgccgggcagtgattaaagaaccacttacgactccatgtgctcacaacttttgcaagacttgtttgcttgggaaatatgatagccaatcctctatgagggaaagaagccgtggtggtcggactctaagggcacagaagattgtgaagacgtgcccttcctgcccaactgacatctgtgacttcttagagaatccccagatcaatcgagaaatgatggagctgattgagactttgcaacgcaaggctgttgaagaaggcaaggtggcttcagatgatgctgaggaatgtggtgatggtgactcggaggaaaatgatggtgctttggtgaagggagaggaggatgatagcggcttgaatgaggaagagcaagacagtgcagatgctgatgctaatgctgatggttctgtgaagattgtggttgaaatcaaggagggaggaaaagatgataaaaagtcagagatgggtgcgactgaagtggtggatgtgttagttgatgaagatgctgcgaaacagacgaagaagcgcaaggttgatgaagatgctgtgaaacagacaaagaagcgcaagggtgatgctgagactggcaccaacggtgccaagaggatgaagagcagtgctgccgtggaagaggttgctgtgtgtggcactcctgtgaaacggaccaggaagagtggtgatatggatgctgaaggcaacggcagtcctgctgtgagcagtggccgcagggtgacccgtagcagcagtgtgaatgccactggagctgatgatagtccggcgaggaggaccagaagccgtgctggagctgatgctggttgctga

SEQ ID NO: 19193 - protein, 773 aa, Sorghum bicolor
  misc_feature: The sequence is a functional homolog of SEQ ID NO 2314 in the 10/374,780 US patent application
  misc_feature: The sequence is a functional homolog of SEQ ID NO 522 in the 10/225,066 US patent application
  misc_feature: Ceres ANNOT ID no. 8724238
  misc_feature (294)..(445): SWISSPROT Homolog: EC 2.1.1.43 Histone-lysine N-methyltransferase
  misc_feature (251)..(409): Pfam ID: YDG_SRA Pfam Description: YDG/SRA domain
  misc_feature (128)..(166): Pfam ID: zf-C3HC4 Pfam Description: Zinc finger, C3HC4 type (RING finger)
  misc_feature (499)..(555): Pfam ID: zf-C3HC4 Pfam Description: Zinc finger, C3HC4 type (RING finger)
  misc_feature (11)..(60): Pfam ID: PHD Pfam Description: PHD-finger
MPDLPCDGDGVCMVCRAASPPEVDLLRCSTCATPWHSPCLSKPPALADAASWSCPDCSPDPAAAAAPSGPANTLVAAIRAIEADTTLSDHEKARRRQALLAGDAHDDDDDDDAAADDALEIVGKNFSCVFCMKLPDRPVTTPCGHNFCLKCFQKWIQNRKRTCAKCRAQIPAKMAEQPRINSALVEVIRMAKISKNPNSAGSAVPYHYIRNDDRPDKAFTTDRAKKSGKANASSGQIFVTIAPDHFGPILAENDPRRSIGVRVGETWEDRLECRQWGAHFPHVAGIAGQSTYGAQSVALSGGYEDDEDHGEWFLYTGSGGRDLSGNKRTNKEQSSDQKFEKLNAALRISCLKGYPVRVVRSHKEKRSSYAPESGVRYDGVYRIEKCWRKIGIQGKFKVCRYLFVRCDNEPAPWTSDDHGDRPRPLPKIKELQGATDITERKGRPSWDYDEKDGWKWMVPPPVSKKPVLSGDPETDKQIRRSTKRAHLSVAERLLKEFGCSICRAVIKEPLTTPCAHNFCKTCLLGKYDSQSSMRERSRGGRTLRAQKIVKTCPSCPTDICDFLENPQINREMMELIETLQRKAVEEGKVASDDAEECGDGDSEENDGALVKGEEDDSGLNEEEQDSADADANADGSVKIVVEIKEGGKDDKKSEMGATEVVDVLVDEDAAKQTKKRKVDEDAVKQTKKRKGDAETGTNGAKRMKSSAAVEEVAVCGTPVKRTRKSGDMDAEGNGSPAVSSGRRVTRSSSVNATGADDSPARRTRSRAGADAGC

SEQ ID NO: 19194 - DNA, 213 bp, Sorghum bicolor
  misc_feature: Ceres ANNOT ID no. 8724245
  misc_feature: Encodes the peptide sequence at SEQ ID NO 19195
atgtcggactggggccccgtggtgatcgggctggtgctgttcgtgctcctctcgccggggctgctgatccagctccccggccgccaccacttcgtcgagttcggcaacctgcagaccagcgccgtctccatcctcgtccactccatcatctacttcgcgcttatcaccatcttcgtcatcgtcatcggagtgcacatcaccaccggcaactag

SEQ ID NO: 19195 - protein, 70 aa, Sorghum bicolor
  misc_feature: Useful for making plants with altered cell wall content and/or composition
  misc_feature: Functional homolog of the protein sequence given in SEQ ID NO 13690
  misc_feature: Ceres ANNOT ID no. 8724245
MSDWGPVVIGLVLFVLLSPGLLIQLPGRHHFVEFGNLQTSAVSILVHSIIYFALITIFVIVIGVHITTGN

SEQ ID NO: 19196 - DNA, 972 bp, Sorghum bicolor
  misc_feature: Ceres ANNOT ID no. 8724283
  misc_feature: Encodes the peptide sequence at SEQ ID NO 19197
atggcggtaagcagcatggagcgcgctggagcggagagcattcaggggaagaagcggcggggatcgggatcggactcggacggacggacggacggacggacgggttcggtgagctccttttacttgccgcaaccgcaaacagcacaggagggagtggggtgggatccagtgcagctccagctccagctccagctccagctccagccagccgcgttccttcctcgtttccccgctcgctcaggtagccaggtagaggaagaagaagaagaagagggagagcgagcaggggcgggcgtggttcgggaaggaatggctggtcggcgcgcggaggaggagtacgactacctgttcaaggtggtgctgatcggggactcgggcgtcggcaagtccaacctcctctcccgattcacccgcaacgagttctgcctcgagtccaagtccaccatcggcgtcgagttcgccacacgaacactccatgttgagggcaagatcatcaaggcgcagatttgggacacggcaggccaggagcggtacagggcaatcacaagcgcctactaccgcggtgcgctgggcgcggtcctggtctatgacgtgagcaagcctaccaccttcgagaacatcagccggtggctcaaggagctgcgtgaccacgccgactccaacatcagaatcatgctcgttggcaacaagactgacttgaggcacctccgagctgtcgccaccgatgatgcgcagagcttcgccgaggcagaaggtctgtcctacatcgagacgtccgcgctggaggcaaccaacgtggaggaggcattccaactgatcctgggtgacatttaccgggccatcagcaagaagcctgtggcatcagatgagtctggccagggtgctgctggaggcgtcaaggaaggtaagaccatcaatgtggcgactggtggcgatgccgctgctgagaagaagcaatgctgctcagcttag

SEQ ID NO: 19197 - protein, 323 aa, Sorghum bicolor
  misc_feature: Useful for making plants with altered lignin content
  misc_feature: Functional homolog of the protein sequence given in SEQ ID NO 13076
  misc_feature: Useful for making plants with altered alkaloid content
  misc_feature: Functional homolog of the protein sequence given in SEQ ID NO 13220
  misc_feature: Useful for making plants with altered terpenoid content
  misc_feature: Functional homolog of the protein sequence given in SEQ ID NO 13157
  misc_feature: Ceres ANNOT ID no. 8724283
  misc_feature (118)..(233): SWISSPROT Homolog: EC 2.7.11.1 Non-specific serine/threonine protein kinase
  misc_feature (118)..(279): Pfam ID: Ras Pfam Description: Ras family
  misc_feature (118)..(232): Pfam ID: Miro Pfam Description: Miro-like protein
MAVSSMERAGAESIQGKKRRGSGSDSDGRTDGRTGSVSSFYLPQPQTAQEGVGWDPVQLQLQLQLQLQPAAFLPRFPARSGSQVEEEEEEEGERAGAGVVREGMAGRRAEEEYDYLFKVVLIGDSGVGKSNLLSRFTRNEFCLESKSTIGVEFATRTLHVEGKIIKAQIWDTAGQERYRAITSAYYRGALGAVLVYDVSKPTTFENISRWLKELRDHADSNIRIMLVGNKTDLRHLRAVATDDAQSFAEAEGLSYIETSALEATNVEEAFQLILGDIYRAISKKPVASDESGQGAAGGVKEGKTINVATGGDAAAEKKQCCSA

SEQ ID NO: 19198 - DNA, 567 bp, Sorghum bicolor
  misc_feature: Ceres ANNOT ID no. 8724284
  misc_feature: Encodes the peptide sequence at SEQ ID NO 19199
atggccagcggcatcgacgactacctcttcaagctgctcctcatcggcgactcctccgtcggcaagtcctgcctcctcctccgcttcgccaaaatccgcactgtcgacctcgatggaaagactgtcaagctacagatttgggacacagcaggccaagaaaggttcaggacaattacaagcagttactaccgaggagctcatggaatcattatcgtgtatgatgtgacagacatggagagcttcaataacatcaagcagtggctgagtgagattgataggtatgccagtgacaacgtttgcaagctgctagttgggaacaagtgtgatttggttgacagtaaggttgttgagactgaaaaggcaaaggcttttgcagattcgttaggaattccctttatcgagacaagtgcaaaggaatccatcaatgtggaggaagctttcctgaccatgtcatcagaaatcaagaaaaggatggcaacccaaccaaccgtggagaggagacccaccgtccatgttcacatgaaagggcagccaatacagcagaagagcagctgctgctcatcatag

SEQ ID NO: 19199 - protein, 188 aa, Sorghum bicolor
  misc_feature: Useful for making plants with altered lignin content
  misc_feature: Functional homolog of the protein sequence given in SEQ ID NO 12946
  misc_feature: Useful for making plants with modulated oxidative stress sensitivity
  misc_feature: Functional homolog of the protein sequence given in SEQ ID NO 13074
  misc_feature: Ceres ANNOT ID no. 8724284
  misc_feature (11)..(156): Pfam ID: Ras Pfam Description: Ras family
  misc_feature (11)..(109): Pfam ID: Miro Pfam Description: Miro-like protein
MASGIDDYLFKLLLIGDSSVGKSCLLLRFAKIRTVDLDGKTVKLQIWDTAGQERFRTITSSYYRGAHGIIIVYDVTDMESFNNIKQWLSEIDRYASDNVCKLLVGNKCDLVDSKVVETEKAKAFADSLGIPFIETSAKESINVEEAFLTMSSEIKKRMATQPTVERRPTVHVHMKGQPIQQKSSCCSS

SEQ ID NO: 19200 - DNA, 156 bp, Sorghum bicolor
  misc_feature: Ceres ANNOT ID no. 8724276
  misc_feature: Encodes the peptide sequence at SEQ ID NO 19201
atgcaaactgttcttccatgcattgtgttcctcacttttagttgcattgggtatgccatgccgtacattctctgtgcaatgatattctgttgtcttccctgcattatatctgttatgggttttagatacagaaaagctatgcagtatgaattttga

SEQ ID NO: 19201 - protein, 51 aa, Sorghum bicolor
  misc_feature: The sequence is a functional homolog of SEQ ID NO 404 in the 10/666,642 US patent application
  misc_feature: The sequence is a functional homolog of SEQ ID NO 178 in the 10/666,642 US patent application
  misc_feature: The sequence is a functional homolog of SEQ ID NO 2 in US patent 7053203
  misc_feature: Ceres ANNOT ID no. 8724276
MQTVLPCIVFLTFSCIGYAMPYILCAMIFCCLPCIISVMGFRYRKAMQYEF

SEQ ID NO: 19202 - DNA, 1101 bp, Sorghum bicolor
  misc_feature: Ceres ANNOT ID no. 8724280
  misc_feature: Encodes the peptide sequence at SEQ ID NO 19203
atggccatggagactacgaaccatcctcctctgctgaccccttacgagatgggtgagtttgagcttgagcaccgtgtggtactggcgccactaactcgtcaacgctcctacggcaacgtcccacagccgcacgccgccgtgtactactcccagcgcgccacccgcggcggcctcctcatcaccgaggccacaggcgtctccgacacggcgcagggctacacggacacgccgggtgtctggacgccccaccacgtcgccgcctggcggcccatcgtcgacgccgtccacgccaagggcgccgtcttcttctgccagctctggcacgtcggccgcgtctccaccaccgcgttccagcccggcggcgccgcgcccatctccagcaccgaccgcggcgtcaccccgcaggtcagccacgacggccacgtcgaggagttctccccgccgcgccgcctggagccccgcgagatcccgtccgtcgtcgacgacttccgcaaggcggcacgcaacgccatcgacgcgggcttcgacggcgtcgagttcctcaaggacagcgccaacgaccgcgacgacgagtacggcgggtcgctccacaaccgctgccgcttcgcgctcgaggtcgtccgcgccgtggccgccgaggtcggcgcccgacgcgtcggcgtgcgcctctcgccgttcaccgactacatggactgccatgactctgacccggaggcgctcgcggggtacatggtggagaagctcagcgaactcggcgtgctctactgccacatgatcgagcccaggatggccatcgtcgacgggcgccggcagatcccgcaccgtctgaggccgttcagggagaagttcaggggcacattcatcgccgccggcgggtacgacagggcggaggggaacaaggtggtggaggaagggtacacggacctcgtctcctatggaaggctgttcctggcaaacccggacctgccccggaggttccgcctccccgacgccgacgcgccgctcaacaagtacgaccgcaacaccttctacacctccgaccctgtcgtcggatacaccgactacccattcctccacgacgacgacggcgccgacaaataa

SEQ ID NO: 19203 - protein, 366 aa, Sorghum bicolor
  misc_feature: Useful for making plants with modulated water use efficiency
  misc_feature: Functional homolog of the protein sequence given in SEQ ID NO 13609
  misc_feature: Ceres ANNOT ID no. 8724280
  misc_feature (4)..(358): SWISSPROT Homolog: EC 1.3.1.42 12-oxophytodienoate reductase
  misc_feature (10)..(333): Pfam ID: Oxidored_FMN Pfam Description: NADH:flavin oxidoreductase / NADH oxidase family
MAMETTNHPPLLTPYEMGEFELEHRVVLAPLTRQRSYGNVPQPHAAVYYSQRATRGGLLITEATGVSDTAQGYTDTPGVWTPHHVAAWRPIVDAVHAKGAVFFCQLWHVGRVSTTAFQPGGAAPISSTDRGVTPQVSHDGHVEEFSPPRRLEPREIPSVVDDFRKAARNAIDAGFDGVEFLKDSANDRDDEYGGSLHNRCRFALEVVRAVAAEVGARRVGVRLSPFTDYMDCHDSDPEALAGYMVEKLSELGVLYCHMIEPRMAIVDGRRQIPHRLRPFREKFRGTFIAAGGYDRAEGNKVVEEGYTDLVSYGRLFLANPDLPRRFRLPDADAPLNKYDRNTFYTSDPVVGYTDYPFLHDDDGADK

SEQ ID NO: 19204 - DNA, 1134 bp, Sorghum bicolor
  misc_feature: Ceres ANNOT ID no. 8724335
  misc_feature: Encodes the peptide sequence at SEQ ID NO 19205
atggagtacccggcggcggccgccggatcggggggccacaagtactactacccgccgcagcactcgcagccgcaggcgcttcgccgcccgccgcgccccgccgctcggtgggtcaagcaatggatcccgcaggatctcgcgtcctccggcggcaaatgctcgctcttcaagtgggtcagagaggataggtacaggaactccaaggagaaccccagagtgctggatgtagaagcccccaagcctgaacccaccacagagatcctcttcctctgcagctacgacaactgtggcaagacctttgttgatgtcagcgcgctccgcaagcatgctcatgtgcacaacgagaagcagtatatctgcaacgagcccaactgtgggaagaaatttgttgatagctccaagttgaagagacattatcttacccacacaggacaaaaggattttgtctgtccacatccaggctgtggtaaggccttctcattggattttaacttacggtcacacctgaaaacacatgcattggagaattatcacatatgccctttcccagcatgtggcaaaagatttacaagtgacttcaaactagcagcacatgtcaagtcacatgaaaagattggaactcctattgcagtgcaacatgcaccagcgccagcagcagaaaaaccgcgcgtcgccccaaagccttcaactccagcaaccacaagctatactgatcgcccatatgtctgcccctacgaaggttgcgacaaagcatacatccacggttacaaattgaaccttcatctaaaaactcagcaccctgaacacggccaagaggaaaatggtaaggtcggtgcttctgctggtcatcatgctgcgaatgaacagacctaccagtataactatgctgaggttggtgagattgcaccaaaccccaaaaggagcaagcataaggtccactcatccaaagcctacaatgccaaggtctcgagagcgatgccttctgacatcggtggtgtcaggaaccagtggccaggtaaagctacgtaccaagatgatagtgaagagaccgaagaagatgggggccacaacattgaagatggctggagatatggcaacaatgatgatgatgaggaaacaccagatgaagattga

SEQ ID NO: 19205 - protein, 377 aa, Sorghum bicolor
  misc_feature: Useful for making plants with altered lignin content
  misc_feature: Functional homolog of the protein sequence given in SEQ ID NO 13069
  misc_feature: Ceres ANNOT ID no. 8724335
  misc_feature (148)..(172): Pfam ID: zf-C2H2 Pfam Description: Zinc finger, C2H2 type
  misc_feature (118)..(142): Pfam ID: zf-C2H2 Pfam Description: Zinc finger, C2H2 type
  misc_feature (241)..(266): Pfam ID: zf-C2H2 Pfam Description: Zinc finger, C2H2 type
  misc_feature (89)..(113): Pfam ID: zf-C2H2 Pfam Description: Zinc finger, C2H2 type
  misc_feature (178)..(202): Pfam ID: zf-C2H2 Pfam Description: Zinc finger, C2H2 type
MEYPAAAAGSGGHKYYYPPQHSQPQALRRPPRPAARWVKQWIPQDLASSGGKCSLFKWVREDRYRNSKENPRVLDVEAPKPEPTTEILFLCSYDNCGKTFVDVSALRKHAHVHNEKQYICNEPNCGKKFVDSSKLKRHYLTHTGQKDFVCPHPGCGKAFSLDFNLRSHLKTHALENYHICPFPACGKRFTSDFKLAAHVKSHEKIGTPIAVQHAPAPAAEKPRVAPKPSTPATTSYTDRPYVCPYEGCDKAYIHGYKLNLHLKTQHPEHGQEENGKVGASAGHHAANEQTYQYNYAEVGEIAPNPKRSKHKVHSSKAYNAKVSRAMPSDIGGVRNQWPGKATYQDDSEETEEDGGHNIEDGWRYGNNDDDEETPDED

SEQ ID NO: 19206 - DNA, 2295 bp, Sorghum bicolor
  misc_feature: Ceres ANNOT ID no. 8724393
  misc_feature: Encodes the peptide sequence at SEQ ID NO 19207
atggtgcaggaggactcgtatcagcgtgatatggataggcagactgctagccacaatactaatgacttactaggttcttctggaatacagtatggtctaaatcgtggacctggaactattggaggcctgcactctagcaatagtttacggagcttggatgaatttcagaacactgatctgccatcaaatacatttgcttctattttagggtcatctctttctaggagtgcatctccagatcctgagcttgtgaggagggcccctagtccatctctgcctccaattggtgtgaaagttagtaacactgataagaagatcaatggtggttcctcttctttccgtcgtagttcatccgcaatcggtgaatctgatgatctggtggctgctttatctgggatgaacttatcatctagggcaatgagtgggcaaactatggaccagtctcagctgtatcaggatgtcgataatgtccagaagttcctttttgatcgacagggtgaccagacaaatggcaatcagcagcactacatgagacgtcctgagcatgggcaatctaagttaccagatggatattcttccaatttggtcaattcatctacgatgaggaaccagattaatgctggaagtttcacatcttttgacagtttgtctcttggatctggctttgcttcccctaggattggttctagatcccctggagggactgtatcttctcgacaaaatttagctggtatgtctaacatgctaaactataatggaattggaagtccaactgcatcaccttctcttcagacctctattgatccagcgtatatccagtaccttgcccaacttgcagctacctgtgatgatcctctaatggacaggggccatctgggaaattcttacatggacttacttggtactcagaaagctaaccttggccctttactccagtcgcaaaagcaatatggttactatggtaatcttggatttaaccttggatatgctggaagtccattgacaagtcctgttcttccctcttcacctattgcgccaggaagtccacttaggcatggtgagcgcaacatgcgctttccatcaggcatgagaaacttcggtaattcctttggttcatggaattcaggcatgggtggaaagatggatgccaatttgatgccctcacttctggaggagttcaagagcaacaaaagtaaatcatatgagctctcggaaatagctggccatgttgttgagtttagtgctgatcaatatgggagtcggttcatacaacagaagctagagacagccagtactgaagaaaaggacatggttttttcagaaatcatgcctcaagctctcacattgatgactgatgtatttggaaattatgttgttcaaaagttttttgagcatggaagcactgcccagataaaggaattggctggtcagcttattggacgtgtccttgctcttagtcttcagatgtatgggtgccgggttatacagaaggctatagaagttgttgatttggatctgcagactaaaatggttgcagagctggagggccatgtcatgcgctgtgtacgtgatcaaaatgggaaccatgttatacagaaatgcatagagtgcattcctcagcatgctatcgagtttattgtctcgacattctatggtcaagttgtaatgctatccactcatccatatggttgtcgagttattcagagggttctagagcattgtgatgatcctaagacacagcaaataatgatggatgagattctccagtctgtttgcttgctagctcaggaccagtatggcaactatgttgttcagcatgttctggaacatggcaaaccacatgagagatcggctattattgagaagctaattggccaaattgtgcaaatgagccagcaaaagtttgcctcaaatgtcatcgagaagtgcttagcctttggaaatcctgtagagcgtcaggttctgattggtgagatgcttggatccactagtgaaagcgaacctcttgaggtaatgatgaaagaccagtttgcaaactatgtggtgcagaaggtgttagaaacttgtgatgatcagcagagagagatgatcctaacaaggataaagacacacctgaacaccctcaagaagtacacatacgggaagcacatagtagcacgtgtagagaagcttgttgctgctggagttaagctgaagttattagtatcagctttcctgaactgtttgatatgtaatgtgactttgttccttgtgctaatggttgagtctcatgtaatccaggtccccgatgtctga

SEQ ID NO: 19207 - protein, 764 aa, Sorghum bicolor
  misc_feature: The sequence is a functional homolog of SEQ ID NO 1232 in the 10/666,642 US patent application
  misc_feature: Ceres ANNOT ID no. 8724393
  misc_feature (86)..(404): Pfam ID: NABP Pfam Description: Nucleic acid binding protein NABP
  misc_feature (549)..(583): Pfam ID: PUF Pfam Description: Pumilio-family RNA binding repeat
  misc_feature (586)..(620): Pfam ID: PUF Pfam Description: Pumilio-family RNA binding repeat
  misc_feature (664)..(698): Pfam ID: PUF Pfam Description: Pumilio-family RNA binding repeat
  misc_feature (441)..(475): Pfam ID: PUF Pfam Description: Pumilio-family RNA binding repeat
  misc_feature (405)..(439): Pfam ID: PUF Pfam Description: Pumilio-family RNA binding repeat
  misc_feature (513)..(547): Pfam ID: PUF Pfam Description: Pumilio-family RNA binding repeat
  misc_feature (622)..(656): Pfam ID: PUF Pfam Description: Pumilio-family RNA binding repeat
  misc_feature (477)..(511): Pfam ID: PUF Pfam Description: Pumilio-family RNA binding repeat
MVQEDSYQRDMDRQTASHNTNDLLGSSGIQYGLNRGPGTIGGLHSSNSLRSLDEFQNTDLPSNTFASILGSSLSRSASPDPELVRRAPSPSLPPIGVKVSNTDKKINGGSSSFRRSSSAIGESDDLVAALSGMNLSSRAMSGQTMDQSQLYQDVDNVQKFLFDRQGDQTNGNQQHYMRRPEHGQSKLPDGYSSNLVNSSTMRNQINAGSFTSFDSLSLGSGFASPRIGSRSPGGTVSSRQNLAGMSNMLNYNGIGSPTASPSLQTSIDPAYIQYLAQLAATCDDPLMDRGHLGNSYMDLLGTQKANLGPLLQSQKQYGYYGNLGFNLGYAGSPLTSPVLPSSPIAPGSPLRHGERNMRFPSGMRNFGNSFGSWNSGMGGKMDANLMPSLLEEFKSNKSKSYELSEIAGHVVEFSADQYGSRFIQQKLETASTEEKDMVFSEIMPQALTLMTDVFGNYVVQKFFEHGSTAQIKELAGQLIGRVLALSLQMYGCRVIQKAIEVVDLDLQTKMVAELEGHVMRCVRDQNGNHVIQKCIECIPQHAIEFIVSTFYGQVVMLSTHPYGCRVIQRVLEHCDDPKTQQIMMDEILQSVCLLAQDQYGNYVVQHVLEHGKPHERSAIIEKLIGQIVQMSQQKFASNVIEKCLAFGNPVERQVLIGEMLGSTSESEPLEVMMKDQFANYVVQKVLETCDDQQREMILTRIKTHLNTLKKYTYGKHIVARVEKLVAAGVKLKLLVSAFLNCLICNVTLFLVLMVESHVIQVPDV

SEQ ID NO: 19208 - DNA, 2226 bp, Sorghum bicolor
  misc_feature: Ceres ANNOT ID no. 8724408
  misc_feature: Encodes the peptide sequence at SEQ ID NO 19209
atgctgattgagtgtccctttgatgatctgtacacccttacaacgcctggacaacagcaagatggctcttcttcttctcagcaacaactcacactgtctgaccacagactatgtgatccccagttcttctcccaatcaaccaatgaatcaaacatgcaattctccgctgtagttaccatccctcgaatgtacaatgtcagtagcaacctcggacagaaccaccttcagattgctgcaggggttagtccagactaccaaaggattagatcaaacaatgctcttcaccacataagccagatcctgatggaggacgttgatgagagggtcggcttgcatgaaggggaggccgcccttcaggctgctgagaaggccttttttgatattctggagcaggtaaacccgccttcactcgactggtcaccgctccatcacagcggcgaagcaggagaaggaccaggtgagggtagcaacagttatcacaaaaggcctcgcagaagcagtttcactactgacatttccagtcacagcatgtttttcgaggaatccagtcacagaatgttgcagcccttgccagccccattgattccaaatagctatggcaggagtcttttcctgccatatcagcagccactggcaagcactgggaggacctcaagatttggtttctctgccttggaaattagaagagaagccgaggatgggaacaggtttgataagatggtgatctgtttggaaaaagacaagctttcgatctgcagactgaccactactaaggcaaagatagtagccaggaagagcaaatatgcaatctttcagattaccgactacaggaacagtccatatatccaagattcggataccagggaagggagaagtaaaaactataccatcacttgcgaaataagccgaaacgaaaagttcgacagggtcctgctatgctatggtctggactgtttcattgaaacagcaaggctgagagacatggctgcaaaggaagcaagtgaaacttcaccaaagggtcaaagcaaaacacctgctcgacagaagttgcggggtactaggcagctcaagaaagaggtggtcgacctcaggaccctcctcaaccactgtgcacaagctgttgcagctgacgaccgtctcttggctggtgagctcatcaagaagataaggcagcactcctcgagagatggagactgttgccagagactggcattttacttcgtgaatggccttgaggcacgcctggctgggacggggagtcagttgttccacaaggtgctggcaaagcgaataagcgatgaagatgtgttgagggtctacaacttctatcttacagtttgccctttcctcagggcatcatacaccttcgctaaccaaactatcttgcaagcttcagtggggcaatccaaggtgcacgtcgtcgaaattggtgtgtgctatgggtttcaatggccgtcgctgattcagcttttcggtgagcaaggagtgcctccaaggcttcggatcacaggtatagaagtgcctcggcctggtttcacccccttggagaacattgagcgggcagggaagctgatggcggactatgcaaacatgtacaaggtaccctttcagtatcagggcatttactcacgatatgaagatattcagatcgaagatctcaacattgaggaggatgaagtgcttataatcaactgcatgtaccagatgaagaacctcggcgatgagacagtagccatcgatagcgcgagggatagggtactgaaaatcatgaggaggatgaacccaaaggtgttaattttcggcattctgaatggattatacagttcccccttcttcatgacacgtttcaaagagcttctgttccattactcctcgatatttgatatgcttgatacaaatgctccacgggataatgaagaaagaaagctgttagagggtggaatgcttgggcgggagatcttaaacatcgtagcatgtgagggtgctgacaggattgagaggccagaaacttaccagcagtggcaaggaaggtgcctcaaggctgggttcgagcagcttcctctcgaccctgccgtcatgaagtcaatgttattgatgaagaaagaaatctaccatgagcactttgttgctgatgaagacaacggctggctgctacaagggtggaaaggcagagtactgtatgcactgtccaaatggaaggttaatgaattatgtgctgatcagtaa

SEQ ID NO: 19209 - protein, 741 aa, Sorghum bicolor
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
  misc_feature: Ceres ANNOT ID no. 8724408
  misc_feature (337)..(642): Pfam ID: GRAS Pfam Description: GRAS family transcription factor
MLIECPFDDLYTLTTPGQQQDGSSSSQQQLTLSDHRLCDPQFFSQSTNESNMQFSAVVTIPRMYNVSSNLGQNHLQIAAGVSPDYQRIRSNNALHHISQILMEDVDERVGLHEGEAALQAAEKAFFDILEQVNPPSLDWSPLHHSGEAGEGPGEGSNSYHKRPRRSSFTTDISSHSMFFEESSHRMLQPLPAPLIPNSYGRSLFLPYQQPLASTGRTSRFGFSALEIRREAEDGNRFDKMVICLEKDKLSICRLTTTKAKIVARKSKYAIFQITDYRNSPYIQDSDTREGRSKNYTITCEISRNEKFDRVLLCYGLDCFIETARLRDMAAKEASETSPKGQSKTPARQKLRGTRQLKKEVVDLRTLLNHCAQAVAADDRLLAGELIKKIRQHSSRDGDCCQRLAFYFVNGLEARLAGTGSQLFHKVLAKRISDEDVLRVYNFYLTVCPFLRASYTFANQTILQASVGQSKVHVVEIGVCYGFQWPSLIQLFGEQGVPPRLRITGIEVPRPGFTPLENIERAGKLMADYANMYKVPFQYQGIYSRYEDIQIEDLNIEEDEVLIINCMYQMKNLGDETVAIDSARDRVLKIMRRMNPKVLIFGILNGLYSSPFFMTRFKELLFHYSSIFDMLDTNAPRDNEERKLLEGGMLGREILNIVACEGADRIERPETYQQWQGRCLKAGFEQLPLDPAVMKSMLLMKKEIYHEHFVADEDNGWLLQGWKGRVLYALSKWKVNELCADQ

SEQ ID NO: 19210 - DNA, 966 bp, Sorghum bicolor
  misc_feature: Ceres ANNOT ID no. 8724419
  misc_feature: Encodes the peptide sequence at SEQ ID NO 19211
atgacgatgagagcactgctggcggtggcgaccatggtggccactgtcttcttgtccatgtcgtcgtcgtccacgcacgcccagcagtgcggcacgcaggccgccggcgcgctgtgccccaactgccagtgctgcagcatgtacgggtggtgcggcagcacctccgactactgcggcagcggctgccagagccagtgcaccggcacctgcggcggcggcggcgtggcgtccatcatctccgagtccgtcttcaaccagatgctgctgcaccgcaacgacgccggctgccctgccaacggcttctacacctacgccgccttcatcgcggcggccaactccttcccgggcttcggcacgacgggggcgagccccgacgtccagaagcgcgagctggcggcgttcctggcgcagacgtcgcacgagacgacgggcgggtgggcgacggcgcccgacggcgcctacgcctggggctactgcttcaaggaggagaaggacggcgcgtcggggccggactactgcgagcccagcacacagtggccgtgcgccgccgggaagaagtactacggccgcggacccatccagatctcctacaactacaactacggccccgccggccaggccatcggcgccggcatcctcgccaacccggaccttgtcgccgccgacgccaccgtctcgttcgagaccgcggtgtggttctggatgacgccgcagtcgcccaagccgtcgtgccacgacgtcatgacggggcagtggacgccgtcggcagctgacatcgccgcggggaggttgccggggtatggcgtcgtcaccaacatcatcaacggcggcctcgagtgcggccatggcgccgatacccgcgtcgcggacaggatcgggttctacaagcgctactgcgacttgcttggggtcagctatggcgacaacttggactgcgccaaccagatgcccttcaacagctcctaa

SEQ ID NO: 19211 - protein, 321 aa, Sorghum bicolor
  misc_feature: Useful for biocontainment applications
  misc_feature: Useful for making plants with modulated biomass
  misc_feature: Functional homolog of the protein sequence given in SEQ ID NO 13042
  misc_feature: Ceres ANNOT ID no. 8724419
  misc_feature (22)..(320): SWISSPROT Homolog: EC 3.2.1.14 Chitinase
  misc_feature (78)..(312): Pfam ID: Glyco_hydro_19 Pfam Description: Chitinase class I
  misc_feature (27)..(66): Pfam ID: Chitin_bind_1 Pfam Description: Chitin recognition protein
MTMRALLAVATMVATVFLSMSSSSTHAQQCGTQAAGALCPNCQCCSMYGWCGSTSDYCGSGCQSQCTGTCGGGGVASIISESVFNQMLLHRNDAGCPANGFYTYAAFIAAANSFPGFGTTGASPDVQKRELAAFLAQTSHETTGGWATAPDGAYAWGYCFKEEKDGASGPDYCEPSTQWPCAAGKKYYGRGPIQISYNYNYGPAGQAIGAGILANPDLVAADATVSFETAVWFWMTPQSPKPSCHDVMTGQWTPSAADIAAGRLPGYGVVTNIINGGLECGHGADTRVADRIGFYKRYCDLLGVSYGDNLDCANQMPFNSS

SEQ ID NO: 19212 - DNA, 2202 bp, Sorghum bicolor
  misc_feature: Ceres ANNOT ID no. 8724409
  misc_feature: Encodes the peptide sequence at SEQ ID NO 19213
atgaggattgagtctccctttgatgatctgtacaccattacaacgcctggacaacggcaagatggcttttctacctcttcttctcagcaacaactcacactgtatgaccaaagactatgtgatccccagttcttctcccaattaacgaatgaatcaaacatgcaattctctggtgtagtcaccatccctggaatgtacaatgtcagtagcaacctcggacagaaccacattcagattcctacaggagttagtccagactaccaaatggtcagaccaaacaacgctcttcaccacataagccagatcctgatggaagacatcgatgatagggtcggctcgcatgaaggagaggccgcccttcaggccgctgagaagtccttccacggtattcttgagcaggtatacccgctttcactcgagtggtcaccgctacatcacagcggcgaagcaggggatggaccaggtgagggtagcaacagttatcacaaaaggcctcgcagaagcagtttcactactgacattttcagtaacagcatgttgcagtccttgcaagccccattgagtccatatagctatggcaggagttctttccagccatatcagcctttggcaagcactgggagggcctcgagatttggtttccctgccttgcaaattagaagagaagccaaggatgcaaaggggttcgataagatggtgatccatttggttggcgacaagctttccatttgcagactgaccactgctaaagcgaaagaggtagccggcaagagcaaatatgcgatctttcagatatcagaccccaggaacaatccatatatccaagacttggataacagggaagggtggggtaaaaattgtaccatcacttgcgaaataaaccacaatgataagctcgacagtgttcttttatgctatggtccggactgtttcaatgaaacagcaaggttgagagacatggctgcaaaggaagcaagcaagaattcaccaaagggtgaaagcaaatcaactgctcaacagaagtctcggggtactaggcagctcaagaaagaggtggtcgatctcaggagcctcctcatccactgtgcacaggctgtggcagctgatgaccgtctgttggccagtgagctcatcaagaagataagacaacactcctcaagagatggagagtgttgccagagactggcattttacttcgtgaatggccttgaggcacgcctggctgggacagggagccagttgttccccaagatgctggcaaagcggataagcgaagatgacatgttgaaggtctacaacttttatcttgcagtttgccctttccacagggcatcatacaccttcgctaaccaaactattattgaaacgtcagcaggccactctagggtgcacatcatcgattttggtgtctacactggttttcaatggccatcactgattcagcttttcggtgaccaaggagtgcctccaaggcttcggattacaggtatagaagtgcctcggccaggtttcagccccttggagaacattgagcggacagggaagctgttggctgactatgcaaacatgtacaaggtgccctttcagtatcagggcatttactcacgatatgaagatattcagatcgaagatctcaacattgaggaggatgaagtgcttataatcaactgcttgtaccgaatgaagaacctcggcgatgagacagtagccatggatagcgcaagggatagggtactgaagatcatgaggaggatgaacccaaaggtgtttattttcggcattctgaatggatcatacagttcccccttcttcgtaacacgtttcaaagagcttctgttccattactcctcactgtttgacatgcttgacgtgaatgcttcacggggtaatgaagcgagaaagctgttagagggtgggatacttgggcgggagatcttaaacgtcatagcatgtgagagtgctgacaggattgagaggccagaaacttaccagcagtggcaagcaaggtgcctcaaggttgggttcgagcagcttcctctcgatcctgccatcatgaagtcaatgttattgatgaagaaagaattttaccatgaggactttgttgctgatgaagacagcggctggctactacaagggtggaaaggcagagtactgtatgcattgtccaaatggaagattaatgaatcatgtgctgatcagtaa

SEQ ID NO: 19213 - protein, 733 aa, Sorghum bicolor
  misc_feature: The sequence is a functional homolog of SEQ ID NO 1324 in the 10/374,780 US patent application
  misc_feature: The sequence is a functional homolog of SEQ ID NO 1471 in the 10/412,699 US patent application
  misc_feature: Ceres ANNOT ID no. 8724409
  misc_feature (329)..(634): Pfam ID: GRAS Pfam Description: GRAS family transcription factor
MRIESPFDDLYTITTPGQRQDGFSTSSSQQQLTLYDQRLCDPQFFSQLTNESNMQFSGVVTIPGMYNVSSNLGQNHIQIPTGVSPDYQMVRPNNALHHISQILMEDIDDRVGSHEGEAALQAAEKSFHGILEQVYPLSLEWSPLHHSGEAGDGPGEGSNSYHKRPRRSSFTTDIFSNSMLQSLQAPLSPYSYGRSSFQPYQPLASTGRASRFGFPALQIRREAKDAKGFDKMVIHLVGDKLSICRLTTAKAKEVAGKSKYAIFQISDPRNNPYIQDLDNREGWGKNCTITCEINHNDKLDSVLLCYGPDCFNETARLRDMAAKEASKNSPKGESKSTAQQKSRGTRQLKKEVVDLRSLLIHCAQAVAADDRLLASELIKKIRQHSSRDGECCQRLAFYFVNGLEARLAGTGSQLFPKMLAKRISEDDMLKVYNFYLAVCPFHRASYTFANQTIIETSAGHSRVHIIDFGVYTGFQWPSLIQLFGDQGVPPRLRITGIEVPRPGFSPLENIERTGKLLADYANMYKVPFQYQGIYSRYEDIQIEDLNIEEDEVLIINCLYRMKNLGDETVAMDSARDRVLKIMRRMNPKVFIFGILNGSYSSPFFVTRFKELLFHYSSLFDMLDVNASRGNEARKLLEGGILGREILNVIACESADRIERPETYQQWQARCLKVGFEQLPLDPAIMKSMLLMKKEFYHEDFVADEDSGWLLQGWKGRVLYALSKWKINESCADQ

SEQ ID NO: 19214 - DNA, 588 bp, Sorghum bicolor
  misc_feature: Ceres ANNOT ID no. 8724512
  misc_feature: Encodes the peptide sequence at SEQ ID NO 19215
atggcgcgcgtgctgatgctcatgtcacactcgcacggccaggaccagtcgctgccgctgccggtgatcgccgccgggcgcggcgacggggcggcgccggagcgggtgttcgtgtgcaagacgtgcaaccgcgtgttcccgtcgttccaggcgctgggcggccaccgcgccagccacaagaagccgcggctggacggggacggcgaccccgcgctcgccaagcccaagctgcacggctgctccatctgcggcctcgagttcgccatcggccaggccctcggcggccacatgaggcgccaccgcgccatgacgggcggcatgcccatgccaccgccggcgacgacgaggatcgtcgtcgacaagaagccggacggcgacgtcgtcggcatcatccaccacgaccacggccacggcggcgtcaagcccggcgggctgtggctcgacctcaaccacccgccctgcgacgacgacggctgcgacgccgaggtggagtgcggccacattaatgccgccgccgccgccggtgggatcacgttccatcagttcctcgacactggcaccatggccgtcgactgccttggctactag

SEQ ID NO: 19215 - protein, 195 aa, Sorghum bicolor
  misc_feature: Useful for making plants with modulated biomass
  misc_feature: Functional homolog of the protein sequence given in SEQ ID NO 13580
  misc_feature: The sequence is a functional homolog of SEQ ID NO 2200 in the 10/374,780 US patent application
  misc_feature: The sequence is a functional homolog of SEQ ID NO 250 in the 10/714,887 US patent application
  misc_feature: The sequence is a functional homolog of SEQ ID NO 250 in the 11/435,388 US patent application
  misc_feature: The sequence is a functional homolog of SEQ ID NO 558 in the 10/666,642 US patent application
  misc_feature: Ceres ANNOT ID no. 8724512
MARVLMLMSHSHGQDQSLPLPVIAAGRGDGAAPERVFVCKTCNRVFPSFQALGGHRASHKKPRLDGDGDPALAKPKLHGCSICGLEFAIGQALGGHMRRHRAMTGGMPMPPPATTRIVVDKKPDGDVVGIIHHDHGHGGVKPGGLWLDLNHPPCDDDGCDAEVECGHINAAAAAGGITFHQFLDTGTMAVDCLGY

SEQ ID NO: 19216 - DNA, 3087 bp, Sorghum bicolor
  misc_feature: Ceres ANNOT ID no. 8724543
  misc_feature: Encodes the peptide sequence at SEQ ID NO 19217
atggtgtgccgtatcttgctactagttaccctcatatgcctcgcactgttatgcatcttgtcgatcaccatagaggctgataacagctccatcggctctggccaaatccgactagcttgtggagcctccaaaccaacagatgttggtcctgatggtcgaatatggcatagtgacatagattccgagtttgcaccatcactggaaggctcttcaattgctttagacccttttaccaccactgttgttccttatatgactgctcggatcttcacttcaaattacacttattcattccctgttagtccaggacgcatgtttgtgcgcctctacttccactatcctaccactcatggcatctatgctccttcaaatgcctactttggtgtcacagcgagcaatttggtcattttagacaacttctatgctacccaaacttctttgacagctaaagacagcttctttcgtgaatactccttaaatgttacttcacgtaaactactactctccttcagcccatctacccaccataatggatcttatgcatttgtgaatgggattgaaatcgtgcccacacctgaccttttcacaacaacaataccaacactagccaatggtggaaaccctgatctattccctattgatcctgcaacagggttccaaacaatgtaccggcttaatgtaggggggccagacatctctccacatgatgatattgacttttaccgtacatggtacgaggacgatccttacttatataatgatgctccttcagtttgccctgtgatggaccacaatattactgtcacctatatgcccagtgtaccaaactacactgcaccagttgatgtctatttaactgctcggtcaatgggacaagatccacaagtcaacctgaagtataatcttacatggattttaccaattgatgctgggttctattacctcctaaggctccatttctgtgagaaccagtacccgataactaaggttaaccagaggtcattctttatctacatcaataaccagacagcacaggaggaaatggatgtcattgcatggagtggaggaatcggcagaacagcgtacacagactatgctatcatcactactagtactggtcagaaggacctgtgggttgcccttcaccctgatctttcgacgaggccagagtattttgatgcaatactgaatggtcttgaggtctttaagctacataattatcgagataacagccttgctgcactccagtcaccccttccaccaccaccatcaccacctgatcaagtggaacctaataatgacaagcctgcaggtgcaagaaaaaggaactcgaagggtgctgtcccagcagccatagctggaactgttggtgtttttgctcttctgttgttgacctgttttggcaagtacatcattggcagatggaaagagagagcaaggaattatagaataaggaccggcttgactcctcaagttgagggctacaatctaccatcagttatgtgccaccacttcaccttcaagcaaatccaggcagccactaataacttcgatgaaacttttctccttggcaagggtggttttgggaatgtgtatcgtggaaagatagattgtggtgttcaggtggcgatcaagcgtggcaatccactgtcccagcagggcctacgtgagttccggaatgagattggaatactgtccatgcttcgtcaccgccaccttgtatctcttattggatactgtgaacagaacaatgagatgatcctagtttatgattacatggctcatggtacccttcaggagcaactctacagcaccaacaggtcacctctgccctggaagcaacgccttgagatctgcatcggtgcagctcgagggctccactatctgcacactggtgccaaccaagcaatcatccatcgtgatgttaagactgccaacattctcttggatgacaagttcgtggcaaaggtcgcagacttcgggctatcgaagggcagtctagacgtcgatgatacccatgtaagcactgcggtgaagggcacctttgggtatctcgatcctgagtatttccggagcaagcgactcaccaggaaatctgatgtgtacgcgtttggggtcgtgctgtttgaggttctgtgcgcgcgccctgtgattaacattcagcttcctgaggagcaagtgagcctgcatgactgggcgctgtcttgccagaagaatggcatgctcagcgagatcattgaccctcatctccaggggaaaataacacccgagtgcttcaggaaattcacagagactgctgagcaatgtgttgctcatcgtagcattgatcggccatccatgggcgatgtactttcgaacctccaggtcgctctccagctgcaggagaggacaggtgtaaatagcagcaatggtgaggctccattgtcccttgcagcaggagctcctcttcgtctcgttcacaaacaggcacgggacagcacgcgcacgaagaggggaacggccagcgcggccggggagttccggccggaggggaggtcaacgcaggcagaacaactagatattgggagggggcaccagatctgctgctcctccccagtccccaggcaggcatttggtcgaagcgtggccattcgtgcctccgcagctcagtactggctgctgaaacaaatcaagccgatagacctgccaatgtcacttctaaacgcgatcacaaaaaacttctctgatggtctacaaattggcagtggcgggttcatggtggtttacaaggtgcgacaccaaaatatagtacggtttctgggatactgtgtggatacacaagggaaaatggaagactgcaagggaaagtttatcctggcagatatgcgtctggtggactggagtggaataagctataaaattatcaaaggaatttgtgagggcctacaatatcttcacgagaataatattgttcacttagatctcaaccttcccaatatactgctgaacgataacatggtcccaaaaatttatgattttggtctctcaaggtggttcaaagaaatacaaggtggaactgtgacgtcaacactagttggatccatgtaa

SEQ ID NO: 19217 - protein, 1028 aa, Sorghum bicolor
  misc_feature: Useful for making plants with modulated biotic stress sensitivity
  misc_feature: Functional homolog of the protein sequence given in SEQ ID NO 14099
  misc_feature: Ceres ANNOT ID no. 8724543
  misc_feature (452)..(794): SWISSPROT Homolog: EC 2.7.11.1 Non-specific serine/threonine protein kinase
  misc_feature (517)..(787): Pfam ID: Pkinase_Tyr Pfam Description: Protein tyrosine kinase
MVCRILLLVTLICLALLCILSITIEADNSSIGSGQIRLACGASKPTDVGPDGRIWHSDIDSEFAPSLEGSSIALDPFTTTVVPYMTARIFTSNYTYSFPVSPGRMFVRLYFHYPTTHGIYAPSNAYFGVTASNLVILDNFYATQTSLTAKDSFFREYSLNVTSRKLLLSFSPSTHHNGSYAFVNGIEIVPTPDLFTTTIPTLANGGNPDLFPIDPATGFQTMYRLNVGGPDISPHDDIDFYRTWYEDDPYLYNDAPSVCPVMDHNITVTYMPSVPNYTAPVDVYLTARSMGQDPQVNLKYNLTWILPIDAGFYYLLRLHFCENQYPITKVNQRSFFIYINNQTAQEEMDVIAWSGGIGRTAYTDYAIITTSTGQKDLWVALHPDLSTRPEYFDAILNGLEVFKLHNYRDNSLAALQSPLPPPPSPPDQVEPNNDKPAGARKRNSKGAVPAAIAGTVGVFALLLLTCFGKYIIGRWKERARNYRIRTGLTPQVEGYNLPSVMCHHFTFKQIQAATNNFDETFLLGKGGFGNVYRGKIDCGVQVAIKRGNPLSQQGLREFRNEIGILSMLRHRHLVSLIGYCEQNNEMILVYDYMAHGTLQEQLYSTNRSPLPWKQRLEICIGAARGLHYLHTGANQAIIHRDVKTANILLDDKFVAKVADFGLSKGSLDVDDTHVSTAVKGTFGYLDPEYFRSKRLTRKSDVYAFGVVLFEVLCARPVINIQLPEEQVSLHDWALSCQKNGMLSEIIDPHLQGKITPECFRKFTETAEQCVAHRSIDRPSMGDVLSNLQVALQLQERTGVNSSNGEAPLSLAAGAPLRLVHKQARDSTRTKRGTASAAGEFRPEGRSTQAEQLDIGRGHQICCSSPVPRQAFGRSVAIRASAAQYWLLKQIKPIDLPMSLLNAITKNFSDGLQIGSGGFMVVYKVRHQNIVRFLGYCVDTQGKMEDCKGKFILADMRLVDWSGISYKIIKGICEGLQYLHENNIVHLDLNLPNILLNDNMVPKIYDFGLSRWFKEIQGGTVTSTLVGSM

SEQ ID NO: 19218 - DNA, 621 bp, Sorghum bicolor
  misc_feature: Ceres ANNOT ID no. 8724597
  misc_feature: Encodes the peptide sequence at SEQ ID NO 19219
atggtgtcaggctccggcttgagcgcaaagcgcatcgtggtggacgcgcgccaccacatgctgggccgcctctcctcgatcatcgcgaaggagctgctcaatgggcagaaggtggtcgtcgtccgctgcgaggagatctgcatgtccggcggcctcgtccgccagaagatgaagtacctccgtttcctccgcaagcggatgaacaccaagccgtcgcacgggcccatccacttccgcgccccctccaagatcctctggcgtaccatccgcgggatgattccgcacaagaccaagaggggagaggcggcgctggcgaggctcaagacgtacgagggcgtcccgccgccgtacgacaagacgaagcgcgtggtcatccctgatgctcttaaggttctgaggctgcagcctgggcacaagtactgcctcctcggtgagctctctaaggaggtcggatggaactaccatgacaccatcagggaacttgaggagaagaggaaagagaaggccaaggttgcctatgagaggaggaagcaactggctaagctgcgcgtcaaggctgagaagacagccgaggagaagctgggatctcaactggagattcttgccccgatcaagtattga

SEQ ID NO: 19219 - protein, 206 aa, Sorghum bicolor
  misc_feature: Useful for making plants with modulated nitrogen use efficiency
  misc_feature: Functional homolog of the protein sequence given in SEQ ID NO 14103
  misc_feature: Ceres ANNOT ID no. 8724597
  misc_feature (11)..(127): Pfam ID: Ribosomal_L13 Pfam Description: Ribosomal protein L13
MVSGSGLSAKRIVVDARHHMLGRLSSIIAKELLNGQKVVVVRCEEICMSGGLVRQKMKYLRFLRKRMNTKPSHGPIHFRAPSKILWRTIRGMIPHKTKRGEAALARLKTYEGVPPPYDKTKRVVIPDALKVLRLQPGHKYCLLGELSKEVGWNYHDTIRELEEKRKEKAKVAYERRKQLAKLRVKAEKTAEEKLGSQLEILAPIKY

SEQ ID NO: 19220 - DNA, 885 bp, Sorghum bicolor
  misc_feature: Ceres ANNOT ID no. 8724645
  misc_feature: Encodes the peptide sequence at SEQ ID NO 19221
atgctgcgcgggggcacgagcgtgctggggatcatcaacttcatcaccttcctgatctcgatcccgatcctaggcggcggcatctggctagcctcgcgtgccaactccaccgactgcatccgcttcctgcagtggcccatcatcgtcgtgggtctcgtcctcatggtcatctccctcatgggcttcgccggcgcctgctaccgccagacctggctcctccgcctctacctcttcgccatgttcttcgtcgtcctcgccctcctcttcttcatcgtcttcgccttcgccgtcaccgaccgcggcgacggacaggtcgtcatgaaccgccggttccccgagtaccagctctccgactacagcggctggctccgcgaccgcgtcgctgacccggagtactgggccaccatcagcgcttgcctccgcgacggccacgcctgcgccggcatgaggcgcctcgcaagggaccccaacaccggcatgctcgtgccggagacgcctgccatgttctacggccgcaacctctccccgattcagtctggatgctgcaagccaccgacatcatgtgcattcacctatatgaacgagacgtactggacacaaaaccctggtgtgccgactgtgatgaatgaccctgactgcagcaggtggagcaacgaccagcagatgctgtgcttccagtgcgactcatgcaaggctggcgtcctagcgggcatcaagaagagctggcgcaaggtggccatcctgaacatcgtggtgttgatcatccttgtgattgtctatgtcgcgggctgtgccgcattccgcaatgccaagaggatcgagaatgacgagccgatcggcatggcacggatgaccaagtcccatcctagcaggttccagttctag

SEQ ID NO: 19221 - protein, 294 aa, Sorghum bicolor
  misc_feature: Useful for making plants with modulated nitrogen use efficiency
  misc_feature: Functional homolog of the protein sequence given in SEQ ID NO 14695
  misc_feature: Ceres ANNOT ID no. 8724645
  misc_feature (6)..(256): Pfam ID: Tetraspannin Pfam Description: Tetraspanin family
MLRGGTSVLGIINFITFLISIPILGGGIWLASRANSTDCIRFLQWPIIVVGLVLMVISLMGFAGACYRQTWLLRLYLFAMFFVVLALLFFIVFAFAVTDRGDGQVVMNRRFPEYQLSDYSGWLRDRVADPEYWATISACLRDGHACAGMRRLARDPNTGMLVPETPAMFYGRNLSPIQSGCCKPPTSCAFTYMNETYWTQNPGVPTVMNDPDCSRWSNDQQMLCFQCDSCKAGVLAGIKKSWRKVAILNIVVLIILVIVYVAGCAAFRNAKRIENDEPIGMARMTKSHPSRFQF

SEQ ID NO: 19222 - DNA, 1149 bp, Sorghum bicolor
  misc_feature: Ceres ANNOT ID no. 8724644
  misc_feature: Encodes the peptide sequence at SEQ ID NO 19223
atggagcgcaagcgcgggaaggcctatctgatgcctccctccgcactttttttcccctccctcccctctatcagaattcagaagcacctcggctcctccgtccgcgccgcgccagccaaccaccgccggcccacacactacacttccactctcgttggcctcttcttcggctccgatccgattcgattccatccctcggccggcgtcctgcgggagggaggtgcaagccgaaccagcccgccaatggcagctgcgcggcggccgggggcgacgaagcccaagggcggcggcggcgggggcgcggggaggaggaggagcgcgtggctggcggcggacgggagcaagcgctggggggaggccttcttcctgctctacacgcctttctggctcactctctgcctcggtgtcgtcgtccccttcaagctctacgagaggttcacggagctggagtacctgatccttggcttggtgtccaccgtgccggcgttcctcatccccctattcctcgtagggaaggcagatagtgttagaaatttcaaagatcgatactgggtcaaggctaatatttggattataatttttagctatgttggtaactacttctggacacattatttcttcacagttcttggcgcgtcatatacttttccatcatggaggatgaataatgtaccccatacgacgtttctcctgacccatgcttgtttcctgttctatcatatggcatcaaatatgacactccgtagattacgtcactctgcagctcacttaccacagtctattcgctggttatttgaagctgcatggattttagcactgtcatacttcatagcgtacttggagaccctagccattgcaaatttcccatactatgaatttgttgaccgggatataatgtacaaagtaggttccttgttctacgcaatatacttcatcgtcagcttcccaatgttttcaaggattgatgaaaaagatgagaagtggaacctatccagggtagctgttgactctctgggcgcagcgatgctcgtcacgataatactcgacctatggcgcatatttttggggccaatagttcctatcccagagtcgaggcagtgtggtcaaccggggctcgcatggttccaagtgcagaacgaaagcacctga

SEQ ID NO: 19223 - protein, 382 aa, Sorghum bicolor
  misc_feature: Useful for making plants with altered sterol content
  misc_feature: Functional homolog of the protein sequence given in SEQ ID NO 13930
  misc_feature: Ceres ANNOT ID no. 8724644
  misc_feature: Down-regulated in shoot tissues in response to salicylic acid treatment
  misc_feature (106)..(375): SWISSPROT Homolog: EC 5.5.1.9 Cycloeucalenol cycloisomerase
MERKRGKAYLMPPSALFFPSLPSIRIQKHLGSSVRAAPANHRRPTHYTSTLVGLFFGSDPIRFHPSAGVLREGGASRTSPPMAAARRPGATKPKGGGGGGAGRRRSAWLAADGSKRWGEAFFLLYTPFWLTLCLGVVVPFKLYERFTELEYLILGLVSTVPAFLIPLFLVGKADSVRNFKDRYWVKANIWIIIFSYVGNYFWTHYFFTVLGASYTFPSWRMNNVPHTTFLLTHACFLFYHMASNMTLRRLRHSAAHLPQSIRWLFEAAWILALSYFIAYLETLAIANFPYYEFVDRDIMYKVGSLFYAIYFIVSFPMFSRIDEKDEKWNLSRVAVDSLGAAMLVTIILDLWRIFLGPIVPIPESRQCGQPGLAWFQVQNEST

SEQ ID NO: 19224 - DNA, 1344 bp, Sorghum bicolor
  misc_feature: Ceres ANNOT ID no. 8724663
  misc_feature: Down-regulated in shoot tissues in response to salicylic acid treatment
  misc_feature: Encodes the peptide sequence at SEQ ID NO 19225
atgatgagctgctttgggtgtttcaagcctgagaagaagatgcctccccggaggctggaggccagggaggtcacggttgtgaagaaggccccaagccagaatgaagcgcctcccagggaatctgggtccgtcaggccatcaccagtcacttcaaagcacaagccatcatctgaaacaccaacaagcactgaacctcctaaaggaagttgttctgtttccaaaaccgcaaaagcattcacattccgtgagctagccacggctacaaagaatttccgttccgactgcctccttggagaagggggctttggcagggtatacaagggcaagcttgaaaatggacagcttgttgctgtcaagcaactagacctgaatgggtatcaaggcaacagagagttcctagttgaggtcctgatgctcagtctattgcaccatccaaacctagtcaatttggttggctattgcgcagatggagatcaaaggcttctggtgtacgagtacatggcacttggttcacttgcagatcacctgcttgatagcactcctgatcaagtgccactgagttggtatctcaggatgaagatagctcatggaactgctaaagggcttgaatacctccatgagaaggcaaacccacctgtcatttaccgggatctcaagtcccccaacatccttcttgatgagaagtacaaccctaagctctcagattttgggcttgcaaagcttggtccagtcggggcaaagacacacatctccactcgggtgatgggaacatatgggtactgtgctcccgaatacataaaaacaggccagctaactgtcaagactgacgtgtacagttttggagttttcctactggagttgatcacaggaagaagagcggtagatacctccaggccagcaaatgaacaaatcctggttaactgggtcaagccattgctgagagacaggaagaggtacaatgagctagtagaccctaatcttagaggtgagtacccagaaaaagacttgagccaagctgtgggtgtagcagcaatgtgcctacaagaggaagcctcagtccgaccttacatgagtgatgctgttgtggccctgggattcctcgcagaaatgcctgctggctataaacacaaatctggccctatactcccaatgaaacaagttagagatccatcactaactaatagtggtagcgctaagcaacataacgatgcatacaatcgtcaaaaggctgtagctgaggccattgagtggggctcactgaggcagaaacagaaggctcaaagtccagaaaagaaagctcaaagtcaaggtggaacatcccctccagaagccagcagattgtaa

SEQ ID NO: 19225 - protein, 447 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8724663
  misc_feature (2)..(440): SWISSPROT Homolog: EC 2.7.11.1 Non-specific serine/threonine protein kinase
  misc_feature (91)..(364): Pfam ID: Pkinase Pfam Description: Protein kinase domain
MMSCFGCFKPEKKMPPRRLEAREVTVVKKAPSQNEAPPRESGSVRPSPVTSKHKPSSETPTSTEPPKGSCSVSKTAKAFTFRELATATKNFRSDCLLGEGGFGRVYKGKLENGQLVAVKQLDLNGYQGNREFLVEVLMLSLLHHPNLVNLVGYCADGDQRLLVYEYMALGSLADHLLDSTPDQVPLSWYLRMKIAHGTAKGLEYLHEKANPPVIYRDLKSPNILLDEKYNPKLSDFGLAKLGPVGAKTHISTRVMGTYGYCAPEYIKTGQLTVKTDVYSFGVFLLELITGRRAVDTSRPANEQILVNWVKPLLRDRKRYNELVDPNLRGEYPEKDLSQAVGVAAMCLQEEASVRPYMSDAVVALGFLAEMPAGYKHKSGPILPMKQVRDPSLTNSGSAKQHNDAYNRQKAVAEAIEWGSLRQKQKAQSPEKKAQSQGGTSPPEASRL

SEQ ID NO: 19226 - DNA, 444 bp, Sorghum bicolor
  misc_feature: Ceres ANNOT ID no. 8724702
  misc_feature: Encodes the peptide sequence at SEQ ID NO 19227
atgtcgtcgtcacgccggagctcgagccccgacagcaacaacaacacggacgtgagcggcggcggcggaggcgggttcgccgcggacgagcggaagcggaagcggatgctgtcgaacagggagtcggcgcgtcggtcccgcgcgaagaagcagcagcggctggaggagctggtggcggaggtggcccgtctgcaggcggagaacgcggcggcgcagtcccgcatcgcggcgttcgagcgcgagttcgccaaggtggacggcgacaacgccgtgctgcgcgcccgccacggggagctgtccagccggctcgagtcgctcggcggcgtcctggaggtgcttcagatggccggcgccgccgtcgacatcccggagatggtcactgaagaccccatgctccgcccctggcagccgtcgttccccccgatgcagcccatcgggttctga

SEQ ID NO: 19227 - protein, 147 aa, Sorghum bicolor
  misc_feature: Useful for biocontainment applications
  misc_feature: Functional homolog of the protein sequence given in SEQ ID NO 14696
  misc_feature: The sequence is a functional homolog of SEQ ID NO 1342 in the 10/374,780 US patent application
  misc_feature: Ceres ANNOT ID no. 8724702
  misc_feature (27)..(90): Pfam ID: bZIP_1 Pfam Description: bZIP transcription factor
MSSSRRSSSPDSNNNTDVSGGGGGGFAADERKRKRMLSNRESARRSRAKKQQRLEELVAEVARLQAENAAAQSRIAAFEREFAKVDGDNAVLRARHGELSSRLESLGGVLEVLQMAGAAVDIPEMVTEDPMLRPWQPSFPPMQPIGF

SEQ ID NO: 19228 - DNA, 972 bp, Sorghum bicolor
  misc_feature: Ceres ANNOT ID no. 8724745
  misc_feature: Encodes the peptide sequence at SEQ ID NO 19229
atggcgacctcaacgtgccaggccttagtgatcatcctgatcgctgtagctgctgcaatgagcacggcgtctggtacagcattgcagtacgacttctacaagtcgtcgtgcccaaaagccgaggaggctgtccgcaacgccactcagaagatcatctccaacgaccccaccatggctgccgcctttgtgcgcctcttcttccatgactgcttcgtcaggggttgtgacgcttccattctgctcgaccaatccaatagcaactcacagcctgagaagttagccatcccgctacgtggttacgctgaagtgaacatgatcaaggcggccgtggaggccgagtgccaaggcgtcgtctcctgcgccgacatcctcgcctatgcggcgcgcgactccgccatcctctccggcggcttcggcttcgccatgcccggtggccggcgcgacggattcgtgtccaactcgaacaacatttttgggaacctccctggacccaacatgcaggtccaggacctcatcacgagcttcaacaacaagggcctcagctccactgacctggtggcgctctccggcgcacactcctttggccaaacgcactgctccttcgttacgccccggctgtaccccaccgtggacacgaccatgaacggcagcttcgcccaagggctaaagacagtgtgcccatcgcaaggcggtggtggcaccgtgctgaacaacaaccgtgtgacagaccccaacaggctgagcaaccagtattacaccaacttggccaccgggcaggtgatgttcacgtcggaccagacgctgacgagcaatgccaccaccaacaagatggtgcaggacaatgctgccgacccggtcgcatggatggcacggttcgcggcggcgatggtcaagatgggaggtatccaggtgctcaccggcaaccagggtgagatcaggagagtctgcggcgccaccaacagtggtaactga

SEQ ID NO: 19229 - protein, 323 aa, Sorghum bicolor
  misc_feature: Useful for making plants with altered carbohydrate content
  misc_feature: Functional homolog of the protein sequence given in SEQ ID NO 14536
  misc_feature: Ceres ANNOT ID no. 8724745
  misc_feature (28)..(321): SWISSPROT Homolog: EC 1.11.1.7 Peroxidase
  misc_feature (44)..(284): Pfam ID: peroxidase Pfam Description: Peroxidase
MATSTCQALVIILIAVAAAMSTASGTALQYDFYKSSCPKAEEAVRNATQKIISNDPTMAAAFVRLFFHDCFVRGCDASILLDQSNSNSQPEKLAIPLRGYAEVNMIKAAVEAECQGVVSCADILAYAARDSAILSGGFGFAMPGGRRDGFVSNSNNIFGNLPGPNMQVQDLITSFNNKGLSSTDLVALSGAHSFGQTHCSFVTPRLYPTVDTTMNGSFAQGLKTVCPSQGGGGTVLNNNRVTDPNRLSNQYYTNLATGQVMFTSDQTLTSNATTNKMVQDNAADPVAWMARFAAAMVKMGGIQVLTGNQGEIRRVCGATNSGN

SEQ ID NO: 19230 - DNA, 1239 bp, Sorghum bicolor
  misc_feature: Ceres ANNOT ID no. 8724733
  misc_feature: Encodes the peptide sequence at SEQ ID NO 19231
atggcctcggtgggcgtggcacgctcttcttcttctttgggatttcagaatggcacaagttctagcagcgacgcagatcgacttcccaacgagttgggcaatatgagcataagggatgataaggacgttgaagatattgtagtcaatggcaatggggcagagcctggtcatatcatagtgaccagcattgatgggagaaatgggcaggcaaagcagaccattagttacatggctgagcgggtggtaggtcatgggtcctttggaactgttttccaggccaagtgtctggaaactggtgagaccgtagctataaaaaaggttcttcaagacaagagatacaagaatcgtgagctgcagactatgcgagtgcttgaccacccaaatgtggtggctctaaagcactgttttttctcaaagactgagaaagaggagctttatctcaatttggtgcttgagtatgtgccggagactgctcatcgtgtcattaaacattataacaagatgaaccagcgcatgcctttgatatatgcaaaactttatatgtatcagatttgtagagctttggcatatattcataacagcattggagtgtgccacagggacattaagccgcaaaatctcctggttaaccctcatacccatcagctaaaactgtgtgactttggcagtgcgaaagttctggtaaaaggcgaaccaaacatttcttacatctgttctaggtactacagagctccagagctcatatttggtgctactgaatacactacagccattgatgtttggtctgctggctgtgtactcgctgagctgcttctagggcagccactattccctggagaaagcggtgttgatcagcttgttgaaatcatcaaggttctgggcacacccacacgtgaagaaattaagtgcatgaatccaaattataccgaatttaaattcccgcaaatcaaagctcacccatggcataagatcttccataaaaggatgcctgctgaagcagtagatctcgtgtccaggcttcttcagtactcgccaaaacttcggtccactgctttggaagcattgatccatccattctttgatgaacttcgggatccaaacacccgcttaccaaatggccgctttcttccacctctcttcaatttcaagccccatgagctgaagagtgtaccgatggatttcctggtgaagttgatccctgagcatgcacggaagcaatgtgcctttgtagggtggtga

SEQ ID NO: 19231 - protein, 412 aa, Sorghum bicolor
  misc_feature: Useful for making plants with modulated water use efficiency
  misc_feature: Functional homolog of the protein sequence given in SEQ ID NO 14073
  misc_feature: Useful for making plants with modulated biomass
  misc_feature: Functional homolog of the protein sequence given in SEQ ID NO 14074
  misc_feature: Ceres ANNOT ID no. 8724733
  misc_feature: Down-regulated in shoot tissues in response to methyl jasmonate treatment
  misc_feature: Up-regulated in root tissues in response to salicylic acid treatment
  misc_feature (1)..(411): SWISSPROT Homolog: EC 2.7.11.1 Non-specific serine/threonine protein kinase
  misc_feature (76)..(360): Pfam ID: Pkinase Pfam Description: Protein kinase domain
MASVGVARSSSSLGFQNGTSSSSDADRLPNELGNMSIRDDKDVEDIVVNGNGAEPGHIIVTSIDGRNGQAKQTISYMAERVVGHGSFGTVFQAKCLETGETVAIKKVLQDKRYKNRELQTMRVLDHPNVVALKHCFFSKTEKEELYLNLVLEYVPETAHRVIKHYNKMNQRMPLIYAKLYMYQICRALAYIHNSIGVCHRDIKPQNLLVNPHTHQLKLCDFGSAKVLVKGEPNISYICSRYYRAPELIFGATEYTTAIDVWSAGCVLAELLLGQPLFPGESGVDQLVEIIKVLGTPTREEIKCMNPNYTEFKFPQIKAHPWHKIFHKRMPAEAVDLVSRLLQYSPKLRSTALEALIHPFFDELRDPNTRLPNGRFLPPLFNFKPHELKSVPMDFLVKLIPEHARKQCAFVGW

SEQ ID NO: 19232 - DNA, 1017 bp, Sorghum bicolor
  misc_feature: Ceres ANNOT ID no. 8724756
  misc_feature: Down-regulated in shoot tissues in response to methyl jasmonate treatment
  misc_feature: Up-regulated in root tissues in response to salicylic acid treatment
  misc_feature: Encodes the peptide sequence at SEQ ID NO 19233
atgagcgccggcaccagagctgatgaggtcgtcgtccaagtacggcagctcgtcgtcgtagtggctgtcgccgtgatggcgacatcatgcttctcctcctcggaggcgcagctccaggtcgggtactacaacgccacctgccccgccgccgagagcctcatcgagaccatcgtccacgccgccgtccgtaaggacgccggcaacggccccggcctcatccgcctcttcttccacgactgcttcgtcaggggatgcgacgcgtcggtgctgctagacgacccgacgggcacgccagggaacaggacggtggagaagacgtcgcaaccaaacttccccagcctccgtgggttcagcgtcatcaaccgggcgaaacgcgtggtggagcggcggtgcccggggacagtctcgtgcgccgacatcgtcgccttcgcggcgcgcgacgccgcccggatcatgggcgggatccgcttcgccatgccttccggccgcctcgacgggcgcgtctccaacgcgtccgaggcgacggccaaccttccgccggcgtcgttcaacctgacgcagctcctggcccggttcgcgtccaagaacctcaccgccgacgacctcgtcacgctgtcgggcgcccactccatcggccgctcccactgctcctccttcgccaacacgcggctgtacccgcagctggacgccacgctgaacgtcacgctggcggcgaggctcagggccaagtgccccgccgctcccggcgggaaagaccgcgtcgtcgacctcgatttcaggacgccgctgcagctggacaaccagtactacagcaacgtggcgacgcatgaggtggtgttcgggtcggaccaggcgctcggcgaccggaacgacacggcggcgctcgtcgcgctgtatgctgccaaccgtaagatatggtcgcagaagttcgcggcggccatggtgaagatgggtagcatcgaggtgctcaccggcccccccggcgaggtcaggctcaagtgcaacaaggtcaactga

SEQ ID NO: 19233 - protein, 338 aa, Sorghum bicolor
  misc_feature: Useful for making plants with altered carbohydrate content
  misc_feature: Functional homolog of the protein sequence given in SEQ ID NO 13714
  misc_feature: Ceres ANNOT ID no. 8724756
  misc_feature: Up-regulated in root tissues in response to methyl jasmonate treatment
  misc_feature (36)..(338): SWISSPROT Homolog: EC 1.11.1.7 Peroxidase
  misc_feature (54)..(302): Pfam ID: peroxidase Pfam Description: Peroxidase
MSAGTRADEVVVQVRQLVVVVAVAVMATSCFSSSEAQLQVGYYNATCPAAESLIETIVHAAVRKDAGNGPGLIRLFFHDCFVRGCDASVLLDDPTGTPGNRTVEKTSQPNFPSLRGFSVINRAKRVVERRCPGTVSCADIVAFAARDAARIMGGIRFAMPSGRLDGRVSNASEATANLPPASFNLTQLLARFASKNLTADDLVTLSGAHSIGRSHCSSFANTRLYPQLDATLNVTLAARLRAKCPAAPGGKDRVVDLDFRTPLQLDNQYYSNVATHEVVFGSDQALGDRNDTAALVALYAANRKIWSQKFAAAMVKMGSIEVLTGPPGEVRLKCNKVN

SEQ ID NO: 19234 - DNA, 972 bp, Sorghum bicolor
  misc_feature: Ceres ANNOT ID no. 8724743
  misc_feature: Up-regulated in root tissues in response to methyl jasmonate treatment
  misc_feature: Encodes the peptide sequence at SEQ ID NO 19235
atggcgaccccaacgtgccaggccttagtgatcatcctgatcgctgtagctgctgcaatgagcacggcgtctggtacagcattgcagtacgacttctacaagtcgtcgtgcccaaaagccgaggaggctgtccgcaacgccactcagaagatcatctccaacgaccccaccatggctgccgcctttgtgcgtctcttcttccatgactgcttcgtcaggggttgtgacgcttccattctgctcgaccagtccaatagcaactcacagcctgagaagttagccatcccgctacgtggttacgccgaagtgaacatgatcaagggggccgtggaggccgagtgccaaggcgtcgtctcctgtgccgacatcctcgcctacgcggcgcgcgactccgccatcctctccggcggcttcggcttcgccatgcccggcggccggcgcgacggattcgtgtccaactcgaacaacatttttgggaacctccctgcccccaacatgcaggtccaggacctcatcacaagcttcaacaacaagggcctcagctccactgacctggtggcgctctccggcgcacactcctttggccaaacgcactgctccttcgtcacgccccggctgtaccccaccgtggacacgaccatgaacggcagcttcgcccaagggctcatggcagtgtgcccatcgcaaggcggtggcggcaccgtgctgaacaacaaccgtgtgacagatcccaacaggctgagcaaccagtattacaccaacttggccaccgggcaggtgatgttcacgtcggaccagacgctgacgagcaacgccaccaccaacaagatggtgcaggacaatgctgccgacccggtcgcatggatggcacggttcgcggcggcgatggtgaagatgggaggtatccaggtgctcaccggcaaccagggtgagatcaggagagtctgtggcgccaccaacagtggtaactga

SEQ ID NO: 19235 - protein, 323 aa, Sorghum bicolor
  misc_feature: Useful for making plants with altered carbohydrate content
  misc_feature: Functional homolog of the protein sequence given in SEQ ID NO 14536
  misc_feature: Ceres ANNOT ID no. 8724743
  misc_feature (28)..(321): SWISSPROT Homolog: EC 1.11.1.7 Peroxidase
  misc_feature (44)..(284): Pfam ID: peroxidase Pfam Description: Peroxidase
MATPTCQALVIILIAVAAAMSTASGTALQYDFYKSSCPKAEEAVRNATQKIISNDPTMAAAFVRLFFHDCFVRGCDASILLDQSNSNSQPEKLAIPLRGYAEVNMIKGAVEAECQGVVSCADILAYAARDSAILSGGFGFAMPGGRRDGFVSNSNNIFGNLPAPNMQVQDLITSFNNKGLSSTDLVALSGAHSFGQTHCSFVTPRLYPTVDTTMNGSFAQGLMAVCPSQGGGGTVLNNNRVTDPNRLSNQYYTNLATGQVMFTSDQTLTSNATTNKMVQDNAADPVAWMARFAAAMVKMGGIQVLTGNQGEIRRVCGATNSGN

SEQ ID NO: 19236 - DNA, 1191 bp, Sorghum bicolor
  misc_feature: Ceres ANNOT ID no. 8724759
  misc_feature: Encodes the peptide sequence at SEQ ID NO 19237
atggccgcagtcgacaccttcctcttcacctcggagtctgtgaatgagggacacccagacaagctctgcgaccaggtctcagatgctgttcttgacgcttgccttgctgaggaccctgacagcaaggttgcttgcgagacctgcaccaagaccaacatggtcatggtctttggtgagatcaccaccaaggccaatgtcgactacgagaagattgtcagggagacctgccgcaacattggtttcgtgtcagctgatgtcgggcttgacgctgaccactgcaaggtgcttgtgaacattgagcagcagtctcctgatattgctcagggtgtgcacggccacttcaccaagcgccccgaggagattggagctggtgaccagggacacatgtttgggtatgccactgatgagacccctgagctgatgcccctcagccatgtccttgccaccaagcttggtgcaaaactcaccgaggtccgcaagaatggaacctgcgcctggctcaggcctgatgggaagacccaggtgacagttgagtaccgcaatgagggtggtgccatggtccccatccgtgtccacactgtcctcatctctacccagcacgacgagacagtcaccaatgatgagattgctgctgacctgaaggagcatgtcatcaagcctgtcatccctgagcagtaccttgatgagaagaccatcttccaccttaacccatctggtcgctttgtcattggtggacctcacggtgatgctggtcttactggccggaagatcatcattgacacctatggtggctggggagcccacggtggtggcgctttctccggcaaggacccaaccaaggtcgaccgcagtggagcctacatcgcaaggcaggctgccaagagcattgttgccaacggccttgctcgccgcgccatcgtccaggtctcctacgccatcggtgtgcctgagcctctctccgtctttgttgacacgtatggcaccggcacgattcctgacaaggagatcctcaagattgtgaaggagaactttgacttcaggcctggcatgatcatcatcaacctcgacctcaagaaaggtggcaacgggcgctacctcaagacggcggcctacggccactttggaagggacgaccctgacttcacctgggaggtggtgaagcccctcaaggcggagaagccttctgcctaa

SEQ ID NO: 19237 - protein, 396 aa, Sorghum bicolor
  misc_feature: Useful for making plants with modulated biomass
  misc_feature: Functional homolog of the protein sequence given in SEQ ID NO 14410
  misc_feature: Ceres ANNOT ID no. 8724759
  misc_feature (1)..(396): SWISSPROT Homolog: EC 2.5.1.6 Methionine adenosyltransferase
  misc_feature (119)..(241): Pfam ID: S-AdoMet_synt_M Pfam Description: S-adenosylmethionine synthetase, central domain
  misc_feature (243)..(385): Pfam ID: S-AdoMet_synt_C Pfam Description: S-adenosylmethionine synthetase, C-terminal domain
  misc_feature (5)..(104): Pfam ID: S-AdoMet_synt_N Pfam Description: S-adenosylmethionine synthetase, N-terminal domain
MAAVDTFLFTSESVNEGHPDKLCDQVSDAVLDACLAEDPDSKVACETCTKTNMVMVFGEITTKANVDYEKIVRETCRNIGFVSADVGLDADHCKVLVNIEQQSPDIAQGVHGHFTKRPEEIGAGDQGHMFGYATDETPELMPLSHVLATKLGAKLTEVRKNGTCAWLRPDGKTQVTVEYRNEGGAMVPIRVHTVLISTQHDETVTNDEIAADLKEHVIKPVIPEQYLDEKTIFHLNPSGRFVIGGPHGDAGLTGRKIIIDTYGGWGAHGGGAFSGKDPTKVDRSGAYIARQAAKSIVANGLARRAIVQVSYAIGVPEPLSVFVDTYGTGTIPDKEILKIVKENFDFRPGMIIINLDLKKGGNGRYLKTAAYGHFGRDDPDFTWEVVKPLKAEKPSA

SEQ ID NO: 19238 - DNA, 1002 bp, Sorghum bicolor
  misc_feature: Ceres ANNOT ID no. 8724754
  misc_feature: Encodes the peptide sequence at SEQ ID NO 19239
atggtgtcgacatggctggcaacagtcttggcggcgctcgtcgtcgccacggcggcacacgcggcggcggaactggaggtcggtttctacaagcactcgtgcccaaaggccgaggagatcgtgcgcaacgccgtccgccgcggtatcgcccgtgacgccggcgtcggcgccggactcatccggatgcagttccatgactgcttcgtccggggctgcgacgcctccatcctcatcaactccacgccgggcaacaaggccgagaaggactccgtcgccaacaaccccagcatgcgcggcttcgacgtcgtcgacgacgccaaggccgtcctcgaggcgcactgcccgcgcaccgtctcctgcgccgacatcatcgcgttcgccgcccgcgacggcgcctacctcgccggcggcctcgactacaaggtcccctcgggccgccgtgacggccgcgtgtccaaagaggacgaggtgctcgacaacaatgtccccgccccgtttgacgacgtcgccgagctcatcaagagcttcaagcgcaagggtctcaacgccgacgacatggtcacgctctccggcgcgcacaccattggccgctctcactgctcctccttcacgcagcgcctttacaacttcagcggccagctcgggcggactgacccgtcgcttgaccccacctacgctgagcacctcaagatgcgctgcccatggccgtccagcaacggccagatggacaccacggtggtgccgctcgacccggtcacgccggcgaccttcgacaaccagtactacaagaacgtgctggcgcacaaggtcctgttcgtctccgacaacacgctgctcgacaacccctggacggccggaatggtccacttcaacgccgcagtcgagaaagcatggcaggtcaagttcgccaaggccatggtgaagatgggcaaggtccaggtgctcaccggcgacgagggagagatcagggagaagtgcttcgtcgtcaacccacactactag

SEQ ID NO: 19239 - protein, 333 aa, Sorghum bicolor
  misc_feature: Useful for making plants with altered carbohydrate content
  misc_feature: Functional homolog of the protein sequence given in SEQ ID NO 13714
  misc_feature: Useful for making plants with altered cell wall content and/or composition
  misc_feature: Functional homolog of the protein sequence given in SEQ ID NO 13958
  misc_feature: Ceres ANNOT ID no. 8724754
  misc_feature (29)..(330): SWISSPROT Homolog: EC 1.11.1.7 Peroxidase
  misc_feature (41)..(294): Pfam ID: peroxidase Pfam Description: Peroxidase
MVSTWLATVLAALVVATAAHAAAELEVGFYKHSCPKAEEIVRNAVRRGIARDAGVGAGLIRMQFHDCFVRGCDASILINSTPGNKAEKDSVANNPSMRGFDVVDDAKAVLEAHCPRTVSCADIIAFAARDGAYLAGGLDYKVPSGRRDGRVSKEDEVLDNNVPAPFDDVAELIKSFKRKGLNADDMVTLSGAHTIGRSHCSSFTQRLYNFSGQLGRTDPSLDPTYAEHLKMRCPWPSSNGQMDTTVVPLDPVTPATFDNQYYKNVLAHKVLFVSDNTLLDNPWTAGMVHFNAAVEKAWQVKFAKAMVKMGKVQVLTGDEGEIREKCFVVNPHY

SEQ ID NO: 19240 - DNA, 1704 bp, Sorghum bicolor
  misc_feature: Ceres ANNOT ID no. 8724790
  misc_feature: Encodes the peptide sequence at SEQ ID NO 19241
atggacttggtgccgaagcagcagcagcagcagcggagcaaggagaagcaagaggaggaagaggagatgatgatggccttggccgagcacggggacaggccgcaggcggcggctttcggtcacggtggcggcggaggcggcgggcgcaggagcgagatcaaggaggtggacttcttctccaccgccggcggtgccgctcgccgcaggaccgacgacgacgacgatggggatcgagaggaggccgccgcaggagcactggcacgcggttgccataacaccacggtcaacactgcacttgacctgctgaccaccagggcggcggcggcggcggcgacgccagcagcagtcgacggcggcgagggtacggcgagtggtcgtgatacagaggtaccaatagtggatgtggcggcgacggcggcggtggagggggagctccggcaggccagcgaggagaaccggcggctgcggcggatgctggaggagctcacccgcagctacggcgcactctaccatcagctcatccaagcccaggctcagcagcagcagcaacaggcctgcagtggcggcgcagcgaacccgatgctaccggcggcaacgacgacgggagtacagttcatggaccacgccggccgcgttgctccggcgatagcaggagaagcggccccgccggcgttcagcggtgacaggggcgattcagacgatggcagcggaggaaatggcggcgaagcggatcaaaacgatgggatgaagacgcctgagcgcggcgagaacgtcgaccggtcaccggcggcggcggcggaggcgcctttgcggcgggcaagagtgtccgtgcgcgcacggtccgaggccccaatgatcagcgatggatgccaatggaggaagtatgggcagaagatggccaagggtaacccatgccccagagcttactaccgctgcacaatggccacaggatgcccagtcaggaagcaggtacaacggtgcgcggaggacaaggcggtgctgatcaccacgtacgagggcacgcacaaccaccagctgccaccggcggcggccgcgatggccaagacgacctccgccgcggcggccatgctcctctcgggcccggccgtcagccgcgacgtgggcgcgctcttcgccggccaccacgtcgccgccccggcgccgctattccagtaccaccacccctacgcgtccgccatggccggcgccacgctgtccgcctccgcgccgttcccgaccatcaccctcgacctcacgcacgcgccgtcgccgggggcggcggcggcggctgcggctgccgcgggcctgctccagcagcgccagctgatgccgccgcctgtccccacgatgacgccgttcccgatgtacggcttcactgctgccgctgggcacaggccggtgccgccgccacagccaccggcggcgacgacgctgtttggtttggacggcagcaaccggtcggcgctggagaccatgactgctgcgatcactaacgaccccaacttcaccacggtcgtggcggccgccctctcgacgatcatggcgggaggcgcagagccaccggttccccggagcggcgccgctgacgccggagatggtagcaacggtagcgttggcattgagcctgccacggcggcggcggccggagcacgtgagaatgcattgcatgcacttttacaaagacttcatgacagccggcaatga

SEQ ID NO: 19241 - protein, 567 aa, Sorghum bicolor
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8724790
  misc_feature (286)..(346): Pfam ID: WRKY Pfam Description: WRKY DNA -binding domain
MDLVPKQQQQQRSKEKQEEEEEMMMALAEHGDRPQAAAFGHGGGGGGGRRSEIKEVDFFSTAGGAARRRTDDDDDGDREEAAAGALARGCHNTTVNTALDLLTTRAAAAAATPAAVDGGEGTASGRDTEVPIVDVAATAAVEGELRQASEENRRLRRMLEELTRSYGALYHQLIQAQAQQQQQQACSGGAANPMLPAATTTGVQFMDHAGRVAPAIAGEAAPPAFSGDRGDSDDGSGGNGGEADQNDGMKTPERGENVDRSPAAAAEAPLRRARVSVRARSEAPMISDGCQWRKYGQKMAKGNPCPRAYYRCTMATGCPVRKQVQRCAEDKAVLITTYEGTHNHQLPPAAAAMAKTTSAAAAMLLSGPAVSRDVGALFAGHHVAAPAPLFQYHHPYASAMAGATLSASAPFPTITLDLTHAPSPGAAAAAAAAAGLLQQRQLMPPPVPTMTPFPMYGFTAAAGHRPVPPPQPPAATTLFGLDGSNRSALETMTAAITNDPNFTTVVAAALSTIMAGGAEPPVPRSGAADAGDGSNGSVGIEPATAAAAGARENALHALLQRLHDSRQ

SEQ ID NO: 19242 - DNA, 891 bp, Sorghum bicolor
  misc_feature: Ceres ANNOT ID no. 8724840
  misc_feature: Encodes the peptide sequence at SEQ ID NO 19243
atggcgtcccagaagcagttcccgccgcagcagcagggatcccagcccggcaaggagcacgccatggacccgcgccctgaggccatcctccagaactacaaggcggcgaacaagctcaagaacaaggtggcgctggtgaccggcggcgactccggcatcggccgcgcggtgtgcctcctcttcgcggcggagggcgcgtcggtagccttcacgtacgtgaagggccacgaggacaaggacgcggaggagacgctccgggcgctgcgcgacatctcctcccgcacgggcgcgcgcccgcccatggcgctcgccgccgacctcgggtacgaggacagctgccggagcgtggtggaggaggtggcgtcggcgcacggcggccgcatcgacgtgctcgtcaacaacgccgccgagcagcacgagcggcggtccatcacggaggtcgccgagcccgacctcgaccgcgtgttccgcaccaacatcttctcctacttcctcacgacgaagcacgcggtggcgcgcatggcgccgcacggcggcgggtccgtcatcaacacggcgtcggtgaacgcgtacaagggacacaagacgctgctggactacacgtccaccaagggcgccatcgtgtccttcacgcgcgcgctggcgctgcagctcgccgacaagggcatccgtgtcaatggcgtcgcgccggggcctatctggacgccgctcatcccggcgtcgttcggcgaggagaaggtggagcagttcggctccgaggtgcccatgaagcgcgccggacagccggctgaggttgcgcctagctacgtcttcctcgccagcgagcaggactcgtcgtacatcaccggacagttcctccacgtcaacggaggcgtcatcgtcaatgggtag

SEQ ID NO: 19243 - protein, 296 aa, Sorghum bicolor
  misc_feature: The sequence is a functional homolog of SEQ ID NO 2 in US patent 7189890
  misc_feature: Ceres ANNOT ID no. 8724840
  misc_feature (47)..(294): SWISSPROT Homolog: EC 1.1.1.100 3-oxoacyl-[acyl-carrier-protein] reductase
  misc_feature (42)..(219): Pfam ID: adh_short Pfam Description: short chain dehydrogenase
MASQKQFPPQQQGSQPGKEHAMDPRPEAILQNYKAANKLKNKVALVTGGDSGIGRAVCLLFAAEGASVAFTYVKGHEDKDAEETLRALRDISSRTGARPPMALAADLGYEDSCRSVVEEVASAHGGRIDVLVNNAAEQHERRSITEVAEPDLDRVFRTNIFSYFLTTKHAVARMAPHGGGSVINTASVNAYKGHKTLLDYTSTKGAIVSFTRALALQLADKGIRVNGVAPGPIWTPLIPASFGEEKVEQFGSEVPMKRAGQPAEVAPSYVFLASEQDSSYITGQFLHVNGGVIVNG

SEQ ID NO: 19244 - DNA, 294 bp, Sorghum bicolor
  misc_feature: Ceres ANNOT ID no. 8724910
  misc_feature: Encodes the peptide sequence at SEQ ID NO 19245
atggccgggccgtgccaggcacgggcactacgcgaggtggatgttgtggtggcacctccattcatctgtatctatgaggtcaagaattcactaactgatcgcattgaggtttgtgctcagaacgtgtgcggactggaaaaggatgagcctacaccagagagatcagaccaattggtggacattggttgtcagtggttattcttggacactgagcgtagacatattattggtgaagatgacgagatgattattttctgtgcatatgctactggtttgacacttccagaaacatag

SEQ ID NO: 19245 - protein, 97 aa, Sorghum bicolor
  misc_feature: Useful for making plants with modulated biomass
  misc_feature: Functional homolog of the protein sequence given in SEQ ID NO 14343
  misc_feature: Ceres ANNOT ID no. 8724910
  misc_feature (12)..(94): SWISSPROT Homolog: EC 5.3.1.1 Triose-phosphate isomerase
MAGPCQARALREVDVVVAPPFICIYEVKNSLTDRIEVCAQNVCGLEKDEPTPERSDQLVDIGCQWLFLDTERRHIIGEDDEMIIFCAYATGLTLPET

SEQ ID NO: 19246 - DNA, 1623 bp, Sorghum bicolor
  misc_feature: Ceres ANNOT ID no. 8724930
  misc_feature: Encodes the peptide sequence at SEQ ID NO 19247
atggggctgggtttgggagctcttctcaaatccggcgctctctcggtctcggactacgacgccatcgtctccatcaacatcttcatcgcgctgctctgcagctgcattgtcatcggccacttgctggaagggaaccgatgggtgaacgagtccatcaccgcgcttgtcatgggtctcatcaccggaggcgtgatcctgctggtcactaatgggacaaactcacgcattcttgtgttcagcgaggacctgtttttcatatacttgcttccgccgataatcttcaatgccgggtttcaagtaaagaaaaagcaattcttccgcaactttataacaattattttgtttggtgctgttggaactctgatttcctttgtaataatctctcttggtgctatgggattgttcaagaaacttgacgttggtccactcgagcttggggactatcttgcaattggtgctattttctctgcgacagattctgtttgcaccttacaggtgcttaaccaggatgaaacacccctactctatagtctagtttttggtgaaggcgttgttaatgatgccacatctgttgtgctcttcaatgcaattgaaaaccttgatattgctaattttgatgctattgttctgttgaatttcgtcggaaaatttctctacctgttcttcaccagcaccatacttggagtagctactgggttgcttagtgcgtacattatcaagaagctctgttttgccagacattcaactgatagagaagtttctatcatgatactcatggcatacctttcgtacatgctgtcaatgctgttggacctgagtggcattcttactgtcttcttctgtggaatagtaatgtcacattacacttggcattatgttgacagaaaacatacttttgcaactttatcattcattgcagaaattttcctcttcctctatgttgggatggatgcattggacattgagaagtggaagttagctagtagcagtcctaagaaaccgattgctttaagtgcaattatattgggcttggttatggttggaagagcggcctttgtattccctttgtcgttcctatccaacctaagtaaaaaggaggcccgtccaaagatctccttcaagcaacaagtaatcatatggtgggctggtctcatgagaggagcagtgtcaattgcacttgcctataacaagtttacatcatctggtcatactgaagtccgagttaatgctatcatgatcactagcacagttattgttgttctattcagcacaatggttttcggtctgctgaccaagccactgcttagtctcctgatcccaccaaggactggcttgaacacgtcatctctgctctccagccagtctattctggacccacttcttactagcatggtggggtctgactttgacgtaggacagatcaactcccctcagtacaacctccagtttattctcactgcgccaactcgctctgtccatcgcctttggcgcaagtttgatgatcggttcatgcgcccaatgtttggggggagaggtttcgttccctttgtgcctggttcgccggtggagcggagcgtccctgaacctcacctgggcactgtgacagaggctgagcatagttga

SEQ ID NO: 19247 - protein, 540 aa, Sorghum bicolor
  misc_feature: The sequence is a functional homolog of SEQ ID NO 2 in US patent 7250560
  misc_feature: Useful for making plants with modulated water use efficiency
  misc_feature: Functional homolog of the protein sequence given in SEQ ID NO 13934
  misc_feature: The sequence is a functional homolog of SEQ ID NO 2 in US patent 7041875
  misc_feature: Useful for making plants with modulated drought sensitivity
  misc_feature: The sequence is a functional homolog of SEQ ID NO 4 in US patent 7250560
  misc_feature: Ceres ANNOT ID no. 8724930
  misc_feature (23)..(437): Pfam ID: Na_H_Exchanger Pfam Description: Sodium/hydrogen exchanger family
MGLGLGALLKSGALSVSDYDAIVSINIFIALLCSCIVIGHLLEGNRWVNESITALVMGLITGGVILLVTNGTNSRILVFSEDLFFIYLLPPIIFNAGFQVKKKQFFRNFITIILFGAVGTLISFVIISLGAMGLFKKLDVGPLELGDYLAIGAIFSATDSVCTLQVLNQDETPLLYSLVFGEGVVNDATSVVLFNAIENLDIANFDAIVLLNFVGKFLYLFFTSTILGVATGLLSAYIIKKLCFARHSTDREVSIMILMAYLSYMLSMLLDLSGILTVFFCGIVMSHYTWHYVDRKHTFATLSFIAEIFLFLYVGMDALDIEKWKLASSSPKKPIALSAIILGLVMVGRAAFVFPLSFLSNLSKKEARPKISFKQQVIIWWAGLMRGAVSIALAYNKFTSSGHTEVRVNAIMITSTVIVVLFSTMVFGLLTKPLLSLLIPPRTGLNTSSLLSSQSILDPLLTSMVGSDFDVGQINSPQYNLQFILTAPTRSVHRLWRKFDDRFMRPMFGGRGFVPFVPGSPVERSVPEPHLGTVTEAEHS

SEQ ID NO: 19248 - DNA, 951 bp, Sorghum bicolor
  misc_feature: Ceres ANNOT ID no. 8724966
  misc_feature: Encodes the peptide sequence at SEQ ID NO 19249
atggtggttcccgtgatcgacttctccaagctggagctggacggcgccgagagggcggagacactggcgcagatcgccaatggctgcgaggagtggggcttcttccagctcgtgaaccacggcatcccgctggagcttctcgagcgcgtcaagaaggtgtgctccgactgctaccgcctccgtgaggccggcttcaaggcgtcggagccggtgcgcacgctggaggcgctcctcgacgcggagcggcgcggcgaggaggtggcgcccgtggacgacctggactgggaggacatcttctacatccacgacgggagccagtggccgtccgacccgccggcgttcaaggagaccatgcgcgagtaccgcgccgagctgaggaagctcgccgagcgcgtcatggaggccatggacgagaacctcggcctggaccggggcaccatcaaggccgccttctccggcgacggccggcacgagcctttcttcggcaccaaggtcagccactacccgccgtgcccgcgcccggacctcatcactggcctgcgcgcgcacaccgacgccggcggcgtcatcctgctgttccaggacgacaaggtcggcggcctcgaggtgctcaaggacggccagtggaccgacgtgcagccgctcgcgggcgccatcgtcgtcaacaccggcgaccagatcgaggtgctcagcaacggccggtaccgcagcgcctggcaccgcgtgctgcccatgcgcgacggcaaccgccgctccatcgcttccttctacaacccggccagcgaggccaccatctcgccggcggcggtggccaccagcggcggcgaggcgtaccccaagtacatgttcggcgactacatggacgtgtacgtcaagcagaagttccaggccaaggagccaaggttcgaagccgtcaaggcggcggcgccaaagtcatctccagcggcataa

SEQ ID NO: 19249 - protein, 316 aa, Sorghum bicolor
  misc_feature: Useful for making plants with modulated heat sensitivity
  misc_feature: Functional homolog of the protein sequence given in SEQ ID NO 12924
  misc_feature: Ceres ANNOT ID no. 8724966
  misc_feature (1)..(305): SWISSPROT Homolog: EC 1.14.17.4 Aminocyclopropanecarboxylate oxidase
  misc_feature (159)..(259): Pfam ID: 2OG-FeII_Oxy Pfam Description: 2OG-Fe(II) oxygenase superfamily
MVVPVIDFSKLELDGAERAETLAQIANGCEEWGFFQLVNHGIPLELLERVKKVCSDCYRLREAGFKASEPVRTLEALLDAERRGEEVAPVDDLDWEDIFYIHDGSQWPSDPPAFKETMREYRAELRKLAERVMEAMDENLGLDRGTIKAAFSGDGRHEPFFGTKVSHYPPCPRPDLITGLRAHTDAGGVILLFQDDKVGGLEVLKDGQWTDVQPLAGAIVVNTGDQIEVLSNGRYRSAWHRVLPMRDGNRRSIASFYNPASEATISPAAVATSGGEAYPKYMFGDYMDVYVKQKFQAKEPRFEAVKAAAPKSSPAA

SEQ ID NO: 19250 - DNA, 1044 bp, Sorghum bicolor
  misc_feature: Ceres ANNOT ID no. 8725022
  misc_feature: Encodes the peptide sequence at SEQ ID NO 19251
atgttgacattgccgccgacgccgagagcaccgatcacaagcaagaaagcatctcctcagtggtgtccgcgtgcgtgcgtccccggtggcatgcctgaggtcgccgtcatgtcggcaccggctgctgagcagggtcgccgtcgtcggctggagccggagggcgacgactatcaggccacagctgcgtcgccgtcgccgcacgcccgggcgccgccgtcgtcgcggtacaagggcgtggtgccgcagcccaacgggcggtggggcgcgcagacatacgagcggcacgcgcgcgtgtggctcggcacgttcgccgacgaggcggccgccgcgcgcgcctacgacgtggccgcgctccgcttccgcggccgcggcgccgccgccaacttcccgggccaccccgcagacgcggccgagatggcgttcctcgccgcgcggcccaaggccgaggtcgtcgacatgctgcggaagcacacctacgacgacgagctccggcaggcgctgcgctccggcggcagcggcggtggtgaccggtctctggtggtactcccacgggtgacgatgttcgagaaggcggtgacgccgagcgacgtcggccggctcaaccggatggtagtgccgaagctccacgccgagaagcacttcccgcggatcgaggaggccgccgacgcggcgcccgtgctgctcgccttcgaggacgtcggcgtcggcggcgggaccgggaaggtgtggcggttccggtactcgtactggagcagcagccagagctacgtgctcacccggggctggagccgcttcgtcagggagaagggccttgccgccggtgacaccgtcgcgttctcgcaggcggcgatcaccgacgacgcggagacgactacggatgtgaagcggcggcggatgttcatcgagtgcaggaagcggaagaggaaagacgacgacggctgcagcgacggcaacgacggcgaccattgtcctgacgatggcggtgagcgcgtcgtcaggctgttcggcgccaacattgccgccgctgcgattggagcttcatga

SEQ ID NO: 19251 - protein, 347 aa, Sorghum bicolor
  misc_feature: The sequence is a functional homolog of SEQ ID NO 20 in the 10/838,616 US patent application
  misc_feature: The sequence is a functional homolog of SEQ ID NO 1177 in the 10/374,780 US patent application
  misc_feature: The sequence is a functional homolog of SEQ ID NO 1373 in the 10/412,699 US patent application
  misc_feature: The sequence is a functional homolog of SEQ ID NO 32 in the 10/838,616 US patent application
  misc_feature: The sequence is a functional homolog of SEQ ID NO 734 in the 11/435,388 US patent application
  misc_feature: The sequence is a functional homolog of SEQ ID NO 1183 in the 10/374,780 US patent application
  misc_feature: The sequence is a functional homolog of SEQ ID NO 22 in the 10/838,616 US patent application
  misc_feature: The sequence is a functional homolog of SEQ ID NO 756 in the 11/435,388 US patent application
  misc_feature: The sequence is a functional homolog of SEQ ID NO 46 in the 10/838,616 US patent application
  misc_feature: Useful for making plants with altered lignin content
  misc_feature: Functional homolog of the protein sequence given in SEQ ID NO 12979
  misc_feature: The sequence is a functional homolog of SEQ ID NO 1258 in the 11/479,226 US patent application
  misc_feature: The sequence is a functional homolog of SEQ ID NO 138 in the 10/225,068 US patent application
  misc_feature: The sequence is a functional homolog of SEQ ID NO 170 in the 10/374,780 US patent application
  misc_feature: The sequence is a functional homolog of SEQ ID NO 2 in the 10/838,616 US patent application
  misc_feature: The sequence is a functional homolog of SEQ ID NO 208 in the 11/375,241 US patent application
  misc_feature: The sequence is a functional homolog of SEQ ID NO 580 in the 10/412,699 US patent application
  misc_feature: The sequence is a functional homolog of SEQ ID NO 630 in the 11/435,388 US patent application
  misc_feature: The sequence is a functional homolog of SEQ ID NO 796 in the 10/225,066 US patent application
  misc_feature: Useful for making plants with altered protein content
  misc_feature: Useful for making plants with altered terpenoid content
  misc_feature: Functional homolog of the protein sequence given in SEQ ID NO 13938
  misc_feature: The sequence is a functional homolog of SEQ ID NO 44 in the 10/838,616 US patent application
  misc_feature: The sequence is a functional homolog of SEQ ID NO 64 in the 10/838,616 US patent application
  misc_feature: Ceres ANNOT ID no. 8725022
  misc_feature (187)..(301): Pfam ID: B3 Pfam Description: B3 DNA binding domain
  misc_feature (74)..(123): Pfam ID: AP2 Pfam Description: AP2 domain
MLTLPPTPRAPITSKKASPQWCPRACVPGGMPEVAVMSAPAAEQGRRRRLEPEGDDYQATAASPSPHARAPPSSRYKGVVPQPNGRWGAQTYERHARVWLGTFADEAAAARAYDVAALRFRGRGAAANFPGHPADAAEMAFLAARPKAEVVDMLRKHTYDDELRQALRSGGSGGGDRSLVVLPRVTMFEKAVTPSDVGRLNRMVVPKLHAEKHFPRIEEAADAAPVLLAFEDVGVGGGTGKVWRFRYSYWSSSQSYVLTRGWSRFVREKGLAAGDTVAFSQAAITDDAETTTDVKRRRMFIECRKRKRKDDDGCSDGNDGDHCPDDGGERVVRLFGANIAAAAIGAS

SEQ ID NO: 19252 - DNA, 780 bp, Sorghum bicolor
  misc_feature: Ceres ANNOT ID no. 8725087
  misc_feature: Encodes the peptide sequence at SEQ ID NO 19253
atgagcggcgaggcggcggcggcggccgtgggcggcggaggaggaggaggaggcgagggagagacgaacggcgtccagccgaacgtcaccatctacatcaacaacctcaacgagaagatcaagctcgaagaacttaagaagtccctaactgccgttttttcccagtttgggaagattcttgatgtgctcgctttcaagactttgaagcataaaggccaagcttgggttgtcttcgaagatgtcgcatcagcgactgaggctctcaagaggatgcagggatttcccttctatgacaaaactatgagaattcaatatgccaagaccaagtcggatattgtagcaaaggccgatggcacctttgtacctcgagaaagaagaaagagggtcgatgaaaaacctgaaaagaagcagaagcgcgagcaccaccatgatgctagtcaaattgggatgggtgtaaatgcttaccctggtgtatatggggctccacagctcacccagatacctatagctggaggacagagggtcattatgccagagattatcgtaccaaacaacatcctgttcgtccaaaacctgccacacgagacaacacccatgatgctccagatgctcttctgccagtaccctggcttcaaggaggttcggatggtcgaggcgaagcctgggattgctttcgtggagtatggagacgaggggcaggccactgctgccatgaacaaccttcaaagcttcaagattacaaaagaaaaccagatggtcatcacatacgcgaagaagtaa

SEQ ID NO: 19253 - protein, 259 aa, Sorghum bicolor
  misc_feature: Useful for making plants with modulated nitrogen use efficiency
  misc_feature: Functional homolog of the protein sequence given in SEQ ID NO 14697
  misc_feature: Ceres ANNOT ID no. 8725087
  misc_feature (187)..(253): Pfam ID: RRM_1 Pfam Description: RNA recognition motif. (a.k.a. RRM, RBD, or RNP domain)
  misc_feature (31)..(103): Pfam ID: RRM_1 Pfam Description: RNA recognition motif. (a.k.a. RRM, RBD, or RNP domain)
MSGEAAAAAVGGGGGGGGEGETNGVQPNVTIYINNLNEKIKLEELKKSLTAVFSQFGKILDVLAFKTLKHKGQAWVVFEDVASATEALKRMQGFPFYDKTMRIQYAKTKSDIVAKADGTFVPRERRKRVDEKPEKKQKREHHHDASQIGMGVNAYPGVYGAPQLTQIPIAGGQRVIMPEIIVPNNILFVQNLPHETTPMMLQMLFCQYPGFKEVRMVEAKPGIAFVEYGDEGQATAAMNNLQSFKITKENQMVITYAKK

SEQ ID NO: 19254 - DNA, 1053 bp, Sorghum bicolor
  misc_feature: Ceres ANNOT ID no. 8725119
  misc_feature: Encodes the peptide sequence at SEQ ID NO 19255
atggcggcgccggggaagggaggggcggcgcgttttgcggccgtgttcttcgtcctcctgaatctcgctgtggcgatcgcggggaagagctactacgacgtgctgcaagttcccaagggcgcgtccgaggatcagattaagaggtcgtaccgcaagctcgcgctcaagtaccaccccgacaagaaccccgacaacgaggaggccaacaagcgcttcgccgagatcaacaatgcatatgaggtgttgacggaccaggagaagaggaagatctatgaccggtatggcgaggaggggttgaagcagttccaaggtgggagaggcggtggcggcggaatgaatattcaggatatctttagcagcttttttggtggtggtggtggtgggatggaagaggaggaagaacaaattgtaaaaggcgatgaggtgattgttgaactggatgcttcattagaggacttgtacatgggcggttcattaaaggtttggagagagaaaaatgtcataaagccagcacctggaaagaggcgctgcaactgtaggaacgaagtttaccaccgacaaataggtcctggaatgtatcaacagatgactgagcaggtctgcgaccaatgtccaaatgtaaaatttgtacgagaaggtgaattcttgactgttgatattgagaagggaatgaaagatggacaggaggttttgtttttcgaggaaggcgagcctaagattgatggcgaacctggcgatttgaagttcaggatccgaacagcaccacacagccgctttagacgagaaggcaatgacctgcatgcaacagtcacaatatccctggtgcaagctctggttggtttcgagaagaccatcaagcatcttgacaaccatctggtagaaattggcaccaagggcatcaccaaaccgaaggagatcaggaagttcaaaggtgaaggcatgccactataccaaagcaacaagaaaggtgacctgtatgtgacattcgaggtgttgttcccgaaaaccctaaccgatgaccagaaggcaaagcttaaggatgttctcgtgtag

SEQ ID NO: 19255 - protein, 350 aa, Sorghum bicolor
  misc_feature: Useful for making plants with modulated heat sensitivity
  misc_feature: Functional homolog of the protein sequence given in SEQ ID NO 13683
  misc_feature: Ceres ANNOT ID no. 8725119
  misc_feature (30)..(92): Pfam ID: DnaJ Pfam Description: DnaJ domain
  misc_feature (228)..(349): Pfam ID: DnaJ_C Pfam Description: DnaJ C terminal region
MAAPGKGGAARFAAVFFVLLNLAVAIAGKSYYDVLQVPKGASEDQIKRSYRKLALKYHPDKNPDNEEANKRFAEINNAYEVLTDQEKRKIYDRYGEEGLKQFQGGRGGGGGMNIQDIFSSFFGGGGGGMEEEEEQIVKGDEVIVELDASLEDLYMGGSLKVWREKNVIKPAPGKRRCNCRNEVYHRQIGPGMYQQMTEQVCDQCPNVKFVREGEFLTVDIEKGMKDGQEVLFFEEGEPKIDGEPGDLKFRIRTAPHSRFRREGNDLHATVTISLVQALVGFEKTIKHLDNHLVEIGTKGITKPKEIRKFKGEGMPLYQSNKKGDLYVTFEVLFPKTLTDDQKAKLKDVLV

SEQ ID NO: 19256 - DNA, 2319 bp, Sorghum bicolor
  misc_feature: Ceres ANNOT ID no. 8725130
  misc_feature: Encodes the peptide sequence at SEQ ID NO 19257
atggctgtcctcggcaccgcggcggttgaggcgctcatcccggtggcggcgttgattggcatcgctttcgcgatgctgcagtggtacgtggtggccagagtccccgtgccttcgcacgccggtgaggacgacggcgacggtggcggaggcggcagtaagcagcacggccacggcgtgcggggcacggaggaggacgaggaggaggacggcatggactacctgctcgtggaggcccggtgcgccgagatccagcgcgccatctccatcggcgccacgtcgttcctgctcaccgagtacaagtacctggccgcgttcacggcggcgttcgcggcggtgatcttcgtgttcctggggtcggcggggcggttcagcgcgcggccgtcgccgtgcgcgtacgacgcgtcgagggagtgccgtccggcgctggcgaacgcggcgttcagcgcggtggcgttcctgctgggcgccgccacgtccgtgctgtcgggctacctgggcatgcgcgtggcgacgttcgccaacgcgcgcacggcgctggaggcccgccacggcgtggggcgcgccttcgccgccgcgttccgctccggcgccgccatgggcttcctcctcgcctccagcgcgctcctcgtgctctacgccgccgtcaacctcttcggcctctactacggcgacgactggggcggcctctacgagtccatcacggggtacggcctcggcggctcctccgtcgccctgttcggccgcgtcggcggcggcatctacaccaaggccgctgacgtcggcgccgacctcgtcggcaaggtcgagcgcaacatccccgaggacgaccctcgcaaccccgcggtgatcgccgacaacgtgggggacaacgtcggcgacatcgccgggatggggtcggacctgttcgggtcgtacgcggagtcgtcgtgcgcggcgctcttcgtggcctccatctcctccttcggggcggagcacaacctgacggcgatgatgtacccgctgctcatcagcgccatgggcctgctcgtgtgcgcgatcaccacggtcgtcgccaccgacgtcgccgaggtgagagagtccgacgaggtcgggccggcgctcaagcgccagatcctcatctccaccgtgctcatgaccgccggcatcgccgccgtcaccttcctcgccctgccgcccagcttcaccctcttcgacttcggcaacgacaagcacgtcaagaactggcacctgttcatctgcgtgtcggccggtctctgggccgggctggtgatcggctacgtcaccgagtacttcaccagcaacgcctacggccccgtgcaggcggtggcgcggtcgtgcaggacgggcgcggcgacgaacgtcatcttcggcctggcggtcgggtacaagtcggtgatcgtgcccatcctggccatcgcggcggcgatctacgccggcttccggctggcggccatgtacggcatcgcgctggcggcgctggggatgctgagcaccatcgccacgggtctggccatcgacgcctacggtcccatcagcgacaacgccggcgggatcgcggagatggccgggatgccgcgccgtgtccgggagcgcaccgacgcgctggacgccgcggggaacaccacggccgccatcggcaaagggttcgccatcgggtccgccgcgctggtgtcgctggcgctgttcggcgcgtacgtgagcagggccgggatcacggcggtggacgtgctgagcgcgcgcgtgttcgtggggctcctcgtcggcgccatgctcccgtactggttctcggccatgacgatgcggagcgtggggagcgccgcgctgcggatggtggaggaggtgcgcaggcagttcgaggtgatcccggggctcgccgagggcctcgccgtgccggactacgccacctgcgtcaggatctccaccgacgcctcgctcaagaagatgatggcgcccggcgcgctcgtcatgctcagcccgctcgtcgccggcacgctgttcggggtcgagacgctcgcggggctcctcgccggcgcgctcgtctccggcgtccaggtcgccatctctgcctccaacagcggcggtgcatgggacaacgccaagaagtacatcgaggccggcatgtcggaggaggcgaggtcgctggggccgaagggatcggaggcgcacaaggcggcggtgatcggagacaccatcggagacccgctaaaggacacctcaggaccgtcgctgaacatcctcatcaagctcatggccgtggagtcgctcgtcttcgcgcccttcttcgccgcgcacggcggcatcatcttcgaccacctctga

SEQ ID NO: 19257 - protein, 772 aa, Sorghum bicolor
  misc_feature: Useful for making plants with modulated water use efficiency
  misc_feature: Functional homolog of the protein sequence given in SEQ ID NO 13830
  misc_feature: Ceres ANNOT ID no. 8725130
  misc_feature (2)..(771): SWISSPROT Homolog: EC 3.6.1.1 Inorganic diphosphatase
  misc_feature (6)..(758): Pfam ID: H_PPase Pfam Description: Inorganic H+ pyrophosphatase
MAVLGTAAVEALIPVAALIGIAFAMLQWYVVARVPVPSHAGEDDGDGGGGGSKQHGHGVRGTEEDEEEDGMDYLLVEARCAEIQRAISIGATSFLLTEYKYLAAFTAAFAAVIFVFLGSAGRFSARPSPCAYDASRECRPALANAAFSAVAFLLGAATSVLSGYLGMRVATFANARTALEARHGVGRAFAAAFRSGAAMGFLLASSALLVLYAAVNLFGLYYGDDWGGLYESITGYGLGGSSVALFGRVGGGIYTKAADVGADLVGKVERNIPEDDPRNPAVIADNVGDNVGDIAGMGSDLFGSYAESSCAALFVASISSFGAEHNLTAMMYPLLISAMGLLVCAITTVVATDVAEVRESDEVGPALKRQILISTVLMTAGIAAVTFLALPPSFTLFDFGNDKHVKNWHLFICVSAGLWAGLVIGYVTEYFTSNAYGPVQAVARSCRTGAATNVIFGLAVGYKSVIVPILAIAAAIYAGFRLAAMYGIALAALGMLSTIATGLAIDAYGPISDNAGGIAEMAGMPRRVRERTDALDAAGNTTAAIGKGFAIGSAALVSLALFGAYVSRAGITAVDVLSARVFVGLLVGAMLPYWFSAMTMRSVGSAALRMVEEVRRQFEVIPGLAEGLAVPDYATCVRISTDASLKKMMAPGALVMLSPLVAGTLFGVETLAGLLAGALVSGVQVAISASNSGGAWDNAKKYIEAGMSEEARSLGPKGSEAHKAAVIGDTIGDPLKDTSGPSLNILIKLMAVESLVFAPFFAAHGGIIFDHL

SEQ ID NO: 19258 - DNA, 864 bp, Sorghum bicolor
  misc_feature: Ceres ANNOT ID no. 8725147
  misc_feature: Encodes the peptide sequence at SEQ ID NO 19259
atgcgcgccggcccgcccagcccgctcggctacggctgccgcaccatcggcttcaacggcgacgccggcgagctcgagtacctgctgctccacgccaaccccgccgccgtcgcgcacagggccaggtccatcgacactgacgacccctcgcgcttcagtaatgtggtgaacgagtatgtgggagcaatgaggcagcttgcatgtgagatcctggacctgttaggagaggggctagggctcaaggaccccagatccttcagcaagctcatcactgacacagacagcgactcactcctgaggatcaaccactaccctccagcatgcaccattcagaagcttgaccatgacaaccaatgcaagatgaagagcagtttcagaatcaagactggcaatggtgtgaaccagtcagcaggtgcacggatcggattcggggagcattcagacccgcagattcttagcttgctccgatcaaacgatgttgacggccttcaggtgcttctgaactgcgacggcagggaggtgtgggttcaggtgccatccgatccatcagcattctttgtcaatgttggtgatctcctccaggctttgacaaatgggaaggtgataagtgtccggcacagggtaattgcaaactcctgcagggcaaggctgtccacaatctacttcgctgcgccgccactgcatgcacgaattttggccctcccagagacaatcacagccaactcaccccgccagtaccggcccttcacctgggccgagtacaagaagacaatgtactccctccgcctgagccacagccgcctcaacctcttccacatcgaccatgatgaccacagcaatgtcggcaaaggagaacaagaatag

SEQ ID NO: 19259 - protein, 287 aa, Sorghum bicolor
  misc_feature: The sequence is a functional homolog of SEQ ID NO 1 in US patent 7057088
  misc_feature: Ceres ANNOT ID no. 8725147
  misc_feature (2)..(280): SWISSPROT Homolog: EC 1.14.11.13 Gibberellin 2-beta-dioxygenase
  misc_feature (95)..(225): Pfam ID: 2OG-FeII_Oxy Pfam Description: 2OG-Fe(II) oxygenase superfamily
MRAGPPSPLGYGCRTIGFNGDAGELEYLLLHANPAAVAHRARSIDTDDPSRFSNVVNEYVGAMRQLACEILDLLGEGLGLKDPRSFSKLITDTDSDSLLRINHYPPACTIQKLDHDNQCKMKSSFRIKTGNGVNQSAGARIGFGEHSDPQILSLLRSNDVDGLQVLLNCDGREVWVQVPSDPSAFFVNVGDLLQALTNGKVISVRHRVIANSCRARLSTIYFAAPPLHARILALPETITANSPRQYRPFTWAEYKKTMYSLRLSHSRLNLFHIDHDDHSNVGKGEQE

SEQ ID NO: 19260 - DNA, 468 bp, Sorghum bicolor
  misc_feature: Ceres ANNOT ID no. 8725167
  misc_feature: Encodes the peptide sequence at SEQ ID NO 19261
atgcagatcttcgtgaagaccctgacggggaagaccatcacgttggaggtggagtcctcggacaccatcgacaacgtgaaggccaagatccaggacaaggagggcatcccgccggaccagcagcgtctcatcttcgccggcaagcagctcgaggacggccgcaccctcgccgactacaacatccagaaggagtccaccctccacctggtcctccgcctccgcggtggcgccaagaagcgcaagaagaagacgtacaccaagcccaagaagatcaagcacaagcacaagaaggtgaagctcgccgtgctccagttctacaaggtggacgacgccaccggcaaggtcacccgcctccgcaaggagtgccccaacaccgagtgcggcgccggcgtctttatggccaaccacttcgaccgccactactgcggcaagtgcggcctcacctatgtctacaaccagaaggcgtaa

SEQ ID NO: 19261 - protein, 155 aa, Sorghum bicolor
  misc_feature: Useful for making plants with modulated cold sensitivity
  misc_feature: Useful for making plants with modulated flowering time
  misc_feature: Functional homolog of the protein sequence given in SEQ ID NO 14303
  misc_feature: Useful for making plants with modulated nitrogen use efficiency
  misc_feature: Functional homolog of the protein sequence given in SEQ ID NO 14348
  misc_feature: Ceres ANNOT ID no. 8725167
  misc_feature (6)..(74): Pfam ID: ubiquitin Pfam Description: Ubiquitin family
  misc_feature (101)..(148): Pfam ID: Ribosomal_S27 Pfam Description: Ribosomal protein S27a
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNTECGAGVFMANHFDRHYCGKCGLTYVYNQKA

SEQ ID NO: 19262 - DNA, 1074 bp, Sorghum bicolor
  misc_feature: Ceres ANNOT ID no. 8725171
  misc_feature: Encodes the peptide sequence at SEQ ID NO 19263
atgacgactaagcgctgctgcctgctcgtcgccacgctcctcgcggcgctgctggtctcggtcacagcccgcctcgacgtcggcttctacaacaagacgtgcccctccgccgagagcatcgtgcagcagaccgtggccgccgcgttcggcaacagctccggcgtcgctcccgcgctcatccgcatgcacttccatgactgcttcgtcagaggctgcgacggctcggtgctgatcgactccacggccaacaacacggctgagaaggattcgcccgccaacaacccgagcctcaggttcttcgacgtggtcgaccgcgccaaggcgtccctggaggcgcagtgccccggcgtggtctcttgcgccgacatcctcgccttcgcggcgagggacagcgtcgtgctcaccggtggcctcggctaccaggtgccgtccggacgccgtgacggcagggtatccaatgccacccaggccacgaacaacctgcctccgccgtttttcaatgccacccaactggtagaccgcttcgcctccaagaacctcacccttgaggacatggttgtcctctccggtgcacacaccctcggtgtctcccactgcagcagcttcgccggacctgccaacctgggcgaccggctctacaacttcagcggctcagctgacgggattgatccggcgctgagcaaagcctacgcatttctcctcaagagcatctgcccgtccaacagcagccagttcttcccgaacacgacaacgttcatggacatcatcacacccgacaagttcgacaacaagtactacgtcggcctgaccaacaacctcggcctctttgagtcggacgctgcgctgctaaccaacgcaaccatgaaggcgctggtggactcctttgtgcgcaacgagaccacatggaagaggaagtttgccaagtccatggtcaagatggggaagatcgaggtgctcaccgggacgcagggcgagatcaggcgcaactgcagggttatcaaccctgctagcgccaccgatgttcttgccagtcagtcaggttcttcaggattcactggagtggctgcaagttaa

SEQ ID NO: 19263 - protein, 357 aa, Sorghum bicolor
  misc_feature: Useful for making plants with altered cell wall content and/or composition
  misc_feature: Functional homolog of the protein sequence given in SEQ ID NO 14262
  misc_feature: Useful for making plants with modulated phosphate use efficiency
  misc_feature: Functional homolog of the protein sequence given in SEQ ID NO 13134
  misc_feature: Useful for making plants with altered carbohydrate content
  misc_feature: Functional homolog of the protein sequence given in SEQ ID NO 13757
  misc_feature: Ceres ANNOT ID no. 8725171
  misc_feature (27)..(334): SWISSPROT Homolog: EC 1.11.1.7 Peroxidase
  misc_feature (41)..(298): Pfam ID: peroxidase Pfam Description: Peroxidase
MTTKRCCLLVATLLAALLVSVTARLDVGFYNKTCPSAESIVQQTVAAAFGNSSGVAPALIRMHFHDCFVRGCDGSVLIDSTANNTAEKDSPANNPSLRFFDVVDRAKASLEAQCPGVVSCADILAFAARDSVVLTGGLGYQVPSGRRDGRVSNATQATNNLPPPFFNATQLVDRFASKNLTLEDMVVLSGAHTLGVSHCSSFAGPANLGDRLYNFSGSADGIDPALSKAYAFLLKSICPSNSSQFFPNTTTFMDIITPDKFDNKYYVGLTNNLGLFESDAALLTNATMKALVDSFVRNETTWKRKFAKSMVKMGKIEVLTGTQGEIRRNCRVINPASATDVLASQSGSSGFTGVAAS

SEQ ID NO: 19264 - DNA, 1068 bp, Sorghum bicolor
  misc_feature: Ceres ANNOT ID no. 8725174
  misc_feature: Encodes the peptide sequence at SEQ ID NO 19265
atgaagcgccgcttcttacggttcgccaccgtcctggcgtcgctcctctcggccaccgcctgcctcgacgtcggcttctacgaccagacgtgccccaccgccgagaccgtcgtgcagcagaccgtggccgccgcgttcaccaacaactccggcgtcgctccggcactcatccgcatgcactttcatgactgctttgtcaggggctgcgacggctcggtgctgatcgactccacggcgaacaacacggcggagaaggacgcgccacccaacaacccgagcctccggttcttcgacgtggtcgacagcgccaaggcggcgctggaggcgcagtgccccggcgtggtctcctgcgccgacgtcctcgccttcgcggcgagggacagcgtcgtgctctccggcggcctcggctaccaggtgcccgccggacgccgtgacggcctgatatccactgccactgaggccctcaacaacctgcctccgccgttcttcaacgccacccaactggcagccagcttcgcctccaagaacctcaccgttgaggacctcgtcgtgctctccggcgcccacaccctcggtgtctcccattgcagcagcttcgccggagttggcaacctgggcgaccgtctctacaacttcagcggctcatctgacgggactgacccggcactgagcaaagcctacgcatttctgctcaagagcatctgcccgtccaacagcagccagttcttccccaacacgacgacgttcatggacctcatcacgccggaaaagttcgacaacaagtactacgtcggcctgacaaacaacctggggctcttcaaatcagatgtggcgctgctgaccaacgcaacgatgaaggcgctggtcgactccttcgtgcgcagcgaggcgactttcaggaccaagttcgccaggtccatgctcaagatggggcagatcgaggtgctgaccgggacgcagggagagatcaggctcaattgcagggtcatcaaccctgctaatgctgctgctgatgttcttgccgatcaatcgggttcttcaggattcactggagtggctgcaagctaa

SEQ ID NO: 19265 - protein, 355 aa, Sorghum bicolor
  misc_feature: Useful for making plants with altered carbohydrate content
  misc_feature: Functional homolog of the protein sequence given in SEQ ID NO 13714
  misc_feature: Useful for making plants with altered cell wall content and/or composition
  misc_feature: Functional homolog of the protein sequence given in SEQ ID NO 13825
  misc_feature: Ceres ANNOT ID no. 8725174
  misc_feature (24)..(331): SWISSPROT Homolog: EC 1.11.1.7 Peroxidase
  misc_feature (38)..(295): Pfam ID: peroxidase Pfam Description: Peroxidase
MKRRFLRFATVLASLLSATACLDVGFYDQTCPTAETVVQQTVAAAFTNNSGVAPALIRMHFHDCFVRGCDGSVLIDSTANNTAEKDAPPNNPSLRFFDVVDSAKAALEAQCPGVVSCADVLAFAARDSVVLSGGLGYQVPAGRRDGLISTATEALNNLPPPFFNATQLAASFASKNLTVEDLVVLSGAHTLGVSHCSSFAGVGNLGDRLYNFSGSSDGTDPALSKAYAFLLKSICPSNSSQFFPNTTTFMDLITPEKFDNKYYVGLTNNLGLFKSDVALLTNATMKALVDSFVRSEATFRTKFARSMLKMGQIEVLTGTQGEIRLNCRVINPANAAADVLADQSGSSGFTGVAAS

SEQ ID NO: 19266 - DNA, 1257 bp, Sorghum bicolor
  misc_feature: Ceres ANNOT ID no. 8725185
  misc_feature: Encodes the peptide sequence at SEQ ID NO 19267
atggacctgcggcggcggcggctggcgctggctgtgttggcggcggtggccatgtgcgccgccacactgacggcggtggtggaggggttcgacatcctggagatcctggggaagcacgacgagttctcgcagttctgcaagctgctcaacgagacgcacctcgccggggacatcaaccgcgaccggaccatcaccgtgctcgccgtcgccaacggcgacatgggccacctcaccggcggccactactcgctcggcacgctccgtcacatcctcgagctccacgtcgtcgccgactactacgacgataagaagctcaagcagctgtcgcacgccgccaccgccgcatccaccatgttccagcgatccggatttgcccccggcatggcaggatacgtgaacataacgcagcaccgcggcggcaaggtgtcgttcatcgtggatgacgcagcggacagcgtgaagcccgtcacctacgtgaagcagatcgagagccaccggtacgactactcggtgctccaggtgagcggcgtgctgtcgtcgccggaggcggaggcgcccgtggccccgccggcgcccgtcaacctcaccgacatcctctccaagaagtactgcaagagcttcgcggcgctgctggccgccgacgccaaggtgttcgacgccatcaatggcaccaaggacacggcgctgaccgtcttctgccccgtcgacgcggcggtggcggcattcatgcccaagttcaagaacctgacggcgaaggcgaagacagccatcctgctgtaccatgccatcccggactactactccatgcagttcctcaagtccaacaagggcaaggtcaccacgctcgccaccaccaacaccaacaagaaggactacacgtatgaggccgagagcaaggatgacacggtcacgctcgacaccaccgtcgtcacctccaccatccaggccaccgtcagggacgacgacccacttgccgtctatgctgtgtccaagttcctgcagcctaaggagctgttcaaggcgaagacggcagaccttgcgcctgcgcctgctccggaagggccaaagaagaagaagaagaagaagcccgccagcggctctgcagccgctgcgccttcggacgatgactctgcagatggcccgtctgccgacgactcatccgatgacgccgccgacaaggccgccgctgcgccggcgtccctgtttgcccggtgggtgacgatcgccgtggcgctggcgctggcgttggcagcctaa

SEQ ID NO: 19267 - protein, 418 aa, Sorghum bicolor
  misc_feature: Useful for making plants with altered carbohydrate content
  misc_feature: Functional homolog of the protein sequence given in SEQ ID NO 14300
  misc_feature: Ceres ANNOT ID no. 8725185
  misc_feature (203)..(335): Pfam ID: Fasciclin Pfam Description: Fasciclin domain
MDLRRRRLALAVLAAVAMCAATLTAVVEGFDILEILGKHDEFSQFCKLLNETHLAGDINRDRTITVLAVANGDMGHLTGGHYSLGTLRHILELHVVADYYDDKKLKQLSHAATAASTMFQRSGFAPGMAGYVNITQHRGGKVSFIVDDAADSVKPVTYVKQIESHRYDYSVLQVSGVLSSPEAEAPVAPPAPVNLTDILSKKYCKSFAALLAADAKVFDAINGTKDTALTVFCPVDAAVAAFMPKFKNLTAKAKTAILLYHAIPDYYSMQFLKSNKGKVTTLATTNTNKKDYTYEAESKDDTVTLDTTVVTSTIQATVRDDDPLAVYAVSKFLQPKELFKAKTADLAPAPAPEGPKKKKKKKPASGSAAAAPSDDDSADGPSADDSSDDAADKAAAAPASLFARWVTIAVALALALAA

SEQ ID NO: 19268 - DNA, 2508 bp, Sorghum bicolor
  misc_feature: Ceres ANNOT ID no. 8725181
  misc_feature: Encodes the peptide sequence at SEQ ID NO 19269
atggatagcacagctgttgggctcaagctggttgtgctagccctttctgtggccatctgggtgtttggcgcttgcaatgccaatttcaccccagcagacaattacctcatcaactgcggttccacggtcgacgcaaccatcgaccagagggttttcctggccgacacttccgggccggccatactgacgacacccaccaatctgagcaccgccgcgaccacctcaccgaattcggtctcagggttcgacggcgctatgctgtatcagactgctaggatattccccgcggcatcgtcctatgccttcaagctcaagagccgtggccggcattttgtccgccttcatttcttcccattcaaataccagagctatgatctcaccacggcaaccttcaaggtgtccacggaggatgttgtgctcctggacaatttcactgtgccaagtagttcttcgccggtgttcaaggagtattccctgaacattaccagggacatgctcatcctgacatttgtgcctcttgggaacaacacgccggccttcgtcaatgctatcgaggtcatctctgtccctgatgatctcataactgattcggcactgaatctggaacctgtcggtcagtatctcgggctgtcaacacagccgctgcagacattctacaggatcaatgtggggggaccgaaggtgactcctgagaatgacacgctctggcggacatgggttactgatcagagctccttcttaaattccactcccactacacttcacactttctcaggaaagctgaatttccagaacggattggcaacagaggaggatgcaccggacagtgtctacaatactgcgaggcggttgctaaatactactggctccatgtccaatatgacatggcaatttgatgtcgatggccgttcaagctatctcgttcggttccatttctgtgacattgtgagcaaggccctttatcagctcttgtttgatgtatatctggatagctggtcggtgatgaaaaatctagatctctctgagaaagcattcggcaacttggctgcgccattttacattgatgctgtcttgctatcaagtgatccatctggtaagctcagtgtcagcattgggccttctgccgtacagatagcagcgccggatggtatcctgaatggactggagatcatgaagatgaacatcagtacagggtctgtttccgttgtgaaaccatcactagggggaaagagtcatctcggtgtcatattgggttctgtactcggagttttggctgctatcgtcattgctattgttatctgcatcttcttcaggagaaaaaacaagccgcatccaccaccaagtcggacctcaagttcttggacacccctcaatggtcttagcttccttaccacaggcagccgaaccagccggacgactctgacatctggaacttcgggtgacacgagctaccgaatcccttttgttgtgctgcaagatgcgacaaatcactttgatgagcagatggtcattggagttggaggctttgggaaggtctacaaagcagtgatgcaggatggaagcaaacttgcagtaaagcggggcaaccagaagtctcaccaagggctgagggagttccggacggagatcgaactgctgtcaggactgcgacaccgtcatctcgtgtcgctcattggttactgtgatgaacacaatgagatgatcttggtgtatgaatacatggagaaaggaactctgaagagccatctgtatggcggtgatatgccgcctctcagctggaagaaaagactggaaatctgcattggagcagcaagagggctccactaccttcacactggttttgccaagtcaatcatacaccgtgatgtcaagtcagcaaacatcctcctcgatgaaaatctcttggccaaggtttctgattttggcctgtcaaaggttgggcctgaattcgaccagacgcatgtcagcacagcagtgaaagggagcttcggataccttgatcctgagtacttccggagacagaagctgactgacaaatcagacgtgtactcttttggtgtggtgctgcttgaggtgatctgtgcgaggccggttattgacccgactcttccaagggacatgattaaccttgcggagtgggctatcaagtggcaaaagaggggagagcttgatcagattgttgaccagcgcatcgctgggacagtcaggcctgaagcactgaggaagtttggagagacagtggagaaatgccttgcagagtatggtgtcgagcgtcctacaatgggtgatgtgctgtggaacctggagtttgtgctgcagctacaggaggcaggtccagacatgtccaacatcgacagtatgaatcagatctctgaactcccttcaaatgcaaacagagtaagctccttggatatcagcactacagatcaaagccgtatgccgattgagtactccgacatgtcgacaagtaacgccttctcgcagctaatcaatgcagaaggaaggtga

SEQ ID NO: 19269 - protein, 835 aa, Sorghum bicolor
  misc_feature: Useful for making plants with modulated biotic stress sensitivity
  misc_feature: Functional homolog of the protein sequence given in SEQ ID NO 14099
  misc_feature: Ceres ANNOT ID no. 8725181
  misc_feature: Up-regulated in shoot tissues in response to salicylic acid treatment
  misc_feature (487)..(787): SWISSPROT Homolog: EC 2.7.11.1 Non-specific serine/threonine protein kinase
  misc_feature (498)..(771): Pfam ID: Pkinase Pfam Description: Protein kinase domain
MDSTAVGLKLVVLALSVAIWVFGACNANFTPADNYLINCGSTVDATIDQRVFLADTSGPAILTTPTNLSTAATTSPNSVSGFDGAMLYQTARIFPAASSYAFKLKSRGRHFVRLHFFPFKYQSYDLTTATFKVSTEDVVLLDNFTVPSSSSPVFKEYSLNITRDMLILTFVPLGNNTPAFVNAIEVISVPDDLITDSALNLEPVGQYLGLSTQPLQTFYRINVGGPKVTPENDTLWRTWVTDQSSFLNSTPTTLHTFSGKLNFQNGLATEEDAPDSVYNTARRLLNTTGSMSNMTWQFDVDGRSSYLVRFHFCDIVSKALYQLLFDVYLDSWSVMKNLDLSEKAFGNLAAPFYIDAVLLSSDPSGKLSVSIGPSAVQIAAPDGILNGLEIMKMNISTGSVSVVKPSLGGKSHLGVILGSVLGVLAAIVIAIVICIFFRRKNKPHPPPSRTSSSWTPLNGLSFLTTGSRTSRTTLTSGTSGDTSYRIPFVVLQDATNHFDEQMVIGVGGFGKVYKAVMQDGSKLAVKRGNQKSHQGLREFRTEIELLSGLRHRHLVSLIGYCDEHNEMILVYEYMEKGTLKSHLYGGDMPPLSWKKRLEICIGAARGLHYLHTGFAKSIIHRDVKSANILLDENLLAKVSDFGLSKVGPEFDQTHVSTAVKGSFGYLDPEYFRRQKLTDKSDVYSFGVVLLEVICARPVIDPTLPRDMINLAEWAIKWQKRGELDQIVDQRIAGTVRPEALRKFGETVEKCLAEYGVERPTMGDVLWNLEFVLQLQEAGPDMSNIDSMNQISELPSNANRVSSLDISTTDQSRMPIEYSDMSTSNAFSQLINAEGR

SEQ ID NO: 19270 - DNA, 666 bp, Sorghum bicolor
  misc_feature: Ceres ANNOT ID no. 8725266
  misc_feature: Up-regulated in shoot tissues in response to salicylic acid treatment
  misc_feature: Encodes the peptide sequence at SEQ ID NO 19271
atgacggcggcggcacggaggagctgcagctcgccggtgggggcgggtgctgtcgcaggcgccgggccagggtcagcgctgaacacaatcacgccgtgcgcggcttgcaagctgctccggcgacggtgcgcgcaggagtgccccttctcgccctacttctcgccgctggagccgcacaagttcgccgccgtccacaaggtcttcggcgccagcaacgtctccaagatgctcctggaggtgcacgagagccagcgcgccgacacggcgaacagcctggtgtacgaggcgaacctgcggctccgggaccccgtctacggctgcatgggcgccatcctcacgctgcagcagcaggtgcaagcgctggaggccgagctcgccaccgtcagggccgagatcgtcaggcacaggtgccgtccggcggcggtgctcccctcgtcgcacgcctcccagctcctcgcggcctcggcagccggccgcgggctgcacgccggcagcaggccatcggtaggggctagagcggcaactttggcggcggcggcggctgctgccgccgtggggcctgtggcctcgtcctcgtcgtcatcggcggtgtacgccgccgccgccgcgtcgagctcaacggactatagctccatcaccaatgagaatgttccttactttggttga

SEQ ID NO: 19271 - protein, 221 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 14583
  misc_feature: Ceres ANNOT ID no. 8725266
MTAAARRSCSSPVGAGAVAGAGPGSALNTITPCAACKLLRRRCAQECPFSPYFSPLEPHKFAAVHKVFGASNVSKMLLEVHESQRADTANSLVYEANLRLRDPVYGCMGAILTLQQQVQALEAELATVRAEIVRHRCRPAAVLPSSHASQLLAASAAGRGLHAGSRPSVGARAATLAAAAAAAAVGPVASSSSSSAVYAAAAASSSTDYSSITNENVPYFG

SEQ ID NO: 19272 - DNA, 666 bp, Sorghum bicolor
  misc_feature: Ceres ANNOT ID no. 8725281
  misc_feature: Encodes the peptide sequence at SEQ ID NO 19273
atgggcgttgccatggccatcaggacggtggtgttgctccccgccgtgctcacgctcctctccttcctcctcctacccttggcctccctggcgctgacgcaggacttctgcgtggccgacctgacctgcagcgacacgccggcggggtacccgtgcaagtccagcgtcaccgccaacgacttctactaccacggcctggccgggcagggcaagatcaacccgctgatcaaggcggccgtgacgccggcgttcgtcggccagttcccgggcgtcaacgggctcggcatctccgcggcgaggctcgacatcgaggtgggcggcgtggtgccgctgcacacccacccggcgggctccgagctcctcttcgtgacccagggcaccgtcgccgccggcttcatcagctccggctccaacaccgtctacaccaagacgctgtacgccggcgacgtcatggtgttcccgcagggactgctccactaccagtacaacgccggcaccggccccgccgtcggcctcgtcgccttcagcagctccaaccccggcctccagatcaccgactttgccctctttgccaacaacctcccgtccgccgtcgtggagaaggtcaccttcttggacgacgcgcaggtcaagaagctcaagagtgtgctcggcggcagcggttaa

SEQ ID NO: 19273 - protein, 221 aa, Sorghum bicolor
  misc_feature: Useful for making plants with modulated nitrogen use efficiency
  misc_feature: Functional homolog of the protein sequence given in SEQ ID NO 14675
  misc_feature: Ceres ANNOT ID no. 8725281
  misc_feature (34)..(215): SWISSPROT Homolog: EC 1.15.1.1 Superoxide dismutase
  misc_feature (64)..(211): Pfam ID: Cupin_1 Pfam Description: Cupin
MGVAMAIRTVVLLPAVLTLLSFLLLPLASLALTQDFCVADLTCSDTPAGYPCKSSVTANDFYYHGLAGQGKINPLIKAAVTPAFVGQFPGVNGLGISAARLDIEVGGVVPLHTHPAGSELLFVTQGTVAAGFISSGSNTVYTKTLYAGDVMVFPQGLLHYQYNAGTGPAVGLVAFSSSNPGLQITDFALFANNLPSAVVEKVTFLDDAQVKKLKSVLGGSG

SEQ ID NO: 19274 - DNA, 504 bp, Sorghum bicolor
  misc_feature: Ceres ANNOT ID no. 8725282
  misc_feature: Encodes the peptide sequence at SEQ ID NO 19275
atggctcattccaacagcgcggccgccactgcccttgcgccagcgcggaaggtggcgctgatcacgagcatcacggggctgctcctatccaagaggtacgaggtgctggaccacatccgccgctcctccaacttcaacacgcagcgactggaccacatctaccacgacctgcacgcggtgtcgtcgtcgccgcggtccccgatgcggctccactacgctgacctctccgactcctcgtccctccgctgcgcgctcgacgccattggccccgacgaggtctacaacctcgccgcgcagtcgcacgtcgccatctccttcgaggtccccgactacaccgccgacgtcaccgccacgagggcgctccacctgctcgaggtcgtccgcctctcgtgcaactccacgccgccaccgcagagcgaggacacacccttccacccgcgctccccctacgccgctgccaaggtcgtcgtgcactggtacaccgtcaactaccggcggcgctag

SEQ ID NO: 19275 - protein, 167 aa, Sorghum bicolor
  misc_feature: Useful for making plants with altered carbohydrate content
  misc_feature: Functional homolog of the protein sequence given in SEQ ID NO 13802
  misc_feature: Useful for making plants with altered cell wall content and/or composition
  misc_feature: Functional homolog of the protein sequence given in SEQ ID NO 13803
  misc_feature: Ceres ANNOT ID no. 8725282
  misc_feature (24)..(128): SWISSPROT Homolog: EC 4.2.1.47 GDP-mannose 4,6-dehydratase
  misc_feature (19)..(167): Pfam ID: Epimerase Pfam Description: NAD dependent epimerase/dehydratase family
MAHSNSAAATALAPARKVALITSITGLLLSKRYEVLDHIRRSSNFNTQRLDHIYHDLHAVSSSPRSPMRLHYADLSDSSSLRCALDAIGPDEVYNLAAQSHVAISFEVPDYTADVTATRALHLLEVVRLSCNSTPPPQSEDTPFHPRSPYAAAKVVVHWYTVNYRRR

SEQ ID NO: 19276 - DNA, 1290 bp, Sorghum bicolor
  misc_feature: Ceres ANNOT ID no. 8725326
  misc_feature: Encodes the peptide sequence at SEQ ID NO 19277
atggccgcttcttgctcctgctttgttcccttcctcctcctcctcctcgcctcggcctcggccttgacgacgacggagcggcgcggcaataatggcacgcggcggccggcgttcagctcggaggaggagctccgcgggttccggagcatcacggccaggcttgccaggctcagggacgcgtccagtcccgacggcgatgtcatcgactgcgtgccggcgcacctgcagccggcgttcgagcatcccaagctgaggggccagaagccagagagcgagcctgcggagaggccgaggagcagcagtggcagtttctccaacgctgctgatcgaggcgaggacgacgatgacgacgacccgttgccgcaggcgtggcggcggtccggcgagtcgtgcccggatgggacggtgccggtgcggcggacgacggaggacgacgtgctcagggccagctcttcctccgccacccgcttcgggatgaaggcccgtggcggcgtgttcgcgcggcgcgactccaccggcggcggccacgagcacgcggtggggtacgtgaccggcgggcagttctacggcgccaaggcgagcctgaacgtgtggccggcgcaggtggcgtcgccggcggagttcagcctgtcgcagatctgggtcatctccggcgccttcggccacgacctcaacaccatcgaggccggctggcaggtcagccctcagctctacggcgataacagccccaggttcttcacctactggactgacgacgcgtacaaggagacggggtgctacaacctgcactgctcggggttcgtgcagacgagcagccgcgtggcgatcggcgccgccatctcgcccatctccacctacgccggccgccagttcgacatcacggtgctcatctggaaggacccgcgcaggggccactggtggctgcagctcggctccggcggatccgccggcgggctcgtcgggtactggccctccgcgctcttcacgcacctcggctcccgcgccgacatggtgcagttcggcggcgaggtcgtcaacgcgcgccccgccggcgcgccgcacacgcccacgcagatggggtccggcaggttccccgccgaagggtacgcccgcgccgcctacttccgcaacgtccaggtcgtcgactgggataatagcctcgtcccggcggctgggctccggctgctcgccgaccgaccggggtgctatgacatcgccggcggcagcggcggcgcatggggcacctacttctattacggtgggcccggcaggaacgcacggtgcccgtag

SEQ ID NO: 19277 - protein, 429 aa, Sorghum bicolor
  misc_feature: Useful for biocontainment applications
  misc_feature: Functional homolog of the protein sequence given in SEQ ID NO 14085
  misc_feature: Ceres ANNOT ID no. 8725326
MAASCSCFVPFLLLLLASASALTTTERRGNNGTRRPAFSSEEELRGFRSITARLARLRDASSPDGDVIDCVPAHLQPAFEHPKLRGQKPESEPAERPRSSSGSFSNAADRGEDDDDDDPLPQAWRRSGESCPDGTVPVRRTTEDDVLRASSSSATRFGMKARGGVFARRDSTGGGHEHAVGYVTGGQFYGAKASLNVWPAQVASPAEFSLSQIWVISGAFGHDLNTIEAGWQVSPQLYGDNSPRFFTYWTDDAYKETGCYNLHCSGFVQTSSRVAIGAAISPISTYAGRQFDITVLIWKDPRRGHWWLQLGSGGSAGGLVGYWPSALFTHLGSRADMVQFGGEVVNARPAGAPHTPTQMGSGRFPAEGYARAAYFRNVQVVDWDNSLVPAAGLRLLADRPGCYDIAGGSGGAWGTYFYYGGPGRNARCP

SEQ ID NO: 19278 - DNA, 990 bp, Sorghum bicolor
  misc_feature: Ceres ANNOT ID no. 8725366
  misc_feature: Encodes the peptide sequence at SEQ ID NO 19279
atggcagcgaggtgggtttcagttcagcatgacccaaaaggttgtcttggccatctgaagcagtacaagtttaaggagatcagaaaggctaccaataacttcagccaaaaaaatattttgggagagggaggatatggaatagtatacaagggtgatttggatggcacaactgttgctgttaaaagactgaaggatcgtgattcagttattggggatggtcaattccacacagaaattgaagtgataagcttggctgtccatcgtaatctccttcaccttactgggttttgcattgcaaataatgaaaggcttcttgtgtatccctacatgccaaatggaactgtcgcttctaaattaaaagaatgtgttaatggggaaccaaccttagactggccaaggagaaagaggatagcccttggtgcgtcgcagggactgctttatttgcatgaacaatgtgatcctaagataatccatcgtgatatcaaggcctgcaatgttctgctggatgaatatcttgaagcagttgttgcggattttggattggcaaaacttctagatcattggatgtcccatgttatcacatcagtgcgtggaacacttgggcgcataccaccagagtatttaaagtctggccacacttcggagaagactgatgtcttttgctttggactctttttgatggaattagtcactggtcgagtgacgctggagcttcatgagaatgaatacgagaagggaggaattcgtgaattgattgctttgctctgcacaatgtacagaccttgccaccgtcccaagatgtctgaaattgttaacatgctagaaggaggagatagggttgcggagaaatgggaggccgtaaaaaatattgaggacccaaaccccgattggtcatctgaatttatgtgcattggcataaattataatgatgatgaccaacgcaataattcaatcgaactacaagccattgaactctcagggccaaggtga

SEQ ID NO: 19279 - protein, 329 aa, Sorghum bicolor
  misc_feature: Useful for making plants with modulated nitrogen use efficiency
  misc_feature: Functional homolog of the protein sequence given in SEQ ID NO 14533
  misc_feature: Useful for making plants with altered carbohydrate content
  misc_feature: Functional homolog of the protein sequence given in SEQ ID NO 14218
  misc_feature: Ceres ANNOT ID no. 8725366
  misc_feature (6)..(238): SWISSPROT Homolog: EC 2.7.11.1 Non-specific serine/threonine protein kinase
  misc_feature (34)..(274): Pfam ID: Pkinase_Tyr Pfam Description: Protein tyrosine kinase
MAARWVSVQHDPKGCLGHLKQYKFKEIRKATNNFSQKNILGEGGYGIVYKGDLDGTTVAVKRLKDRDSVIGDGQFHTEIEVISLAVHRNLLHLTGFCIANNERLLVYPYMPNGTVASKLKECVNGEPTLDWPRRKRIALGASQGLLYLHEQCDPKIIHRDIKACNVLLDEYLEAVVADFGLAKLLDHWMSHVITSVRGTLGRIPPEYLKSGHTSEKTDVFCFGLFLMELVTGRVTLELHENEYEKGGIRELIALLCTMYRPCHRPKMSEIVNMLEGGDRVAEKWEAVKNIEDPNPDWSSEFMCIGINYNDDDQRNNSIELQAIELSGPR

SEQ ID NO: 19280 - DNA, 2217 bp, Sorghum bicolor
  misc_feature: Ceres ANNOT ID no. 8725375
  misc_feature: Encodes the peptide sequence at SEQ ID NO 19281
atggccgcgcactccgtcgccgccgcgcacgccaccatatccgcgcgcgcggtcgccgcgcacggcgccggagtgtcggccccgggcgagcgcctcggcttcctccgcctgagctcaccggtcgccggccgcggccagctgcgctccccgctcccggcccgccgccagcgcgtcgtgcgcgccgccgccgccgccgagacggtcgaggggaacaaggccgccaccggcgagctgctggagaagtcggtcaacacgatccggttcctggccatcgacgccgtcgagaaggccaactccgggcacccgggcctccccatgggctgcgcgcccgtgggccacgtcctctacgacgaggtcatgcgctacaaccccaagaacccttactggttcaaccgcgaccgcttcgtcctctctgccggccacggctgcatgctccagtacgccctgctccacttagccggctacgacagcgtcaaggaggaggacttgaagcagttcaggcaatggggaagcagcacacctggccaccctgagaactttgagactccaggagttgaagttaccactggacctcttggtcagggtgtcgccaatgctgttgggttggcacttgctgagaagcacctggctgcccgcttcaacaagcctgacagtgagattgtcgaccactacacgtacgttattttgggagatggttgccaaatggagggtgttgccaatgaagcttgctccttggctgggcactggggtcttggcaagctgattgctttctacgatgacaaccacatttccattgatggagatacagagattgcattcacagaggacgtgagcacccgctttgaggctcttgggtggcacacaatctgggttaagagtgggaacactggctatgatgacatccgtgcagctattaaggaagcaaaggcggttaccgacaagcccaccttaatcaaggtgacaaccacaatcggttttggatcacccaataaggccaactcatacagtgtgcatggaagtgcattgggtgccaaagaggtcgaagcaaccaggcagaaccttggatggccctatgagccattctttgtaccagaggatgtcaagagccattggagccgccacacgccacaaggtgctgcacttgaggctgattggaatgccaaatttgcagagtacgagaagaagtatgcagaggatgcagcaactttgaaaagtctcatcacaggggagttccccactggctgggctgatgctcttccgaaatacactccagagagcccagccgatgccaccaggaacctctcccagcagtgcttgaatgcacttactaatgttgtgcctggtcttattggaggtagtgctgatcttgcgtcctccaacatgaccctgcttaagatgtttggtgacttccagaaggatacgcctgaagagcgcaatgtccgttttggagtcagagagcacggaatgggcgccattgcgaatggcattgctctgcacagcccagggtttgttccatactgtgctactttctttgtcttcactgattacatgagaggtgccatgagaatctcagctttgtctgaagccggagttatctatgttatgacccacgactctattggtctcggagaggatggcccgacccatcagcccattgagcacttggtgagtttccgcgcaatgccgaacatattgatgcttcgccctgctgatggtaatgagactgctggagcatacaaagttgcagttctcaacaggaagaggccatctattcttgctctctcaaggcaaaagcttcctcatctgcctggcacctcaattgagggtgttgagaagggtggatataccatctctgacaattcaacaggcaacaagcctgatctcatcgtgttgagtaccggctctgaactagagattgctgccaaggctgctgatgagttgaggaaggaggggaagactatccgtgttgtatcatttgtttcctgggaactttttgaggaacagtcagacgaatacaaggagagtgttcttcctgaggccgttactgcaagaatcagcattgaggctggttctactctcggatggcaaaagtacattggagcccagggcaaggccattggcatcgacaaattcggtgcaagtgctcctgctggaaagatctacaaggagtatggcatcactgtggagggtgttattgcggcagccaaaagcttctaa

SEQ ID NO: 19281 - protein, 738 aa, Sorghum bicolor
  misc_feature: Useful for making plants with modulated biomass
  misc_feature: Functional homolog of the protein sequence given in SEQ ID NO 13642
  misc_feature: Ceres ANNOT ID no. 8725375
  misc_feature (66)..(738): SWISSPROT Homolog: EC 2.2.1.1 Transketolase
  misc_feature (78)..(412): Pfam ID: Transketolase_N Pfam Description: Transketolase, thiamine diphosphate binding domain
  misc_feature (427)..(602): Pfam ID: Transket_pyr Pfam Description: Transketolase, pyrimidine binding domain
  misc_feature (614)..(731): Pfam ID: Transketolase_C Pfam Description: Transketolase, C-terminal domain
MAAHSVAAAHATISARAVAAHGAGVSAPGERLGFLRLSSPVAGRGQLRSPLPARRQRVVRAAAAAETVEGNKAATGELLEKSVNTIRFLAIDAVEKANSGHPGLPMGCAPVGHVLYDEVMRYNPKNPYWFNRDRFVLSAGHGCMLQYALLHLAGYDSVKEEDLKQFRQWGSSTPGHPENFETPGVEVTTGPLGQGVANAVGLALAEKHLAARFNKPDSEIVDHYTYVILGDGCQMEGVANEACSLAGHWGLGKLIAFYDDNHISIDGDTEIAFTEDVSTRFEALGWHTIWVKSGNTGYDDIRAAIKEAKAVTDKPTLIKVTTTIGFGSPNKANSYSVHGSALGAKEVEATRQNLGWPYEPFFVPEDVKSHWSRHTPQGAALEADWNAKFAEYEKKYAEDAATLKSLITGEFPTGWADALPKYTPESPADATRNLSQQCLNALTNVVPGLIGGSADLASSNMTLLKMFGDFQKDTPEERNVRFGVREHGMGAIANGIALHSPGFVPYCATFFVFTDYMRGAMRISALSEAGVIYVMTHDSIGLGEDGPTHQPIEHLVSFRAMPNILMLRPADGNETAGAYKVAVLNRKRPSILALSRQKLPHLPGTSIEGVEKGGYTISDNSTGNKPDLIVLSTGSELEIAAKAADELRKEGKTIRVVSFVSWELFEEQSDEYKESVLPEAVTARISIEAGSTLGWQKYIGAQGKAIGIDKFGASAPAGKIYKEYGITVEGVIAAAKSF

SEQ ID NO: 19282 - DNA, 390 bp, Sorghum bicolor
  misc_feature: Ceres ANNOT ID no. 8725386
  misc_feature: Encodes the peptide sequence at SEQ ID NO 19283
atggcggcgcaggcgggcggagacgcgcagcagcagcagcagcaggccgtcggcgggaaccggattcaggtgtccagctccaagaagccgctattcttctacgtcaatctcgctaagaagtacatgcagcagcacggcgacgtcgagctttccgcgctcgggctggccatatcaacggttgtaaccattgcagagatactgaagaacaatggtcttgctgtcgagaagaagattagaacatccacggttgaaatcattgacgaaacgaaagcccgaccaatccaaaaggctaagattgagatagtgctgggaaagactgataagtttgaggaattgatggcggccaatgttggagatgcaaacgcaggagatggcgaggaacaaacctag

SEQ ID NO: 19283 - protein, 129 aa, Sorghum bicolor
  misc_feature: Useful for making plants with modulated nitrogen use efficiency
  misc_feature: Functional homolog of the protein sequence given in SEQ ID NO 13593
  misc_feature: Ceres ANNOT ID no. 8725386
  misc_feature (18)..(87): Pfam ID: Alba Pfam Description: Alba
MAAQAGGDAQQQQQQAVGGNRIQVSSSKKPLFFYVNLAKKYMQQHGDVELSALGLAISTVVTIAEILKNNGLAVEKKIRTSTVEIIDETKARPIQKAKIEIVLGKTDKFEELMAANVGDANAGDGEEQT

SEQ ID NO: 19284 - DNA, 609 bp, Sorghum bicolor
  misc_feature: Ceres ANNOT ID no. 8725419
  misc_feature: Encodes the peptide sequence at SEQ ID NO 19285
atgtcggaaggcccggcgcggagctccacggcggagtcgtcctcctccgcggcgtcctcgtcggggctcgacttcgaggacaccgcgctcgccctcacgctccgcctcccgggctccgactccgacgtccgcaagcgcgccgcctccacctccaccccagtcgccggccgctgctccccgcgggcctctgcctccaacgaggcaccgcccgcccccaaggcgcaggtggtggggtggccgccggtgagccggaaccggcggaacgccgcgctccccagcagggggaagttcgtcaaggtggccgtggccggcgcgccgtaccagcgcaaggtggacctcgaggcctacgcgggctacgaccagctgctcgccgcgctccaggacaagttcacctcccacttcaccgtccgccgccgggtggggaacgacgagatggcgctcgtcgacgtcgtcagcggggcagagtacgtgcccacgtacgaggacaaggacggcgactggatgctcgtcggggacgtcccctggagaatgtttgtggaaacctgccagcgtctccgtctgatgaaaagctctgaggtggttaacttagcaccaagagctgctgaatga

SEQ ID NO: 19285 - protein, 202 aa, Sorghum bicolor
  misc_feature: The sequence is a functional homolog of SEQ ID NO 738 in the 10/374,780 US patent application
  misc_feature: The sequence is a functional homolog of SEQ ID NO 736 in the 10/374,780 US patent application
  misc_feature: The sequence is a functional homolog of SEQ ID NO 739 in the 10/374,780 US patent application
  misc_feature: The sequence is a functional homolog of SEQ ID NO 2006 in the 10/374,780 US patent application
  misc_feature: The sequence is a functional homolog of SEQ ID NO 288 in the 10/412,699 US patent application
  misc_feature: The sequence is a functional homolog of SEQ ID NO 664 in the 11/479,226 US patent application
  misc_feature: The sequence is a functional homolog of SEQ ID NO 890 in the 10/412,699 US patent application
  misc_feature: The sequence is a functional homolog of SEQ ID NO 2004 in the 10/374,780 US patent application
  misc_feature: The sequence is a functional homolog of SEQ ID NO 660 in the 11/479,226 US patent application
  misc_feature: Useful for making plants with modulated nitrogen use efficiency
  misc_feature: Functional homolog of the protein sequence given in SEQ ID NO 13612
  misc_feature: Useful for making plants with altered terpenoid content
  misc_feature: Functional homolog of the protein sequence given in SEQ ID NO 13610
  misc_feature: Useful for making plants with altered alkaloid content
  misc_feature: Functional homolog of the protein sequence given in SEQ ID NO 13611
  misc_feature: Ceres ANNOT ID no. 8725419
  misc_feature (23)..(200): Pfam ID: AUX_IAA Pfam Description: AUX/IAA family
MSEGPARSSTAESSSSAASSSGLDFEDTALALTLRLPGSDSDVRKRAASTSTPVAGRCSPRASASNEAPPAPKAQVVGWPPVSRNRRNAALPSRGKFVKVAVAGAPYQRKVDLEAYAGYDQLLAALQDKFTSHFTVRRRVGNDEMALVDVVSGAEYVPTYEDKDGDWMLVGDVPWRMFVETCQRLRLMKSSEVVNLAPRAAE

SEQ ID NO: 19286 - DNA, 1215 bp, Sorghum bicolor
  misc_feature: Ceres ANNOT ID no. 8725416
  misc_feature: Encodes the peptide sequence at SEQ ID NO 19287
atgccgtcgtcgtcgtcgtcagcctcgacgccggccgccgcatccggcggcctcttcgagttggggtccgcggcgagcgtgccggagacgcacgcgtggccgggggtgaacgagcacccgtcggtggagtccgctggccgcgacgcggtcccggtggtggacatgggcatgggcggcccggacgacgccgacgcggcggcgcgggcagtggcgcgcgccgccgaggagtggggcgcgttcctgctcgtcggccacggcgtgccgcggggcgtggcggcgcgcgccgaggcgcaggtcgcgcgcctgttcgcgctcccggctcccgacaaggcccgcgctgcccgtcgccgccgtgccgccgccgccgccgccgccggctacggcatgccgcccctggcgctccgcttctccaagctcatgtggtccgaggcgtacacgttccccgccgccgccgtccgcgacgagttccgccgcgtctggcccgacgccggcgacgactacctccgcttctgcgacgtgatggaggagtacgacagagagatgagggctctcggcggcaggctgctcgacctattcttcatggcgctcggcggcggcctcaccgacgacgaccagatcgccggcggcgagacgacgacgacggagcggaagatccgagacaacttgacggcgatgatgcacccgatcctgtaccccaagtgcccggaaccggagcgcgccatggggctggcgccgcacacggactcgggcttcatcacgctcatcacgcagagcgccggcgtgccggggctgcagctgctccgccgcgggccggacaggtgggtgacggtgccggcgccgccgggcgcgttcgtcgtcgtgctcggcgacctcttccaggtgctcaccaacggccgctaccggagcgcgctccaccgcgccgtcgtgaacagggagcgcgaccggatctccgtgccctacttcctcggcccgccggacggcatgaaggtggcgccgctcgcgtcggctctgctgccggggaggaggaaggccgcgttccgggccgtgacgtggccggagtacatggagctcaagcacaaggtgctcggcacggatacgtcggcgctggagatgctgcagttggacgaggaagagatggtgggagggggcccgccacctaagaaactattccttcggttcaaaacgaaaggaattttgtcttttctacataattag

SEQ ID NO: 19287 - protein, 404 aa, Sorghum bicolor
  misc_feature: The sequence is a functional homolog of SEQ ID NO 2 in US patent 7049490
  misc_feature: Ceres ANNOT ID no. 8725416
  misc_feature (19)..(378): SWISSPROT Homolog: EC 1.14.11.15 Gibberellin 3-beta-dioxygenase
  misc_feature (222)..(324): Pfam ID: 2OG-FeII_Oxy Pfam Description: 2OG-Fe(II) oxygenase superfamily
MPSSSSSASTPAAASGGLFELGSAASVPETHAWPGVNEHPSVESAGRDAVPVVDMGMGGPDDADAAARAVARAAEEWGAFLLVGHGVPRGVAARAEAQVARLFALPAPDKARAARRRRAAAAAAAGYGMPPLALRFSKLMWSEAYTFPAAAVRDEFRRVWPDAGDDYLRFCDVMEEYDREMRALGGRLLDLFFMALGGGLTDDDQIAGGETTTTERKIRDNLTAMMHPILYPKCPEPERAMGLAPHTDSGFITLITQSAGVPGLQLLRRGPDRWVTVPAPPGAFVVVLGDLFQVLTNGRYRSALHRAVVNRERDRISVPYFLGPPDGMKVAPLASALLPGRRKAAFRAVTWPEYMELKHKVLGTDTSALEMLQLDEEEMVGGGPPPKKLFLRFKTKGILSFLHN

SEQ ID NO: 19288 - DNA, 627 bp, Sorghum bicolor
  misc_feature: Ceres ANNOT ID no. 8725437
  misc_feature: Encodes the peptide sequence at SEQ ID NO 19289
atggtgaagcacaacaacgttatccccaacgggcacttcaagaagcactggcagaactatgtcaagacatggttcaaccagcccgcccgcaagcagaggcgccgcatcgctcgtcaaaagaaggctgtgaagatattcccacgcccaactgctggccctcttcgccccattgtgcaatgccaaactctcaagtacaacatgaagtcaagggctggtagaggctttacccttgaggagctgaaggcagcaggcattccaaagaagcttgccccgaccattggcatttccgtggatcaccgccgcaagaacaaatccctcgagggactgcaggccaatgtccagaggcttaagacatacaaggccaagctggttatcttcccaaggcgtgctcgcaaggtcaaggctggtgactctactgtggaggagcttgctaccgtcacccaggtccagggtgactacatgcctattactcgtggtgagaagcgctcagtcgaggttgtgaaggttactgacgagatgaagtcgtttgcggcctacggcaagctccgccttgagcggatgaacaagaaacaccagggtgcccgccagaagaaggccgctgaggcggagaaggacgagaagaagtga

SEQ ID NO: 19289 - protein, 208 aa, Sorghum bicolor
  misc_feature: Useful for making plants with modulated nitrogen use efficiency
  misc_feature: Functional homolog of the protein sequence given in SEQ ID NO 14483
  misc_feature: Useful for making plants with modulated phosphate use efficiency
  misc_feature: Functional homolog of the protein sequence given in SEQ ID NO 14484
  misc_feature: Ceres ANNOT ID no. 8725437
  misc_feature (6)..(185): Pfam ID: Ribosomal_L13e Pfam Description: Ribosomal protein L13e
MVKHNNVIPNGHFKKHWQNYVKTWFNQPARKQRRRIARQKKAVKIFPRPTAGPLRPIVQCQTLKYNMKSRAGRGFTLEELKAAGIPKKLAPTIGISVDHRRKNKSLEGLQANVQRLKTYKAKLVIFPRRARKVKAGDSTVEELATVTQVQGDYMPITRGEKRSVEVVKVTDEMKSFAAYGKLRLERMNKKHQGARQKKAAEAEKDEKK

SEQ ID NO: 19290 - DNA, 1542 bp, Sorghum bicolor
  misc_feature: Ceres ANNOT ID no. 8725411
  misc_feature: Encodes the peptide sequence at SEQ ID NO 19291
atggcggcggagctccacttcgtgctggttccagtcatggcgcagggccacttgctccccatgctcgacctggcgcgcctcatcgccggccacggcgcgcgcgtcaccgtcgtgctgacgcccgtgaacgccgcgcgcaacaggcccttcctggagcacgccgcgcgggcggggctggccgtcgcgttcgccgagctcgccttcccgggacccgcgctgggcctgcccgagggctgcgagagcgtcgacatggtgacggacatgtccctcatcgtcccgttctaccacgccatgtggcttctcgccgcgccgctcgaggcgtacctccggtcgctgccccggcggcccgactgcctcgtcgcagactcgttgggcccctggacggcgggcgtcgcgcggcgcgtcggcgtcctgcggttggtcctccacgggccgtccacgttctacctcctcgccgtgcacaacctcgccaagcacggcgcgtacgaccgcgccgccggcgacttggagccgttggaggtgccggacttcccagtgcgcacggttgtcaacagggcgacgtcgctcgggttctttcagtggccagggatggagaggttccggcgggagacgctggaagccgaggctaccgccgacggcctgctcgtgaacacgtgctcggccttggagagcgcgttcgtgaagagctacgcggcggcgctcggccggaaggtgtgggaagtcgggccgctctgcctcaccgacaccgacgcggtcacgacggcgggtcgaggcaaccgcgcggcgatgaacgccgagcacatcgtgtcctggctcgacgcgcggccggcggcgtctgtgctctacgtcaacttcggcagcatcgcccgcctgttcccaacgcaggtcgccgagctcgccgccggcctggaggcgtcgcgccggccgttcgtctggtcgacgaaagagaccgccggactggatggggagttcgaggcccgcgtcaaggactacggcctcgtcatccgcgggtgggcgccgcagatgaccatcctgtcgcaccccgccgtcggcggcttcttgacgcactgcgggtggaactcgacgctcgaggccatctccaacggcgtgccgctgctgacctggccgcagttcgccgaccagttcctgaacgaggcgctggtcgtggacgtgctcggcgtcggcgtccgcgccggcgtgaaggtaccggccacgcacgcgatgctcctgaatcccggagacccgcaggtcgggagagacgatgtggagagggtggtggccgagctgatggacgaggggcggccagcgggtgcggcgcggcgggccaaggcgaaggagctcgcccacagtatggtggccgcggtgaccaagggtggctcgtcggacttggaggtgaaggacatgctccggcatgtcttggagctatcacgaaaggatgagcactttgtcgtcggtgcggcggagggtgcgatcaaggacaaggaggaggtggacatggatgactcggatggcatacttacagtggtctccaaagtcgcttga

SEQ ID NO: 19291 - protein, 513 aa, Sorghum bicolor
  misc_feature: Useful for making plants with altered carbohydrate content
  misc_feature: Functional homolog of the protein sequence given in SEQ ID NO 14399
  misc_feature: Ceres ANNOT ID no. 8725411
  misc_feature (4)..(476): SWISSPROT Homolog: EC 2.4.1.238 Anthocyanin 3'-O-beta-glucosyltransferase
  misc_feature (6)..(476): Pfam ID: UDPGT Pfam Description: UDP-glucoronosyl and UDP-glucosyl transferase
MAAELHFVLVPVMAQGHLLPMLDLARLIAGHGARVTVVLTPVNAARNRPFLEHAARAGLAVAFAELAFPGPALGLPEGCESVDMVTDMSLIVPFYHAMWLLAAPLEAYLRSLPRRPDCLVADSLGPWTAGVARRVGVLRLVLHGPSTFYLLAVHNLAKHGAYDRAAGDLEPLEVPDFPVRTVVNRATSLGFFQWPGMERFRRETLEAEATADGLLVNTCSALESAFVKSYAAALGRKVWEVGPLCLTDTDAVTTAGRGNRAAMNAEHIVSWLDARPAASVLYVNFGSIARLFPTQVAELAAGLEASRRPFVWSTKETAGLDGEFEARVKDYGLVIRGWAPQMTILSHPAVGGFLTHCGWNSTLEAISNGVPLLTWPQFADQFLNEALVVDVLGVGVRAGVKVPATHAMLLNPGDPQVGRDDVERVVAELMDEGRPAGAARRAKAKELAHSMVAAVTKGGSSDLEVKDMLRHVLELSRKDEHFVVGAAEGAIKDKEEVDMDDSDGILTVVSKVA

SEQ ID NO: 19292 - DNA, 1578 bp, Sorghum bicolor
  misc_feature: Ceres ANNOT ID no. 8725461
  misc_feature: Encodes the peptide sequence at SEQ ID NO 19293
atggccgcgaagcaccagcagcagcaccacttcctgatcgtcacgtacccggcgcaggggcacatcaccccggcgcgtcacctcgcgcgccgcctcgccagcgcgtgccccggcggcgcgcgcgtcaccatctgcgccccgctgtcggcgttccggaagatgttcccgggcgccgccgccgctgtggctgtgacgggggaggagtgtggcggcgacggcgacggcgacggcgacgagagcgtcgcgtacgtggcctactcggacggctacgacggcgggttcgacgtcgccgtggacagctacgcgaggtacatggaggaggcgagggcggcggggtcgcggtcgctggcccgtgtgctccgccgcctccgcgacgaggggcgccccgtcacgtgcgccgtgtacacgctgctcctgccctgggtagccggcgtggcccggagccacggcgtggccgcgacggccgtgttctggatccagccagccacggccctcgccgcgtactaccactacttccgcggccaccgggacgccgtcgtggccgccgcggcttcgggggatccgcgcgccgaggttcggctcccgggcctcccgccgctccgcgtccgcgacctcccgtcgttcctcgccgtcacctccgacgacgacccgttcgcgttcgtgctcccggagttccgcgagctcgtggacgcgatcgaacgagacgacgacggcgacggcgacgggtcctcgtcgaagcccccgacgtacgtgctcgccaacacctgcgacgccatggagcccgaagcgctggcgtcgctgcgcccacacgtggacatcttcgccgtcgggcccgtgctgtcgttcctgcacgacgaggcggacgacgacggcaacgggaggcgcgccccgtctccgtctcctcctcgtgacgtctttgagcacgacaagagcgggtacctcggctggctcgacaccaagccggccaagtcggtggtgtacatctccttcggcagctcgtcggtgacgagcaggaagcaggccgcggagatcgccgacgccatggcccaggtgaagagaccgttcctctgggttttaaggaaggacaactggaaggacgacgacgacgacgacgcggcgatcaagaaagcagcggcggcggcggtggatgcggacagcggtggcgggatggtggtgtcatggtgcgaccaggcgcgggtgctgtcgcacccgtcggtggcgtgcttcgtgacgcactgcgggtggaactcgacgctggagagcttggcgtgcggcgtgccgaccgtggcggtgccgcagtactcggaccagggcacggccgcgtggctcgtggcggagcggatgggcgccggcgtccgcgtccgcgtccgcgcggacgacgacggcggcgtcgtggtggaggccgacgagctggcgcggtgcgtggaggccgccgcggcgtcggatgccgtggcggcgcgcgccgcggcgttaatgggcaaggcgagggcggccgtggcggacgacgacggcggcgggagctcgcaccgcaacctgacggagttcctcaggcagatcgcccgcggtcccggcgaataa

SEQ ID NO: 19293 - protein, 525 aa, Sorghum bicolor
  misc_feature: Useful for making plants with altered carbohydrate content
  misc_feature: Functional homolog of the protein sequence given in SEQ ID NO 14698
  misc_feature: Ceres ANNOT ID no. 8725461
  misc_feature (295)..(441): SWISSPROT Homolog: EC 2.4.1.210 Limonoid glucosyltransferase
  misc_feature (29)..(511): Pfam ID: UDPGT Pfam Description: UDP-glucoronosyl and UDP-glucosyl transferase
MAAKHQQQHHFLIVTYPAQGHITPARHLARRLASACPGGARVTICAPLSAFRKMFPGAAAAVAVTGEECGGDGDGDGDESVAYVAYSDGYDGGFDVAVDSYARYMEEARAAGSRSLARVLRRLRDEGRPVTCAVYTLLLPWVAGVARSHGVAATAVFWIQPATALAAYYHYFRGHRDAVVAAAASGDPRAEVRLPGLPPLRVRDLPSFLAVTSDDDPFAFVLPEFRELVDAIERDDDGDGDGSSSKPPTYVLANTCDAMEPEALASLRPHVDIFAVGPVLSFLHDEADDDGNGRRAPSPSPPRDVFEHDKSGYLGWLDTKPAKSVVYISFGSSSVTSRKQAAEIADAMAQVKRPFLWVLRKDNWKDDDDDDAAIKKAAAAAVDADSGGGMVVSWCDQARVLSHPSVACFVTHCGWNSTLESLACGVPTVAVPQYSDQGTAAWLVAERMGAGVRVRVRADDDGGVVVEADELARCVEAAAASDAVAARAAALMGKARAAVADDDGGGSSHRNLTEFLRQIARGPGE

SEQ ID NO: 19294 - DNA, 615 bp, Sorghum bicolor
  misc_feature: Ceres ANNOT ID no. 8725532
  misc_feature: Encodes the peptide sequence at SEQ ID NO 19295
atggcggcttccctgggactgaaccctgaagctctcttcgcttcatactcgtctgcctactcctcctcctcgccgttcgtgtccgactacgcggcgagcttcccggcggccgtcgactccgccacggccttctccgcggagctcgatgaccttcaccacttcgactactcaccggcgccgatcttcacagctgtcggagccggggctggcggcgatcgcaacgagaagatgatgatgtggtgtgagggcggtggtgatgaaaagagactcagaagcagtggaaggatcgggttcagaacgagatcagaggtggagatcttggacgatggattcaaatggaggaagtatgggaagaaggctgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagtcccggagccgccgccatcatccagtacggcggcggcggcggcaatagcggcttctacagcccgccgcacagtggctcgccgtcggctgcctcatactcgggctccttcgtcttctga

SEQ ID NO: 19295 - protein, 204 aa, Sorghum bicolor
  misc_feature: The sequence is a functional homolog of SEQ ID NO 206 in the 10/714,887 US patent application
  misc_feature: The sequence is a functional homolog of SEQ ID NO 206 in the 11/435,388 US patent application
  misc_feature: The sequence is a functional homolog of SEQ ID NO 148 in the 10/714,887 US patent application
  misc_feature: The sequence is a functional homolog of SEQ ID NO 148 in the 11/435,388 US patent application
  misc_feature: The sequence is a functional homolog of SEQ ID NO 210 in the 10/714,887 US patent application
  misc_feature: The sequence is a functional homolog of SEQ ID NO 210 in the 11/435,388 US patent application
  misc_feature: The sequence is a functional homolog of SEQ ID NO 146 in the 10/714,887 US patent application
  misc_feature: The sequence is a functional homolog of SEQ ID NO 146 in the 11/435,388 US patent application
  misc_feature: The sequence is a functional homolog of SEQ ID NO 134 in the 10/714,887 US patent application
  misc_feature: The sequence is a functional homolog of SEQ ID NO 134 in the 11/435,388 US patent application
  misc_feature: The sequence is a functional homolog of SEQ ID NO 1533 in the 10/374,780 US patent application
  misc_feature: The sequence is a functional homolog of SEQ ID NO 1617 in the 10/412,699 US patent application
  misc_feature: The sequence is a functional homolog of SEQ ID NO 130 in the 10/714,887 US patent application
  misc_feature: The sequence is a functional homolog of SEQ ID NO 130 in the 11/435,388 US patent application
  misc_feature: The sequence is a functional homolog of SEQ ID NO 152 in the 10/714,887 US patent application
  misc_feature: The sequence is a functional homolog of SEQ ID NO 152 in the 11/435,388 US patent application
  misc_feature: The sequence is a functional homolog of SEQ ID NO 1535 in the 10/374,780 US patent application
  misc_feature: The sequence is a functional homolog of SEQ ID NO 1619 in the 10/412,699 US patent application
  misc_feature: The sequence is a functional homolog of SEQ ID NO 144 in the 10/714,887 US patent application
  misc_feature: The sequence is a functional homolog of SEQ ID NO 144 in the 11/435,388 US patent application
  misc_feature: The sequence is a functional homolog of SEQ ID NO 1611 in the 10/412,699 US patent application
  misc_feature: The sequence is a functional homolog of SEQ ID NO 971 in the 10/666,642 US patent application
  misc_feature: The sequence is a functional homolog of SEQ ID NO 208 in the 10/714,887 US patent application
  misc_feature: The sequence is a functional homolog of SEQ ID NO 208 in the 11/435,388 US patent application
  misc_feature: The sequence is a functional homolog of SEQ ID NO 138 in the 10/714,887 US patent application
  misc_feature: The sequence is a functional homolog of SEQ ID NO 138 in the 11/435,388 US patent application
  misc_feature: The sequence is a functional homolog of SEQ ID NO 142 in the 10/714,887 US patent application
  misc_feature: The sequence is a functional homolog of SEQ ID NO 142 in the 11/435,388 US patent application
  misc_feature: The sequence is a functional homolog of SEQ ID NO 1610 in the 10/412,699 US patent application
  misc_feature: The sequence is a functional homolog of SEQ ID NO 970 in the 10/666,642 US patent application
  misc_feature: The sequence is a functional homolog of SEQ ID NO 150 in the 10/714,887 US patent application
  misc_feature: The sequence is a functional homolog of SEQ ID NO 150 in the 11/435,388 US patent application
  misc_feature: The sequence is a functional homolog of SEQ ID NO 1534 in the 10/374,780 US patent application
  misc_feature: The sequence is a functional homolog of SEQ ID NO 1618 in the 10/412,699 US patent application
  misc_feature: The sequence is a functional homolog of SEQ ID NO 1640 in the 11/479,226 US patent application
  misc_feature: The sequence is a functional homolog of SEQ ID NO 2 in the 10/225,066 US patent application
  misc_feature: The sequence is a functional homolog of SEQ ID NO 254 in the 10/374,780 US patent application
  misc_feature: The sequence is a functional homolog of SEQ ID NO 30 in the 10/714,887 US patent application
  misc_feature: The sequence is a functional homolog of SEQ ID NO 30 in the 11/435,388 US patent application
  misc_feature: The sequence is a functional homolog of SEQ ID NO 808 in the 10/412,699 US patent application
  misc_feature: The sequence is a functional homolog of SEQ ID NO 202 in the 10/714,887 US patent application
  misc_feature: The sequence is a functional homolog of SEQ ID NO 202 in the 11/435,388 US patent application
  misc_feature: The sequence is a functional homolog of SEQ ID NO 194 in the 10/666,642 US patent application
  misc_feature: The sequence is a functional homolog of SEQ ID NO 6 in the 10/714,887 US patent application
  misc_feature: The sequence is a functional homolog of SEQ ID NO 6 in the 11/435,388 US patent application
  misc_feature: The sequence is a functional homolog of SEQ ID NO 806 in the 10/412,699 US patent application
  misc_feature: The sequence is a functional homolog of SEQ ID NO 154 in the 10/714,887 US patent application
  misc_feature: The sequence is a functional homolog of SEQ ID NO 154 in the 11/435,388 US patent application
  misc_feature: The sequence is a functional homolog of SEQ ID NO 86 in the 10/412,699 US patent application
  misc_feature: The sequence is a functional homolog of SEQ ID NO 22 in the 10/374,780 US patent application
  misc_feature: The sequence is a functional homolog of SEQ ID NO 231 in the 11/479,226 US patent application
  misc_feature: The sequence is a functional homolog of SEQ ID NO 858 in the 10/225,066 US patent application
  misc_feature: The sequence is a functional homolog of SEQ ID NO 88 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8725532
  misc_feature (107)..(166): Pfam ID: WRKY Pfam Description: WRKY DNA -binding domain
MAASLGLNPEALFASYSSAYSSSSPFVSDYAASFPAAVDSATAFSAELDDLHHFDYSPAPIFTAVGAGAGGDRNEKMMMWCEGGGDEKRLRSSGRIGFRTRSEVEILDDGFKWRKYGKKAVKNSPNPRNYYRCSSEGCGVKKRVERDRDDPRYVITTYDGVHNHASPGAAAIIQYGGGGGNSGFYSPPHSGSPSAASYSGSFVF

SEQ ID NO: 19296 - DNA, 1350 bp, Sorghum bicolor
  misc_feature: Ceres ANNOT ID no. 8725526
  misc_feature: Encodes the peptide sequence at SEQ ID NO 19297
atgagcatcaccgtcaccaagtcgccgctggtgctggtcggcccgtcgacagcgccggcggcggcagagacgaccgcgcacatcatcaacctctcgtcgtttgacaaggcgctcgccttcttccccgtcacgtcgttccacatcttcgaccatgcgatccacaggccggccgagaccgtgcggagcgctctgtcccgcgccctggtccactactacccggtcgccggccgcgccgtcgaagacagcagcggcgacctccgtatcgcttgcaccggcgagggcgtggggttcgtggccgcgtcggcgaactgctccctggctgacgtcaaactctttgacccgccgttcggcgcgctgctgaaggagctcgccgtcggcctcggtgccgaggggttccgtccgtcggacccgctgctgctcgtgcaggtgacggagttctcctgcggcgggttcgtcgtcggggtgacgcggaaccacgtcgtcgccgacggcacggggttcgcgcagttcctgcaggccgtcggcgagctcgcgcggggcctgccccggccggccgtcttcccggtcagctgcggcgatgactccctcccggagctgccgccgttcgtcgacgccatggagaaggcgcaggtcacgctcgagccacgggacttcgcctacctcgacatcaccgtcccgtccaggtgcatcaaccgtatcaaagccggattcgctcgccacgccgccgccgctgcggagagcggcggcccgtgcaccgtcttcgaggcggtcatggccgtcctctggcagtgccgcacgcgcgccatcatgtctgacccggacacccccgctcctctcatcttcgcggcgaacgtgcgcaagcacgccggcgccaagcgcggctactacggcaactgcataacgtcggcggtggtcgtgccgacgagcggggaggtggcgaacggcgacatcaacgacgtactgaggcttatcaagcgcgctaagcagccgataccgtaccagttctggaagaacaactccgccgacgacgacgccggagacgacgaagaaggcggccgccacgtgaaggaaccgcggccggaaggtggtttgtcgttgtccatggagcagctggacgtgacgctcgggtacaacgccttcgacgtgacgagctggcggaacctcggcgccgacgcggtggacttcggcggcggccggccggcgagggtgatgtgctggctggaccggatggcggtgccgcactgcgtcgcgtgcctgccatgcaacaaggacggggggaacgtgttggcgcgctgtgtcagggaggagcatgtggacgccttccttggtgaactcgccaagttcacctga

SEQ ID NO: 19297 - protein, 449 aa, Sorghum bicolor
  misc_feature: Useful for making plants with altered carbohydrate content
  misc_feature: Functional homolog of the protein sequence given in SEQ ID NO 14699
  misc_feature: Ceres ANNOT ID no. 8725526
  misc_feature (56)..(335): SWISSPROT Homolog: EC 2.3.1.167 10-deacetylbaccatin III 10-O-acetyltransferase
  misc_feature (1)..(448): Pfam ID: Transferase Pfam Description: Transferase family
MSITVTKSPLVLVGPSTAPAAAETTAHIINLSSFDKALAFFPVTSFHIFDHAIHRPAETVRSALSRALVHYYPVAGRAVEDSSGDLRIACTGEGVGFVAASANCSLADVKLFDPPFGALLKELAVGLGAEGFRPSDPLLLVQVTEFSCGGFVVGVTRNHVVADGTGFAQFLQAVGELARGLPRPAVFPVSCGDDSLPELPPFVDAMEKAQVTLEPRDFAYLDITVPSRCINRIKAGFARHAAAAAESGGPCTVFEAVMAVLWQCRTRAIMSDPDTPAPLIFAANVRKHAGAKRGYYGNCITSAVVVPTSGEVANGDINDVLRLIKRAKQPIPYQFWKNNSADDDAGDDEEGGRHVKEPRPEGGLSLSMEQLDVTLGYNAFDVTSWRNLGADAVDFGGGRPARVMCWLDRMAVPHCVACLPCNKDGGNVLARCVREEHVDAFLGELAKFT

SEQ ID NO: 19298 - DNA, 747 bp, Sorghum bicolor
  misc_feature: Ceres ANNOT ID no. 8725664
  misc_feature: Encodes the peptide sequence at SEQ ID NO 19299
atggcagaccagtcagggcgggttgtgttggatgaggggaaggggcactcaaacaccatgagtaccagcaacaacacctccgaccttagcgacgagaagcttaaggaccaacgatgcctgacaccagcttcatggcgctgcccttactgcgaccatgagctcaactgcaattcgtacatggttgggtttccagcaggtgtcaagtttgatccgacagatcaggagctcctagagcacctagagtccatggtgaaggaaggaggctctagagcacaccccctcattggtgactttgtaaccacacttcaaggagacgatggcatttgctacacccatcctgagaatctcccaggtgtgacaagagatggcgtcagcaagcacttcttccacaggccatccaaagcttacacctctggcacaaggaagaggagaaagatccagtcaaaacgcggtgaagatgttggcgaggcgcggtggcataagaccggcaagacacgtccattgatcgttggtggtcggcagaaggggtgcaagaagatcctagtgttgtacagtaactatggaaagcaagggaacaagctagagaagaccaactgggtgatgcatcaataccacctcggtagggatgaggagaaggatggggagctggtcgtgtctaaggtcttctaccagcagacacaacgttctaccacaacaatgatggaacagaacgatgatgaaaagtgcaatatccctcagccctcctga

SEQ ID NO: 19299 - protein, 248 aa, Sorghum bicolor
  misc_feature: The sequence is a functional homolog of SEQ ID NO 1710 in the 10/374,780 US patent application
  misc_feature: The sequence is a functional homolog of SEQ ID NO 542 in the 10/666,642 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 210 in the 10/666,642 US patent application
  misc_feature: Useful for making plants with altered carbohydrate content
  misc_feature: Functional homolog of the protein sequence given in SEQ ID NO 14394
  misc_feature: The sequence is a functional homolog of SEQ ID NO 1713 in the 10/374,780 US patent application
  misc_feature: The sequence is a functional homolog of SEQ ID NO 562 in the 11/435,388 US patent application
  misc_feature: Ceres ANNOT ID no. 8725664
  misc_feature (63)..(207): Pfam ID: NAM Pfam Description: No apical meristem (NAM) protein
MADQSGRVVLDEGKGHSNTMSTSNNTSDLSDEKLKDQRCLTPASWRCPYCDHELNCNSYMVGFPAGVKFDPTDQELLEHLESMVKEGGSRAHPLIGDFVTTLQGDDGICYTHPENLPGVTRDGVSKHFFHRPSKAYTSGTRKRRKIQSKRGEDVGEARWHKTGKTRPLIVGGRQKGCKKILVLYSNYGKQGNKLEKTNWVMHQYHLGRDEEKDGELVVSKVFYQQTQRSTTTMMEQNDDEKCNIPQPS

SEQ ID NO: 19300 - DNA, 1191 bp, Sorghum bicolor
  misc_feature: Ceres ANNOT ID no. 8725672
  misc_feature: Encodes the peptide sequence at SEQ ID NO 19301
atgtgcagcagcaacagcacctctgacctcactgatgagaagcttaaggaccaacaacggtcgacaccagcttcacggcgctgccctagttgcgaccatgagctcgactgcaatccagacatggttggatttccagcaggtgtcaagtttgatccatcagaccaggagctcatagagcacctggagtccatggtgaaggaaggaggctccagagcacaccccctgattggtgactttatacacacaattgatcaaggaaacgatggcatttgctacacccatcctgagaatctcccaggtgtgacaagaaatggagttagcaagcacttcttccataggccatccaaagcctacacctctggtacaaggaagaggagaaagatcaagtcagaacgtggccttcgcagctgcgatgatgttggcgaggcgtgctggcataagaccggcaagacacgtcctgtgctcgttggtggtcagcagaaggggtggaagaagaccctagtgctgtacaatagctatggaaagcaacggaaaccagagaagaccaactgggtgatgcaccaataccacctcggcagggaggagaaggacggggagctggtcgtgtctaaggtcttctatcagcagaagcagctgcgtcctaccgcgacaatgatgggacagaatgatgaaagggtagaagtgacctcagaggccatgaaagatatgctccctgggtgcggtgcggcagccgctgaagctggggatgccatgatacaactgcagcagcacctacagcagaggcaggctgatggccagagcagatttacttctgccaggatgtcccgtgaggttggtgtaggcaacccattagttggtgatcaaggactgctgcatgaaacccaccacataccatcacaacataatgaagtccgatcaatgctcgtaaaaccagtgcacactatgccttctgttgaaagcacaccccttgaacacagaatcgaccaaattatcgcctgcagtgcaatatccctcagtccccctgaacagcgcagtgaaaaccaagaggatcggcagcagcagaagaaagttgactgcagaaggccttgtagttcggaagaagccatgatagcctgccagacatcaagcacagaagagtgcttgaaaatagatgcagtaaaattggtgggttcatattgccatgctatatag

SEQ ID NO: 19301 - protein, 396 aa, Sorghum bicolor
  misc_feature: The sequence is a functional homolog of SEQ ID NO 1710 in the 10/374,780 US patent application
  misc_feature: The sequence is a functional homolog of SEQ ID NO 542 in the 10/666,642 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 210 in the 10/666,642 US patent application
  misc_feature: Useful for making plants with altered carbohydrate content
  misc_feature: Functional homolog of the protein sequence given in SEQ ID NO 14394
  misc_feature: The sequence is a functional homolog of SEQ ID NO 562 in the 11/435,388 US patent application
  misc_feature: Ceres ANNOT ID no. 8725672
  misc_feature (44)..(192): Pfam ID: NAM Pfam Description: No apical meristem (NAM) protein
MCSSNSTSDLTDEKLKDQQRSTPASRRCPSCDHELDCNPDMVGFPAGVKFDPSDQELIEHLESMVKEGGSRAHPLIGDFIHTIDQGNDGICYTHPENLPGVTRNGVSKHFFHRPSKAYTSGTRKRRKIKSERGLRSCDDVGEACWHKTGKTRPVLVGGQQKGWKKTLVLYNSYGKQRKPEKTNWVMHQYHLGREEKDGELVVSKVFYQQKQLRPTATMMGQNDERVEVTSEAMKDMLPGCGAAAAEAGDAMIQLQQHLQQRQADGQSRFTSARMSREVGVGNPLVGDQGLLHETHHIPSQHNEVRSMLVKPVHTMPSVESTPLEHRIDQIIACSAISLSPPEQRSENQEDRQQQKKVDCRRPCSSEEAMIACQTSSTEECLKIDAVKLVGSYCHAI

SEQ ID NO: 19302 - DNA, 1527 bp, Sorghum bicolor
  misc_feature: Ceres ANNOT ID no. 8725727
  misc_feature: Encodes the peptide sequence at SEQ ID NO 19303
atggcggacaccgacgacgcgccgccggccccggccgtgcaccgccgcccaccgcgccccgcccgcggtgctgccgctgcccagggcttcgcggccaagttgcgccgacggctcagctccggcgccgcggcggcggcgcgcgccagcttcgcggcagactccggggacgagtccggccccggggagccctcttcgtcccgccgccgcgacaacggcggggacgcctcgtccgccgccgacggcggccggggcggggcaggggacttctccgctttcacgttccgcgccgcggcgcctgtccaccggaaagccaaggagagccccctcagctccgacgctatcttcaagcagagtcatgcaggccttttcaacctatgtattgttgttctggttgcagtgaatagcaggctcattattgagaacctgatgaagtatggcttattaataaggtctggcttttggtttaatgctacatcattgcgagactggccactgctaatgtgttgccttagtctacctgtgtttccccttggtgcatttgcagttgaaaagttggcattcaacaatctcattactgatgctgccgctacctgttttcacatctttcttacaacacttgaaattgtatatccagtgcttgtgattcttaagtgtgattctgcagttttatcaggctttgtgttgatgtttattgcctgcattgtttggctgaagcttgtatcttttgcacatacaaaccatgatataagaaaactgatcacaagcggcaagaaggttgataatgaactgaccgtggctgacatagataatttacaagctccaactcttgggagtctaacatacttcatgatggctccgacactctgttatcagccaagttatcctcgaacaccttatgttagaaaaggttggctggttcgtcaagttattctatacttgatatttactggtctccaaggattcattattgagcaatacataaatcctattgttgtgaactctcaacatccattgaagggaggattactgaatgctgtagagactgttttgaagctctcattaccaaatgtctacctgtggctttgcatgttctattgccttttccatctatggttaaacatacttgctgagattcttcgatttggtgaccgtgaattctacaaagactggtggaatgcaaaaacaattgatgagcctgtgcataaatggatgcttcgtcatatatattttccttgcatacgaaatggtatatcaaaggaagttgctgcttttatagcgttctttgtttctgctgtatttcatgagttatgtgttgctgttccctgccacatactcaagttctgggctttcttaggaatcatgcttcagattcccctcatcatactgacatcatacctcaaaaataaattcaatgacacaatggttggcaatatgatcttttggttctttttctgcatttacgggcagccaatgtgcgttctattgtattaccatgatgtgatgaaccggactgagaagacaaaataa

SEQ ID NO: 19303 - protein, 508 aa, Sorghum bicolor
  misc_feature: The sequence is a functional homolog of SEQ ID NO 2 in US patent 7067718
  misc_feature: Ceres ANNOT ID no. 8725727
  misc_feature (101)..(502): SWISSPROT Homolog: EC 2.3.1.20 Diacylglycerol O-acyltransferase
  misc_feature (221)..(497): Pfam ID: MBOAT Pfam Description: MBOAT family
MADTDDAPPAPAVHRRPPRPARGAAAAQGFAAKLRRRLSSGAAAAARASFAADSGDESGPGEPSSSRRRDNGGDASSAADGGRGGAGDFSAFTFRAAAPVHRKAKESPLSSDAIFKQSHAGLFNLCIVVLVAVNSRLIIENLMKYGLLIRSGFWFNATSLRDWPLLMCCLSLPVFPLGAFAVEKLAFNNLITDAAATCFHIFLTTLEIVYPVLVILKCDSAVLSGFVLMFIACIVWLKLVSFAHTNHDIRKLITSGKKVDNELTVADIDNLQAPTLGSLTYFMMAPTLCYQPSYPRTPYVRKGWLVRQVILYLIFTGLQGFIIEQYINPIVVNSQHPLKGGLLNAVETVLKLSLPNVYLWLCMFYCLFHLWLNILAEILRFGDREFYKDWWNAKTIDEPVHKWMLRHIYFPCIRNGISKEVAAFIAFFVSAVFHELCVAVPCHILKFWAFLGIMLQIPLIILTSYLKNKFNDTMVGNMIFWFFFCIYGQPMCVLLYYHDVMNRTEKTK

SEQ ID NO: 19304 - DNA, 909 bp, Sorghum bicolor
  misc_feature: Ceres ANNOT ID no. 8725710
  misc_feature: Encodes the peptide sequence at SEQ ID NO 19305
atggctaggaagtgctcaagttgtggaaacaatggccacaactccagaacttgcagtggtcacagatgccaagtgaccagcattagcatcaacagcactagtactactactagctgtggtagcttgaggctgtttggggtgcagctgcaggtaggctcctctcctctcaagaagtgcctcagcatggagtgcctgtcacctattgcctgctatggagctgctgctgcttcgtcaagcttgtcgccttctgtgtcatcgtcttcgtcttcgcttgcctcgatagaggagagctcccagaggatcaccggagggtacgtgtcggatggcctcgtggtcagggttcaggacaggaagaaaggagttccatggaccgaggaagagcaccggatgttccttgccggcctagacaagcttgggaggggcgattggcgaggcatttcccgacactttgtcacgacacggacaccgacgcaggtggccagccatgctcagaagtacttcctgaggcagaacagcctcactcaaaagaagaggaggtccagcctctttgatgcggatgaaggtgccaacaaggcagcactccgcaggacagcatcagtatccgagctgcaattccccagcctgtcgccggtggccgtcgacgcaaggacgacgaagggagctgtgccgctgccaccatgcctgaacctgatgatgagcagcgcatcacagtgtgctggtagtggtagtggtagtagtgatgcatcacagacacagaacccatcttccctctacctgatggcaaagccgcatcaggcacaactccagatgcctgatctggagctgaagatgtcgacatcccggttatctgaacagcctggtggtgcctcccggggaacgcctctttttggaactatcagagttacctga

SEQ ID NO: 19305 - protein, 302 aa, Sorghum bicolor
  misc_feature: The sequence is a functional homolog of SEQ ID NO 1064 in the 11/479,226 US patent application
  misc_feature: The sequence is a functional homolog of SEQ ID NO 462 in the 10/412,699 US patent application
  misc_feature: Ceres ANNOT ID no. 8725710
  misc_feature (120)..(167): Pfam ID: Myb_DNA-binding Pfam Description: Myb-like DNA-binding domain
MARKCSSCGNNGHNSRTCSGHRCQVTSISINSTSTTTSCGSLRLFGVQLQVGSSPLKKCLSMECLSPIACYGAAAASSSLSPSVSSSSSSLASIEESSQRITGGYVSDGLVVRVQDRKKGVPWTEEEHRMFLAGLDKLGRGDWRGISRHFVTTRTPTQVASHAQKYFLRQNSLTQKKRRSSLFDADEGANKAALRRTASVSELQFPSLSPVAVDARTTKGAVPLPPCLNLMMSSASQCAGSGSGSSDASQTQNPSSLYLMAKPHQAQLQMPDLELKMSTSRLSEQPGGASRGTPLFGTIRVT

SEQ ID NO: 19306 - DNA, 1212 bp, Sorghum bicolor
  misc_feature: Ceres ANNOT ID no. 8725756
  misc_feature: Encodes the peptide sequence at SEQ ID NO 19307
atgccgctccaccaccccaagcaccgccaccacgacgacgacctcctcccctaccgccgctccgatgatgaggccaagccgcggcggccctacacccccaccttcccctcctcccccgcctccgctaaccgcctcctcctcttcttcgccgtcgcctgcctcgccctcgccgccgcctccttcgccttcgccatctccaccagccgtaaccgccagcccctgccgcagcctccgcctactgtcgccttccgctgcggacgcgccgaggactcgctccgctccttcctagcggcctcctcgcacggcaacttctccgccagcgacagggagaaggtgctcgctgtcgttggcgtacacacggagcacggcaacatctccgctgcccgacgcgctgcgctccgcgctacctggttcccgcccaaccccgaaggcatcgtcgcttataacttagatctctgggtcatctgctccaattgcaaatggtcactatttgagaacgcaatttttcaatcgggcggggtgggtttagaacatggaactggattgtcttttaggtttgtcactagacggccaaaggacaaagataaaatggaagatcttcagaaagaggcggatacttatcatgactttttgtttattgatgctgatgaggacacaaagcccccacagaagatgttagcatttttcaaagcagcttaccacatgttcaatgcagaattctatgtcaaagctaatgatgatatctacctgcgcccagatagacttgctgctcttcttgcaaaagaaagagctcagcacaagacatacattggttgcatgaagaagggaccagttgtcaatgatccaaatatgaaatggtacgaaagttcttgggaacttttgggtaacgagtacttcatgcatgcttctggttcactatatgctctttcttctgaggtggttgaagctctagctactacaaagagtgatagcttaaggatgtttgattacgaagatgttacagtcggcgcatggatgcttgctatgaatgtaaagcatgaagacaacagagcaatgtgtgattcaatatgcactcctacctccattgctgtatgggacagtaagaaatgttcaggtacttgtaacatagctgacaaaataaagcagctccataacaccactgtgtgctcaaagagcccaacgttgccacctgaggtggaggaggaagaatag

SEQ ID NO: 19307 - protein, 403 aa, Sorghum bicolor
  misc_feature: Useful for making plants with altered carbohydrate content
  misc_feature: Functional homolog of the protein sequence given in SEQ ID NO 13800
  misc_feature: Ceres ANNOT ID no. 8725756
  misc_feature (200)..(347): SWISSPROT Homolog: EC 2.4.1.134 Galactosylxylosylprotein 3-beta-galactosyltransferase
  misc_feature (165)..(350): Pfam ID: Galactosyl_T Pfam Description: Galactosyltransferase
MPLHHPKHRHHDDDLLPYRRSDDEAKPRRPYTPTFPSSPASANRLLLFFAVACLALAAASFAFAISTSRNRQPLPQPPPTVAFRCGRAEDSLRSFLAASSHGNFSASDREKVLAVVGVHTEHGNISAARRAALRATWFPPNPEGIVAYNLDLWVICSNCKWSLFENAIFQSGGVGLEHGTGLSFRFVTRRPKDKDKMEDLQKEADTYHDFLFIDADEDTKPPQKMLAFFKAAYHMFNAEFYVKANDDIYLRPDRLAALLAKERAQHKTYIGCMKKGPVVNDPNMKWYESSWELLGNEYFMHASGSLYALSSEVVEALATTKSDSLRMFDYEDVTVGAWMLAMNVKHEDNRAMCDSICTPTSIAVWDSKKCSGTCNIADKIKQLHNTTVCSKSPTLPPEVEEEE

SEQ ID NO: 19308 - DNA, 822 bp, Sorghum bicolor
  misc_feature: Ceres ANNOT ID no. 8725895
  misc_feature: Encodes the peptide sequence at SEQ ID NO 19309
atgcacatccgagaagagcaagctatgccatcaacagtgacaggcatcatggtgtcgaccctgacttcggcggggctgaagctgaaggagccggcgacgatgtcccctggtggctccgcgtcggttgctgctggatttgggtctgctgcagagaggaacaacggcaggggcaagggcaagactgagatcaagcgcatcgagaacacgaccaacaggcaggtgaccttctgcaagcgccgcaacggcctcctcaagaaggcgtacgagctctccgtgctctgcgacgccgaggtcgcgctcatcgtcttctccagccgcggccgcctctacgagtactccaacaacagcgtgaaggccaccattgagaggtacaagaaggcaaacagtgacaactccagcgctgctggtacgattgcagaggtcacgattcagcactacaagcaggaatctgctaggctgaggcagcagatcactaacttgcagaactccaacagggccctgataggtgatatcacaaccatgagccccaaggacctcaaacacctggagactaggttagacaaagcacttggaaagattagagcaagaaaggaaatggagttgcagaatgacaacttgtacttaaggagcagggttgatgagaatgaaagggcacaacagacagtgaacatgatgggggcgccatcgacaagtgattatcagcagcagggttttattccttatgacccaataaggagcttcctgcagttcaacatcatgcagcagcctcagttttactcccagcaggaggaccggaaagacttcaacctaggtggaagatag

SEQ ID NO: 19309 - protein, 273 aa, Sorghum bicolor
  misc_feature: Useful for biocontainment applications
  misc_feature: Functional homolog of the protein sequence given in SEQ ID NO 13973
  misc_feature: The sequence is a functional homolog of SEQ ID NO 14 in the 10/666,642 US patent application
  misc_feature: Useful for making plants with altered alkaloid content
  misc_feature: Useful for making plants with altered lignin content
  misc_feature: Useful for making plants with modulated biomass
  misc_feature: Useful for making plants with modulated flowering time
  misc_feature: Functional homolog of the protein sequence given in SEQ ID NO 13528
  misc_feature: The sequence is a functional homolog of SEQ ID NO 32 in the 10/666,642 US patent application
  misc_feature: Useful for making plants with altered terpenoid content
  misc_feature: Functional homolog of the protein sequence given in SEQ ID NO 13438
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 1701 in the 10/412,699 US patent application
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: The sequence is a functional homolog of SEQ ID NO 1949 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8725895
  misc_feature (64)..(114): Pfam ID: SRF-TF Pfam Description: SRF-type transcription factor (DNA-binding and dimerisation domain)
  misc_feature (129)..(214): Pfam ID: K-box Pfam Description: K-box region
MHIREEQAMPSTVTGIMVSTLTSAGLKLKEPATMSPGGSASVAAGFGSAAERNNGRGKGKTEIKRIENTTNRQVTFCKRRNGLLKKAYELSVLCDAEVALIVFSSRGRLYEYSNNSVKATIERYKKANSDNSSAAGTIAEVTIQHYKQESARLRQQITNLQNSNRALIGDITTMSPKDLKHLETRLDKALGKIRARKEMELQNDNLYLRSRVDENERAQQTVNMMGAPSTSDYQQQGFIPYDPIRSFLQFNIMQQPQFYSQQEDRKDFNLGGR

SEQ ID NO: 19310 - DNA, 927 bp, Sorghum bicolor
  misc_feature: Ceres ANNOT ID no. 8725994
  misc_feature: Encodes the peptide sequence at SEQ ID NO 19311
atggcggacgcgaagcagcagccccagcagacggcggcggcggccgcggccaccaccggcgtctggaagacggtcaagcccttcgttaacggcggggcctccgggatgctcgccacctgcgtcatccagcctatcgacatggtcaaggtgaggatccagttgggtgagggctctgctggtcaggtcacaaggaacatgcttgcaaatgagggtgtccgttccttctacaagggtttgtctgccggtttgctaaggcaagcgacgtacacgactgctcgtcttggatcattcagggttctaactaacaaagcagttgaaaagaatgaagggaagccgttgcctctaattcagaaagcttttattggtctgactgctggagcaattggtgcttgtgttggtagtcctgctgatttggcactcattagaatgcaagctgattcgaccctgccagctgcacaacggcgcaactataagaatgcttttcatgcactctaccgtatcactgctgatgagggagtccttgcgctttggaagggtgcaggtccaactgttgtgagagctatggcactcaatatgggtatgcttgcttcctatgaccagagtgtcgagctatttagggacaaacttggtgcaggagaaatttctactgttgttggagccagtgctatttctggattcttcgcctcagcttgcagtttgccctttgactatgtgaagacacagattcagaagatgcaacctgatgcgaatggcaagtacccatacacagggtctttggactgtgccatgaagaccttcaagagcggtggtccattcaagttctacactggtttcccagtgtactgtgtcaggattgcaccccatgtcatgatgacctggatattcttgaatcagatccagaagcttgagaagaagattggcatatag

SEQ ID NO: 19311 - protein, 308 aa, Sorghum bicolor
  misc_feature: Useful for making plants with modulated biomass
  misc_feature: Functional homolog of the protein sequence given in SEQ ID NO 14700
  misc_feature: Ceres ANNOT ID no. 8725994
  misc_feature (114)..(209): Pfam ID: Mito_carr Pfam Description: Mitochondrial carrier protein
  misc_feature (213)..(307): Pfam ID: Mito_carr Pfam Description: Mitochondrial carrier protein
  misc_feature (23)..(108): Pfam ID: Mito_carr Pfam Description: Mitochondrial carrier protein
MADAKQQPQQTAAAAAATTGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLIQKAFIGLTAGAIGACVGSPADLALIRMQADSTLPAAQRRNYKNAFHALYRITADEGVLALWKGAGPTVVRAMALNMGMLASYDQSVELFRDKLGAGEISTVVGASAISGFFASACSLPFDYVKTQIQKMQPDANGKYPYTGSLDCAMKTFKSGGPFKFYTGFPVYCVRIAPHVMMTWIFLNQIQKLEKKIGI

SEQ ID NO: 19312 - DNA, 2493 bp, Sorghum bicolor
  misc_feature: Ceres ANNOT ID no. 8726072
  misc_feature: Encodes the peptide sequence at SEQ ID NO 19313
atggccaccgtccgctccaccctctcccccagtctcccaccgccatctccatcttcacctcccgcccacacccccgcggccacctctccccgccaccgcaagcatctcaacacgaccgcagccgggcaggcggctctcgagccgtccgaagcggcggcgctcctcacggccgcggcgcgcgcccgcgacctccgcctgggccgcgctctccacgcccgcctcctccgcaccgggtcactcctcgacgccgacgccgtcgtcaccaactcgctcctcacgctctactccaagtgcggcgccgtggtcgccgcgcgcagcgtgttcgacggaatgcccgttggcctgcgggacctcgtctcctggacggcaatggcgtcctgcctgtcgcgaaacggcgcggaggccgaggcgctccgcctgttcggcgagacgctcgaggagggtctcctgccgaacgcgttcacgctgtgcgccgcggcccaggcctgctttctcaccgagctcttccactcggctggtggcgcggttcttggtttggtgttcaaattgggtttctggggtactgatgtctcggtgggttgcgctctgattgacatgttcgcgaagaatggggatttggtggcggcgcgcagggtgtttgatggattgttcgagaggacggttgtcgtctggacattgctgattacacggtatgcgcagagtggctattctgatgaggctgcagaattgtttcttgacatgctggagaatggatttcagccggatcaatacaccatgagcagtatgttatcggcttgtacagagttgggatcattcaggttggggcagcaactgcactctctagcgctcaggcttggactggaatcagatagttgcgtgagctgtgggcttgtggacatgtatgcaaagtctcacaatggacattccttgcacaatgcgaggaaagtcttcaatcggatgccaaagcataatgtgatgtcatggacagcacttttgtcagggtatgtgcagcgtggatcgcaggacaaccaggtgatgatactgttttgcgagatgttaaatgaaggcatcagaccaaaccatatcacatattctagtatgcttaaggcgtgtgcaaaccttggtgatcaagattcaggcaggcaaattcatacccattgcgtcaaatccagcctagctgacttaaatgttgttgggaatgctctagtaagcatgtatgctgaatctggttccatggaacaagctagacatgcgttcgaccagctgtatgaaaagaacatggtatccttcaacaacaatttagatggagatgggaggagcaacacttatcaagattatcagattgaaagaatggagttaggaatcaacactttcacatttgctagtctgatcagtggcgctgctactgtagggttcctaaccagaggccaacagctgcatgccctctcactgaaggctggatttgggtcagatagagccataggcaactctcttgtgtctatgtattctaggtgtggatacctagtagatgcttgccaagcctttgatgaaatggatgaccataatgtgatctcatggacttcaatgattagtggtttggcaaaacatgggtatgcagcgagagctctggaattgtttcatgatatgatcgcagctggggtgaaaccaaatgatgtcacatacattgctgttttatctgcatgtagtcatgctggtctagttaaagaagggcaggagcactttagaatgatgcagaaggatcatggactcataccaaggatggagcattatgcttgcatggttgatctgcttggaagatcaggccttgttgaagaagcactagatttcatcaacgaaatgccttgtcaagcagacgcattggtctggaagacactccttggtgcctgtaagacccacaacaacatggatatcggtgagattgctgctaaccacgtcatacagctcgaaccacaagatccagccccctatgtcttgctctccaacttgtatgcagatgctggtttgtgggatcaagtagctaggctaaggagtctaatgagggataaaaacttgatgaaagaaaaagggttgagctggatgcatgttgagaacaccattcacgagtttcgagctggtgataccaaccatccacaagcagaggagatctatacgaagttggagacgctgataagagaaatcaaagtcataggctatgtaccagacaccagcatagtgctccatgacatgtcggatgagcttaaggagctttgtctgcttcagcacagcgagaagattgctgttgcattcggtttgatcagttgtacatcagcaataaaaccaataaggatatttaagaacctccgtgtatgcgctgattgtcattcagcactcaagtatgtctctaaggccactggtagggagataattctgagagatagcaacagattccacaggatgaaggatggggaatgctcatgcggagaatactggtaa

SEQ ID NO: 19313 - protein, 830 aa, Sorghum bicolor
  misc_feature: Useful for making plants with altered cell wall content and/or composition
  misc_feature: Functional homolog of the protein sequence given in SEQ ID NO 14701
  misc_feature: Ceres ANNOT ID no. 8726072
  misc_feature (524)..(558): Pfam ID: PPR Pfam Description: PPR repeat
  misc_feature (222)..(256): Pfam ID: PPR Pfam Description: PPR repeat
  misc_feature (119)..(153): Pfam ID: PPR Pfam Description: PPR repeat
MATVRSTLSPSLPPPSPSSPPAHTPAATSPRHRKHLNTTAAGQAALEPSEAAALLTAAARARDLRLGRALHARLLRTGSLLDADAVVTNSLLTLYSKCGAVVAARSVFDGMPVGLRDLVSWTAMASCLSRNGAEAEALRLFGETLEEGLLPNAFTLCAAAQACFLTELFHSAGGAVLGLVFKLGFWGTDVSVGCALIDMFAKNGDLVAARRVFDGLFERTVVVWTLLITRYAQSGYSDEAAELFLDMLENGFQPDQYTMSSMLSACTELGSFRLGQQLHSLALRLGLESDSCVSCGLVDMYAKSHNGHSLHNARKVFNRMPKHNVMSWTALLSGYVQRGSQDNQVMILFCEMLNEGIRPNHITYSSMLKACANLGDQDSGRQIHTHCVKSSLADLNVVGNALVSMYAESGSMEQARHAFDQLYEKNMVSFNNNLDGDGRSNTYQDYQIERMELGINTFTFASLISGAATVGFLTRGQQLHALSLKAGFGSDRAIGNSLVSMYSRCGYLVDACQAFDEMDDHNVISWTSMISGLAKHGYAARALELFHDMIAAGVKPNDVTYIAVLSACSHAGLVKEGQEHFRMMQKDHGLIPRMEHYACMVDLLGRSGLVEEALDFINEMPCQADALVWKTLLGACKTHNNMDIGEIAANHVIQLEPQDPAPYVLLSNLYADAGLWDQVARLRSLMRDKNLMKEKGLSWMHVENTIHEFRAGDTNHPQAEEIYTKLETLIREIKVIGYVPDTSIVLHDMSDELKELCLLQHSEKIAVAFGLISCTSAIKPIRIFKNLRVCADCHSALKYVSKATGREIILRDSNRFHRMKDGECSCGEYW

SEQ ID NO: 19314 - DNA, 1884 bp, Sorghum bicolor
  misc_feature: Ceres ANNOT ID no. 8726076
  misc_feature: Encodes the peptide sequence at SEQ ID NO 19315
atggccatgaacgtgattgcgctacttggcctcttggcagttgcatcggtggtgaggacggcttccggcgccggcggccatgactacgcctcggcattgaagaagaccatcctctacttcgaggcacagcggtccggcgtcctcccgcccaaccagcgggtcacctggagagggaactccggtctcttcgacggcaaggccaacggagtggacctcgtcggagggtattatgacgcaggggacaacgtgaagttcggcctgccgatggcgttcacggtgaccatgatgtcgtggggcatcctggagtacggcagacagatggcggcggccggggagctgcgcaacgccatggacgccgtcaagtggggcaccgactacttcatcaaggcccacccggagcccgaggtgctgtacggcgaggtgggcgacggcgacacggaccacagctgctggcagcggcccgaggacatgtccaccagccgccagtccttccgcattgacccccagaaccccgggtccgacctcgccggagagaccgccgcggccatggccgccgcgtccctcgtcttccgcaacacctacccgggctacgccaacctgctccttgaacatgccaagcagctgttccagttcgccgacaagtaccgtggcaagtacgacgccagcatccccgtcgctcgcaactactacggatccttcagcggatatggggatgagcttctgtgggcggcggcgtggctgtacgaggcgacggaggaagggtgctacctcgagtacctggcccgcaacggcgacgctctgggcggcacgggctggtccatcaaccagttcggctgggacgtcaagtaccccggcgtgcaggtgctggcagcaaagttcctcctgcagggccgtgccggcgcgcacgccgcggcgctgcagcggtaccggcagaacgccgagttcttcgtgtgctcctgcgtcggcaagggcgccgtgaacgtgccgcggacacccggcggcgtcatgtaccaccagcgctggaacaacctgcagttcgtcaccagcgcgtcgttcctgctgacggtgtacgcggactacgccacggcgctacccggcagctccggcggcgccgtgcggtgccccgcgggcgccgcgcggcccttcgagatcctcgccttcgtcaggtcccaggtgaactacatcctcggcgacaacccgcggggcaccagctacatggtcgggtacggcggcagcttcccgcggcaggtgcaccaccgcggcgcctccatcgtgtccgtcaggacggacccgtccttcgtcagctgccaggaagggtactccgcctggtacccgaggcaggccggcaacccaaacgtcctggagggcgccatcgtcggcgggcccgacgagtacgacgacttcgccgacgagcggaacaactacgagcagacggaggccgccacatacaacagcgcgccgctgctcggtgtcctcgcccgcctcgccggcgcctgcggcaccgggctggaagagtaccagctgccacccccggaggccgccgcgaacgagacgtcgtcgccgtctcaccgtcgccgacatcacgcgccgtcgtcgtccccgatcgagatcgagcagaacgtgacgaggacgtgggcgaggcgccgcacgacgtactaccgctactcggtgacggtgaccaacaggtcgaggaagaccgtccgggagctccacctcggcgtctcggagctccgtggccggctctggggcctcgacagggcaaggtacgggtacgtgccgcccaagtggctgccggcgttgcgcgctggtaagagcctcaggttcgtgtacgtccagcacgggacgccggccaacgtctgggtcaccggctacaagctactctga

SEQ ID NO: 19315 - protein, 627 aa, Sorghum bicolor
  misc_feature: Useful for making plants with altered cell wall content and/or composition
  misc_feature: Functional homolog of the protein sequence given in SEQ ID NO 14702
  misc_feature: Useful for making plants with altered carbohydrate content
  misc_feature: Functional homolog of the protein sequence given in SEQ ID NO 14506
  misc_feature: Useful for making plants with altered lignin content
  misc_feature: Functional homolog of the protein sequence given in SEQ ID NO 13875
  misc_feature: Ceres ANNOT ID no. 8726076
  misc_feature (25)..(627): SWISSPROT Homolog: EC 3.2.1.4 Cellulase
  misc_feature (28)..(493): Pfam ID: Glyco_hydro_9 Pfam Description: Glycosyl hydrolase family 9
MAMNVIALLGLLAVASVVRTASGAGGHDYASALKKTILYFEAQRSGVLPPNQRVTWRGNSGLFDGKANGVDLVGGYYDAGDNVKFGLPMAFTVTMMSWGILEYGRQMAAAGELRNAMDAVKWGTDYFIKAHPEPEVLYGEVGDGDTDHSCWQRPEDMSTSRQSFRIDPQNPGSDLAGETAAAMAAASLVFRNTYPGYANLLLEHAKQLFQFADKYRGKYDASIPVARNYYGSFSGYGDELLWAAAWLYEATEEGCYLEYLARNGDALGGTGWSINQFGWDVKYPGVQVLAAKFLLQGRAGAHAAALQRYRQNAEFFVCSCVGKGAVNVPRTPGGVMYHQRWNNLQFVTSASFLLTVYADYATALPGSSGGAVRCPAGAARPFEILAFVRSQVNYILGDNPRGTSYMVGYGGSFPRQVHHRGASIVSVRTDPSFVSCQEGYSAWYPRQAGNPNVLEGAIVGGPDEYDDFADERNNYEQTEAATYNSAPLLGVLARLAGACGTGLEEYQLPPPEAAANETSSPSHRRRHHAPSSSPIEIEQNVTRTWARRRTTYYRYSVTVTNRSRKTVRELHLGVSELRGRLWGLDRARYGYVPPKWLPALRAGKSLRFVYVQHGTPANVWVTGYKLL

SEQ ID NO: 19316 - DNA, 219 bp, Sorghum bicolor
  misc_feature: Ceres ANNOT ID no. 8726250
  misc_feature: Encodes the peptide sequence at SEQ ID NO 19317
atggcaagaactccactactgggtctcgccatcgccgcggcgctcgtcttcgccgtcgccatgccggccgtcgccgatgcgcaggcccccgccccggcgcccaccagcgacgggacgtcgattgaccagggcattgcgtacctgctgatgatcgtggcgctggtgctcacctacctcatccatcctctggacgcctcctccccatacaggctcttctga

SEQ ID NO: 19317 - protein, 72 aa, Sorghum bicolor
  misc_feature: Useful for making plants with altered carbohydrate content
  misc_feature: Functional homolog of the protein sequence given in SEQ ID NO 14436
  misc_feature: Useful for making plants with altered cell wall content and/or composition
  misc_feature: Useful for making plants with modulated nitrogen use efficiency
  misc_feature: Useful for making plants with modulated salt sensitivity
  misc_feature: Functional homolog of the protein sequence given in SEQ ID NO 14437
  misc_feature: Ceres ANNOT ID no. 8726250
MARTPLLGLAIAAALVFAVAMPAVADAQAPAPAPTSDGTSIDQGIAYLLMIVALVLTYLIHPLDASSPYRLF

SEQ ID NO: 19318 - DNA, 2067 bp, Sorghum bicolor
  misc_feature: Ceres ANNOT ID no. 8726273
  misc_feature: Encodes the peptide sequence at SEQ ID NO 19319
atggccacacggtggcccaatcccctctgctttcctccccagatcgccggcgttgccttgacctttctcgtcgccgtcctccacacaccaccgttcacctctgctcaagagcaaccgccgccgtggctcctgtgcggcccctaccctcccagtggcaactacacggagaacagcacctaccaaggaaacatcaaccgactctccggcaccctccccaagaacgtctcctccagtccggtcctctacggcacgggcagcgtcggctccgtcccggacatcgtctacgcgctcgccctgtgccgtggcgacgccaacgcctcctcctgcgagagctgcgtggcgaccgcgttccagggcgcgcagaaggggtgcccacacttcaaggacgtcttgatcttctacgacctctgccagctccgcttctccaaccgcaacttcttcccggacgacgacaatttcgccaccgcgtactacctcgtgggatcccaggtggtgagcaagccgacggacgcgttcgacgccgccgtccgcctgctcgtcaacaccaccgccggctacgcagccgggaactcgtccaggaggttcgccacgggggaggagggtttcgatgggagcaaccccaggatttacgcgctggcgcagtgcacgccggacaagacggtggacttctgccagggctgttttggccccattattaaccggatgcccgaggttttcagtggggtcaatggcgggggagttttcggcacctggtgcagcttccggtatgaggtgtaccctttcttctccggccgcccactcctacagcttccagtcttcgttgggatgccgccggcgccggccactagaagccaagagaaatcgatgaataaggccggtaaagtattagcaattttgatgcctgcaattgctgcaatgctgatcataaccgtcatatgcttttggacaaggcggagaagattagcagcacaatcttttgaaccttactcaactagttcagaggatattcaaggagacgatatgctccttctcgatctgtcaacactgcgtgttgctacagaagactttgccgaaacaaaaatgctgggtaaaggaggcttcggtatggtttataagggagtcctacctgatggtcaagaaattgcagttaaaaggctttgccacagttccagacaaggaattgaagagctgaaaagcgagctagttctggttgctaagcttcaccacaagaaccttgtgagacttgtcggtgtttgtttgcaagaacatgagaaaatacttgtttatgaatatatgccaaatagaagccttgataccgttctttttgattgtgagagaaacaacgagctagattgggcaaaaagatttaatattatcagtggaatcgctagaggcttacaatatctccatgaagattctcaactgaagatagttcaccgggacctgaaagtgagtaacatcctattagactttgattatgtacctaagatctctgacttcggcttagcaaagatttttgatggagatcaatcaaaatatgtcactcgtcgtgtcgctgggacatatggttacatggcacccgaatacgccatgcgtggtctgtattcaatcaagtcggacgtgtttagcttcggtgttttggttctagagattgttactggaagaagaaacggtggcttatataacagcgagcaagatgttgatctcttaaatcttgtgtgggagcactgggccaggggaaatgtggtcgggttgatcgatccatcactgaacgaccatcatcatcctcccatcgagcagatcctgaagtgcattcacatcgggcttctgtgtgttcaaagaaaccctgctgccaggccggtgatgtcgtgggtaaacgtgatgcttagcagcagcacggtgcgcctcccttctctttccaggccagccttgtgcatccaggaggttagtgccactgacagttcagatgcgtattcgccggaacggccaggagcttcagggtacacggatagctcagtgttgatgtcatgtaacgaggcatccatcacggagctctctccaagatga

SEQ ID NO: 19319 - protein, 688 aa, Sorghum bicolor
  misc_feature: Useful for making plants with altered carbohydrate content
  misc_feature: Functional homolog of the protein sequence given in SEQ ID NO 14360
  misc_feature: Ceres ANNOT ID no. 8726273
  misc_feature (262)..(629): SWISSPROT Homolog: EC 2.7.11.1 Non-specific serine/threonine protein kinase
  misc_feature (356)..(625): Pfam ID: Pkinase Pfam Description: Protein kinase domain
MATRWPNPLCFPPQIAGVALTFLVAVLHTPPFTSAQEQPPPWLLCGPYPPSGNYTENSTYQGNINRLSGTLPKNVSSSPVLYGTGSVGSVPDIVYALALCRGDANASSCESCVATAFQGAQKGCPHFKDVLIFYDLCQLRFSNRNFFPDDDNFATAYYLVGSQVVSKPTDAFDAAVRLLVNTTAGYAAGNSSRRFATGEEGFDGSNPRIYALAQCTPDKTVDFCQGCFGPIINRMPEVFSGVNGGGVFGTWCSFRYEVYPFFSGRPLLQLPVFVGMPPAPATRSQEKSMNKAGKVLAILMPAIAAMLIITVICFWTRRRRLAAQSFEPYSTSSEDIQGDDMLLLDLSTLRVATEDFAETKMLGKGGFGMVYKGVLPDGQEIAVKRLCHSSRQGIEELKSELVLVAKLHHKNLVRLVGVCLQEHEKILVYEYMPNRSLDTVLFDCERNNELDWAKRFNIISGIARGLQYLHEDSQLKIVHRDLKVSNILLDFDYVPKISDFGLAKIFDGDQSKYVTRRVAGTYGYMAPEYAMRGLYSIKSDVFSFGVLVLEIVTGRRNGGLYNSEQDVDLLNLVWEHWARGNVVGLIDPSLNDHHHPPIEQILKCIHIGLLCVQRNPAARPVMSWVNVMLSSSTVRLPSLSRPALCIQEVSATDSSDAYSPERPGASGYTDSSVLMSCNEASITELSPR

SEQ ID NO: 19320 - DNA, 2859 bp, Sorghum bicolor
  misc_feature: Ceres ANNOT ID no. 8726500
  misc_feature: Encodes the peptide sequence at SEQ ID NO 19321
atgatgacgggtgaaaagcaaatgacttcgaagggcacagagtcttcatcttcttctgttcctcctgatggagtagtcagcagggaacctcaaaaaggggggagattacccaatgggaggacaactggtccagcacgtcgctcatccaagggaaattggactccagaagaggatgacatacttcgcgaagctgttgaaacttacaagggaaaaaattggaaaaagatagctgaatcttttccaggtaggactgatgttcaatgtttgcataggtggcagaaggttttgaaccctgaacttgttaaagggccatggtccaaagaagaagatgagatcattattcagatggtaaacaaacatgggccaaagaaatggtcgaccatagcccaagctcttcctggacgtattggaaagcaatgtcgggaaagatggcacaaccatcttaatcctgggatcaataaggacgcatggacacaagacgaggaaatcaggctcatccatgctcatcaaacttatggaaacaaatgggctgagttgacaaagtttttaccaggaaggacagacaatgcaattaaaaatcattggcacagctcggtgaagaagaaagttgattcatacagatcatctggtttactggctcaattccagggtctgacacctgttgaatacactcctggtggtttaaatgttgattcttcatctgccatgaccaatcaaattagcgaagacagtggttttaatgtttttcgggaggctgaagattcaatggagttaagtcaatcatcgtttgccaagggttcttgctctcaggaggagcaaactgatgtgactttgggatctcatttgcatgtgcatgaatctttgtgtcaagatggtttcaataatgctgagaatggtgcttctgctttacctgacatgcatcaccacttatccacttctgacatggatcaagataaacacttgcaggaaggaatggatttggataaacacttgcagctagagttttctcaaggaatagatttgcatcttgatacagatgaagtgccaaacaactttgtgataagagatagccaggcatccaatgagcttgcagttcaatttcaggacagacagactatgaatagttcagaaaatgatggagtatctttgataccatatgctgtaacgccatgtgttcccatcttacctagtgtttctggatgtgagcataacataaatgtgatgtccgaagtgggcattaaaaatgataattgtttccaatctgaaaagtggcaggatatttccattcaatcaggtgcatattcttctgaagctgcaagcaacttttcagcaccactttacccattgcagacagctgaaccagtaacaatgatgggtggccctgtgtattatcagagttctgtaacgtcattaccaccggacttcatttcttcagatggtgcttctaatgcatctggtgtcaaatttgagacaaatcacaatcctgtttctcgccaaggtttggagattaaaacttgccacaatccttccggtgatcctgatcaaaattcatatatgtgcagcgaagatgacagaaacaggacttctgaaccaatggacagcataccagaatctgaaaaggaacagcaggttgatgttgaacagtcatgtttggagcctgcagcctacagttttaaggaaccattatcaagtcatggtgacaccatattaaatgaaaaggaggatgctggagctctatgctatgaacctccttgctttccaagttttgaagttccttttgtcagctgtgagcttgtaaactccagcgatctcccagaatatagtcctcttggcattcgagagttgatgaggacgaccttgaacttccctaccccagtaagattgtggggatcccctcctagggatggtagtcctgatgctgtcttaaagaatgctgccaaaagattcgtgtgcaccccgtccataatgaaaaaaaggcctagagacctatcatctcctggtcctgatataagaaacgaaaagaaatcaaatactgaaaaggattgtaggagctcaggcatgtcctctacaagagttgggaaatcttgcatggatagccctgatgattcagctgatttagtttcaccaaaagagacaactgcatttcaaaagaacgtcaagctttctcacgaaaacaaagaaaacttgaatggaattactgatcaaggagaaaatgaaggcaatgcaaagcattctacagggattcttactaagagcagtgtcgacaaccacaatactcctaagcatggtccaaattttcaaagtcaggggctaaataccagtgcgcaggtgtctaactctaaagacataatattttctagatcaaagccatcagaacttcttgttgataaatctgcagcctgcgttgatgcagattatgaattggctgatactccaggtattaaaagaggcttagaatctccttctgcatggaagtctcctttgttcacaccattcccggatgcatacttcatgagcccagctagcagagcttttgatgccttaggattggtgaagcagattaatgagcagagtgctgctgctgtggaggaagcacatgaagttctggcaagtggaggcccatggaaacgacataacaaggaaaactctgacaaagaaaatatagaaaatacaactttgaagcatgaacatgtaacaagcaaacctccatccatactcatggcagaggcacgggtgctcgatttcaatgaatgctccacacctgtgaggaagaaagaagataagaaatcggaaatagctttaggaggatcttcaagctcccctgttacttcctcgtatcttcggatgaatttgcggtag

SEQ ID NO: 19321 - protein, 952 aa, Sorghum bicolor
  misc_feature: The sequence is a functional homolog of SEQ ID NO 2684 in the 10/374,780 US patent application
  misc_feature: The sequence is a functional homolog of SEQ ID NO 844 in the 10/225,066 US patent application
  misc_feature: Ceres ANNOT ID no. 8726500
  misc_feature (50)..(96): Pfam ID: Myb_DNA-binding Pfam Description: Myb-like DNA-binding domain
  misc_feature (102)..(148): Pfam ID: Myb_DNA-binding Pfam Description: Myb-like DNA-binding domain
  misc_feature (154)..(199): Pfam ID: Myb_DNA-binding Pfam Description: Myb-like DNA-binding domain
MMTGEKQMTSKGTESSSSSVPPDGVVSREPQKGGRLPNGRTTGPARRSSKGNWTPEEDDILREAVETYKGKNWKKIAESFPGRTDVQCLHRWQKVLNPELVKGPWSKEEDEIIIQMVNKHGPKKWSTIAQALPGRIGKQCRERWHNHLNPGINKDAWTQDEEIRLIHAHQTYGNKWAELTKFLPGRTDNAIKNHWHSSVKKKVDSYRSSGLLAQFQGLTPVEYTPGGLNVDSSSAMTNQISEDSGFNVFREAEDSMELSQSSFAKGSCSQEEQTDVTLGSHLHVHESLCQDGFNNAENGASALPDMHHHLSTSDMDQDKHLQEGMDLDKHLQLEFSQGIDLHLDTDEVPNNFVIRDSQASNELAVQFQDRQTMNSSENDGVSLIPYAVTPCVPILPSVSGCEHNINVMSEVGIKNDNCFQSEKWQDISIQSGAYSSEAASNFSAPLYPLQTAEPVTMMGGPVYYQSSVTSLPPDFISSDGASNASGVKFETNHNPVSRQGLEIKTCHNPSGDPDQNSYMCSEDDRNRTSEPMDSIPESEKEQQVDVEQSCLEPAAYSFKEPLSSHGDTILNEKEDAGALCYEPPCFPSFEVPFVSCELVNSSDLPEYSPLGIRELMRTTLNFPTPVRLWGSPPRDGSPDAVLKNAAKRFVCTPSIMKKRPRDLSSPGPDIRNEKKSNTEKDCRSSGMSSTRVGKSCMDSPDDSADLVSPKETTAFQKNVKLSHENKENLNGITDQGENEGNAKHSTGILTKSSVDNHNTPKHGPNFQSQGLNTSAQVSNSKDIIFSRSKPSELLVDKSAACVDADYELADTPGIKRGLESPSAWKSPLFTPFPDAYFMSPASRAFDALGLVKQINEQSAAAVEEAHEVLASGGPWKRHNKENSDKENIENTTLKHEHVTSKPPSILMAEARVLDFNECSTPVRKKEDKKSEIALGGSSSSPVTSSYLRMNLR

SEQ ID NO: 19322 - DNA, 882 bp, Sorghum bicolor
  misc_feature: Ceres ANNOT ID no. 8726576
  misc_feature: Encodes the peptide sequence at SEQ ID NO 19323
atggaagacccaatgatccaattgcagcatattaaactcaaagcaacaccaccaagagctaaccaaagaagagaaccaattgaaccctccaaaagcttgaatttacaacaactaaaagaggccaagaggataaaagaagcgctaggcacactgctgcagcgaacttttggtgactggttggaaggaggtgttggtggcccgtgcagcggcggactggcggcagggagagcgatgagcgcggcggcggcgagctcggtcaccaagttcatcaagtgcgtcacggtcggcgatggggccgtcgggaagacctgcatgctcatctgctacacctgcaacaagttcccgacggattatatccccactgtatttgacaacttcagcgccaatgtctctgtggatgggagcattgtcaacttgggcctctgggacacggcaggtcaggaggattacagcagattgaggcctctcagctacaggggggctgatgtgttcatcctctccttctccctggtcagcagggcgagctatgagaatgtcttgaagaagtggatgccagagcttcgccgattttcacctagtgttccggtagttcttgttggaaccaaactagatctccgtgaagacagatcttaccttgctgaccattctgctgcttccatcatctctaccgaacagggagaagagctcagaaagcagataggtgctgtggcatacatagaatgcagctcaaagacacagaggaacataaaggctgtgttcgacactgcaattaaagtagtgctgcaaccaccaaggagaagagaagttaccaggaagaaaatgaagaaaagttcgaatcagtctgtgagaagatacctctgtggaagtgcatgtttcacatga

SEQ ID NO: 19323 - protein, 293 aa, Sorghum bicolor
  misc_feature: Useful for making plants with modulated nitrogen use efficiency
  misc_feature: Functional homolog of the protein sequence given in SEQ ID NO 13110
  misc_feature: Ceres ANNOT ID no. 8726576
  misc_feature (91)..(262): Pfam ID: Ras Pfam Description: Ras family
  misc_feature (91)..(204): Pfam ID: Miro Pfam Description: Miro-like protein
MEDPMIQLQHIKLKATPPRANQRREPIEPSKSLNLQQLKEAKRIKEALGTLLQRTFGDWLEGGVGGPCSGGLAAGRAMSAAAASSVTKFIKCVTVGDGAVGKTCMLICYTCNKFPTDYIPTVFDNFSANVSVDGSIVNLGLWDTAGQEDYSRLRPLSYRGADVFILSFSLVSRASYENVLKKWMPELRRFSPSVPVVLVGTKLDLREDRSYLADHSAASIISTEQGEELRKQIGAVAYIECSSKTQRNIKAVFDTAIKVVLQPPRRREVTRKKMKKSSNQSVRRYLCGSACFT

SEQ ID NO: 19324 - DNA, 288 bp, Sorghum bicolor
  misc_feature: Ceres ANNOT ID no. 8726585
  misc_feature: Encodes the peptide sequence at SEQ ID NO 19325
atgccactgctctgctctactctgctctggtcgctgccctctccactgtcaaatgtcgaactacttgctcctaaccgcaaatgccactgcaacgcgacaccactgctccactggattgcaccgtgcaatgcgctatgctccaacatcaccacgctgggaccactcatgctcccaatgtccgagcaactccagttcctggccgccgcactgctccgtcgcgtcgctcatggagccatgaagatgaagccctacgtgtcggacttcaagctgacactagagcacttctaa

SEQ ID NO: 19325 - protein, 95 aa, Sorghum bicolor
  misc_feature: The sequence is a functional homolog of SEQ ID NO 2 in US patent 7038112
  misc_feature: Ceres ANNOT ID no. 8726585
  misc_feature (43)..(95): SWISSPROT Homolog: EC 2.3.1.119 Icosanoyl-CoA synthase
MPLLCSTLLWSLPSPLSNVELLAPNRKCHCNATPLLHWIAPCNALCSNITTLGPLMLPMSEQLQFLAAALLRRVAHGAMKMKPYVSDFKLTLEHF

SEQ ID NO: 19326 - DNA, 1356 bp, Sorghum bicolor
  misc_feature: Ceres ANNOT ID no. 8726759
  misc_feature: Encodes the peptide sequence at SEQ ID NO 19327
atggcgcgcctcctcctccccctccccttcgcggcggccgccgccgcctctgcctcatcgctccacctcgccgcctcccgccttcgtctccccgcggtctccgtcgcgcggcgcgagtgtctctacgggggaagggtggtaggaggagtggtgagggcgccggcgaggcttggtaagcgcgggttgtgcgccggcgcggaggctggcggctcggccggtacggtggtcgggcaggaggaggctttggagtgggtcaagaaggaccggaggcgcctgctccacgtcgtctaccgcgtcggggacctcgacaagacgatcaagttctacacggagtgcctgggcatgaagctgctgaggaagagggacattccggaggagaggtacaccaatgcctttttggggtacgggcctgaggattcgcattttgttgtggagctcacttacaattatggtgtggagagctatgacattgggactgcttttggccactttggaattgctgttgatgatgttgcaaaaacggtggaacttattaaagcaaaaggaggaacagtcacaagggagccaggtcctgtcaaaggtgggaagtcagtaattgcctttattgaggatcctgatggttacaagtttgagcttatagaaaggggtcctactcctgagcctctgtgccaggtaatgcttcgagtgggagatcttgatcgtgctataaatttctatgagaaggcatttggcatggaacttcttcgcaagcgagacaatcctgagtacaagtatacaattgcgatgatgggatatggtccagaagacaaaaatgctgtactggagttgacctacaactatggggtgaaggaatatgacaagggaaatgcttatgcacagattgctattagtactgatgatgtctacaagactgcggaagcaattagagtaaatggtggacgaattactcgtgagcctggtccattacctggcattaacaccaagataactgcatgcacagatcctgatggctggaaaacaagaggtgagcgtttggtaggccgacttgaagccgtgcatgagctcaaaggtgtttgtgatgaagaccaccacgcagccgccagagaggagaccagcaatggcgttgccagacactttgccaacccatgcacagaagatgaagagggtggcaatggctgccacgagagcatagccgacgagggagacatgggtgggcatctggtcgctctgaatgttctgccagaagcgttggcaggaaagactagagcggttgtgcatggtgacgtggtgtccgaggtgcaatggaggtgggtgtttgtcgataacatagattttctgaaggagttggaagaatga

SEQ ID NO: 19327 - protein, 451 aa, Sorghum bicolor
  misc_feature: Useful for making plants with modulated nitrogen use efficiency
  misc_feature: Functional homolog of the protein sequence given in SEQ ID NO 13155
  misc_feature: Ceres ANNOT ID no. 8726759
  misc_feature (79)..(339): SWISSPROT Homolog: EC 4.4.1.5 Lactoylglutathione lyase
  misc_feature (91)..(212): Pfam ID: Glyoxalase Pfam Description: Glyoxalase/Bleomycin resistance protein/Dioxygenase superfamily
  misc_feature (221)..(342): Pfam ID: Glyoxalase Pfam Description: Glyoxalase/Bleomycin resistance protein/Dioxygenase superfamily
MARLLLPLPFAAAAAASASSLHLAASRLRLPAVSVARRECLYGGRVVGGVVRAPARLGKRGLCAGAEAGGSAGTVVGQEEALEWVKKDRRRLLHVVYRVGDLDKTIKFYTECLGMKLLRKRDIPEERYTNAFLGYGPEDSHFVVELTYNYGVESYDIGTAFGHFGIAVDDVAKTVELIKAKGGTVTREPGPVKGGKSVIAFIEDPDGYKFELIERGPTPEPLCQVMLRVGDLDRAINFYEKAFGMELLRKRDNPEYKYTIAMMGYGPEDKNAVLELTYNYGVKEYDKGNAYAQIAISTDDVYKTAEAIRVNGGRITREPGPLPGINTKITACTDPDGWKTRGERLVGRLEAVHELKGVCDEDHHAAAREETSNGVARHFANPCTEDEEGGNGCHESIADEGDMGGHLVALNVLPEALAGKTRAVVHGDVVSEVQWRWVFVDNIDFLKELEE

SEQ ID NO: 19328 - DNA, 1209 bp, Sorghum bicolor
  misc_feature: Ceres ANNOT ID no. 8726811
  misc_feature: Encodes the peptide sequence at SEQ ID NO 19329
atggcggaccagcaacagccacaacaggaggagatgaacattgtccgtgttggtggcctcgacctacttccagggttccgcttccatccgaatgactttgagattgtcaatgactacctcatgaaaaaggtgcacaacagggacttcatctgtgccatcggggaggttgacttaaataagaccgaaccatgggatctcccaagggaggcaaaaatgaatgagaaagagtggtacttcttctcaaagaaggaccgcaagtacccaacggggctaagggcaaacagggccacagaagctggttattggaaggcgaccggcaaggacaaggaggtatacaagcctagcaaaggggaaggtgtggtgctactcatcggcatgaagaaaacacttgtcttctatgaaggcagggctccgaggggcaacaaaacaaactgggtgatgcacgagtataggctcgaaggcaatagcagggtccctagccccacatctgcatccagctcaacgaccaatgccaccatagccataaaagggtcagcttttgtttccaaggatgagtgggtgatctgtcgtgtgttccacaagaccactggaatcaggaagacaacaataccggcataccaagtggccatgcccgatgctgagattgatcagaatcagaacaataccttggccattcccgtccctatgcagctgcaactaccacagtccatgcccatgccaatgcaatgtcccatcctgccagacttctccatggacccagtacccccctactaccctaactccaacactggcatagggatgccactagtgatgccacctatggccggtatcggtggcactggtgggctccagatcaatggttccctattcaacaatccgatggttgtgccaccatcaatgaacttctaccaccagatgggcatggggtcatccgctgggcaaatgggaacaggggaaccaataggccagatggacatgggggcactagtaggccagatgggcattggacctgttgcccagatggacatgggagcagctagcgctagcggcttcaatgttgctatgtcggagagtagaccatcctcgatggtgttgcagaaggatgagcaggctaatgctgctgagatcacatcgatgatgtccgtgagtggcccagggtccgcgaccaccaccatagagatagatggcatatggaagtacaagtactga

SEQ ID NO: 19329 - protein, 402 aa, Sorghum bicolor
  misc_feature: Useful for making plants with altered carbohydrate content
  misc_feature: Functional homolog of the protein sequence given in SEQ ID NO 13622
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Ceres ANNOT ID no. 8726811
  misc_feature (22)..(153): Pfam ID: NAM Pfam Description: No apical meristem (NAM) protein
MADQQQPQQEEMNIVRVGGLDLLPGFRFHPNDFEIVNDYLMKKVHNRDFICAIGEVDLNKTEPWDLPREAKMNEKEWYFFSKKDRKYPTGLRANRATEAGYWKATGKDKEVYKPSKGEGVVLLIGMKKTLVFYEGRAPRGNKTNWVMHEYRLEGNSRVPSPTSASSSTTNATIAIKGSAFVSKDEWVICRVFHKTTGIRKTTIPAYQVAMPDAEIDQNQNNTLAIPVPMQLQLPQSMPMPMQCPILPDFSMDPVPPYYPNSNTGIGMPLVMPPMAGIGGTGGLQINGSLFNNPMVVPPSMNFYHQMGMGSSAGQMGTGEPIGQMDMGALVGQMGIGPVAQMDMGAASASGFNVAMSESRPSSMVLQKDEQANAAEITSMMSVSGPGSATTTIEIDGIWKYKY

SEQ ID NO: 19330 - DNA, 1350 bp, Sorghum bicolor
  misc_feature: Ceres ANNOT ID no. 8726869
  misc_feature: Encodes the peptide sequence at SEQ ID NO 19331
atggaggaggcacggaagaagaagaagcaggaggagaagctcaagaccgtcgtcaacctcgacgactggctgcccatcacgtcgtcgcgcacggccaagtggtactactcggcgttccacaacgtgacgtccatggtcggcgccggcgtgctgggcctccccttcgccatgtcgcagctgggatggggtgtcgggacggtggcggtcgtgatgtcgttcgtgatcacgctctacacgctgtggcagctggtgcagatgcacgagatggtccccggcaagcgcttcgaccggtaccacgagctcgggcagcacgtgttcggcgaccgcctgggcctctggatcatccttcccctgcagatcatcgtcatggccggcaccgacgtcgtgtacatggtcaccggcgggcagtgcctgcgcaagttccacgacctcgtctgccagggcggcggcggcggctgcaccgacatgcgcctcacgttctggatcatgatcttcgccaccccgcacttcgtcctctcccagctcccaaacttcaactccatctccgccgtctccggcgccgccgccgtcatgtccctcgcctactccatgatcgccttctgcacgtcggtggtcaagggtgccagagccacggcgggcgccatcgactacgggctcagggcgaccacgacgtccgggcaggcgttcggcatgctcagcgcgctgggcaccgtgtcgttcgcgtacgcggcgcacaacgtggtgctggaaatccaggccaccatcccgtccacgccggagaagccgtccaagaagcccatgtggcgcggcgtcgtcgtggcctacgccgtcgtcgcgctctgctacttctccgtcgccttcggcgggtactacgccttcggcagctccgtggaccccaacgtgctcatcaccctcgacaagccgcggtggctcatcgccgccgccaacctcatggtcgtcatccatgtcatcggcggctaccaggtcttcgccatgcccatgttcgacatgatcgagaccgtgctcgtcaagaagcacaagttcaacccggggttctggctacgcttcgtgtcccgctcagcttatgtcgccgctaccatgttcatcggattgaccttccccttcttcgacggcctgctcggattcttcggaggcttcggcttcgcgccaacgacgtacttcattccttgcataatgtggctgatggtgcggaagcccaagaagtatggcctcacatggttcattaacattatctgtatcgtcatcggcgtgttgctgacgatcatcggcaccattggaggactccggcaaatcatccttggcgccaagaattacaagctatactcttaa

SEQ ID NO: 19331 - protein, 449 aa, Sorghum bicolor
  misc_feature: Useful for making plants with altered oil content
  misc_feature: Functional homolog of the protein sequence given in SEQ ID NO 13448
  misc_feature: Ceres ANNOT ID no. 8726869
  misc_feature (30)..(436): Pfam ID: Aa_trans Pfam Description: Transmembrane amino acid transporter protein
MEEARKKKKQEEKLKTVVNLDDWLPITSSRTAKWYYSAFHNVTSMVGAGVLGLPFAMSQLGWGVGTVAVVMSFVITLYTLWQLVQMHEMVPGKRFDRYHELGQHVFGDRLGLWIILPLQIIVMAGTDVVYMVTGGQCLRKFHDLVCQGGGGGCTDMRLTFWIMIFATPHFVLSQLPNFNSISAVSGAAAVMSLAYSMIAFCTSVVKGARATAGAIDYGLRATTTSGQAFGMLSALGTVSFAYAAHNVVLEIQATIPSTPEKPSKKPMWRGVVVAYAVVALCYFSVAFGGYYAFGSSVDPNVLITLDKPRWLIAAANLMVVIHVIGGYQVFAMPMFDMIETVLVKKHKFNPGFWLRFVSRSAYVAATMFIGLTFPFFDGLLGFFGGFGFAPTTYFIPCIMWLMVRKPKKYGLTWFINIICIVIGVLLTIIGTIGGLRQIILGAKNYKLYS

SEQ ID NO: 19332 - DNA, 2391 bp, Sorghum bicolor
  misc_feature: Ceres ANNOT ID no. 8726926
  misc_feature: Encodes the peptide sequence at SEQ ID NO 19333
atggacaacgcggcggcggaggcgttgaagccgatgaaggcaacgtcggacggcgtgttccagggagagaacccgctacactcggcacttccgctcgccatcctgcaaatttgcattgtcgtcgtgctcacccgcgtcctcgccttcatcctccgcccgctacgtcagcctcgcgtcgtcgcggagatcatcggcgggattcttcttggtccgtcggcggttggccgcagcaccgcattcctcaacaccgtgttcccgaagcagagcctaacggttcttgataccctcgccaacatcggcctcctctacttcctcttcctggtcggccttgaactggacctccgcgccatacgccgcactgggagcacggcgctcgtgattgctgtcgccgggatctcccttcctttcatcatgggcatcggcacctcctttgtcctccagcacaccgtcgcccgcggcgtgcccacggggccattcctcgtcttcatgggcgtcgcgctctccatcacagcgttcccggtgctggcacgcatcctcgccgagctcaaactgctcaccaccgacatcgggcgcatggccatgtcagctgccgccgtcaacgacgtcgttgcgtggatacttctagccctcgccattgctttgtcaggcagcggctcccctcttgtctcgctatgggtgctgctagcgggagctggcttcgtcctcgcggcgttcttgctgatccgccctgtcctcacctggatggcacggcgatctcccgaaggcgagccagtgaaggagctttacatatgcgcgactctggccatcgtgcttgccgctgggttcgccaccgacaccattggcatccacgcgctctttggcgccttcatcgtcggcatcgtcgttccaaaggacgggcccttcgccggggttctcctggagaaggtggaggacctcatatctgggctattcctgccactctacttcgtgtccagcggcctcaagacgaacgtaatgaccatcaagggtggtgactcgtgggcgctcctcgtcctcgtcgttgccaccgcgtgcataggcaagatcggcggcacggttatcgcgtcgctcatcgtgcgggtgccattccgtgaggcgctcacgctcggcttcctcatgaataccaaggggctcgtggagctcatcgtcctcaacatcggcaaggaccggcacgtgctcaacgacgagacattcgccatcctcgtgctgatggcgctcataacaaccttcatcacgacgccggtggtcatggcgatctacaagccagcacggcgtgggccgccctacaagaaccgcgccgtggagcgcgcgaacccgcacgacgagttccgcatgatggcctgcttccacagcacgcgcaacatccccaccatcatcaacctgatggagtcgtcgcgcggcacgcggaagcgcggcatcaccgtctacgccatgcacctcgtggagctctccgagaggtcgtccgccatctccatggtccacaaagcgcggcgcaacggcatgccgttctggaacaagcgacgcaacggcgacggcgacggcgaccagctcgtcgtcgccttcgagacgtaccagcagctgagccgcgtgtccatccgggccatgacggccatctccgacctgcatacgatccacgaggacgtggtcaccagcgcgcaccagaagcgagccgcgctcatcgtgctcccgttccacaagctccaccagatggacggccacatggagtcgcttggcgaccagtaccagcacatcaaccagcgcgtgctccaccacgcgccctgctccgtaggcatcctcgtcgaccgcggcctaggaggtgctgctcaggtggctgccagcgatgtgtcctacaccatcgttgtcatcttcttcggaggccgcgacgaccgtgaggctctggcctatgccatgcgcatggtcgagcacccaggcatcgggctccatgtgctacgcttctgcttggtacagtccagctccactgacgtcgacgacgacgcgttccttgaagacttccgaaccaaggtggccaacgggaacgattctgtccgttacgaagataagccggcgggagggaaagaggaggtcgtggaggcgatcaaggcaatagggccgtgcaacctgttccttgtcgggcagggcacgccctgcatgccgctgattgactggagcacagactgcccggagctcgggccgctcggtacgtacttggcgttaccagaattctcaacggtagcatctgtgctggtcatgaaacagtacgatcccacggcgaagcactacgacctcgtggaggaggtggccgacatagccgtggacgtcgacacgccggggcccagcaacaggggcaccaacactagcttccacaccggatga

SEQ ID NO: 19333 - protein, 796 aa, Sorghum bicolor
  misc_feature: Useful for making plants with modulated heat sensitivity
  misc_feature: Functional homolog of the protein sequence given in SEQ ID NO 13975
  misc_feature: Ceres ANNOT ID no. 8726926
  misc_feature (37)..(424): Pfam ID: Na_H_Exchanger Pfam Description: Sodium/hydrogen exchanger family
MDNAAAEALKPMKATSDGVFQGENPLHSALPLAILQICIVVVLTRVLAFILRPLRQPRVVAEIIGGILLGPSAVGRSTAFLNTVFPKQSLTVLDTLANIGLLYFLFLVGLELDLRAIRRTGSTALVIAVAGISLPFIMGIGTSFVLQHTVARGVPTGPFLVFMGVALSITAFPVLARILAELKLLTTDIGRMAMSAAAVNDVVAWILLALAIALSGSGSPLVSLWVLLAGAGFVLAAFLLIRPVLTWMARRSPEGEPVKELYICATLAIVLAAGFATDTIGIHALFGAFIVGIVVPKDGPFAGVLLEKVEDLISGLFLPLYFVSSGLKTNVMTIKGGDSWALLVLVVATACIGKIGGTVIASLIVRVPFREALTLGFLMNTKGLVELIVLNIGKDRHVLNDETFAILVLMALITTFITTPVVMAIYKPARRGPPYKNRAVERANPHDEFRMMACFHSTRNIPTIINLMESSRGTRKRGITVYAMHLVELSERSSAISMVHKARRNGMPFWNKRRNGDGDGDQLVVAFETYQQLSRVSIRAMTAISDLHTIHEDVVTSAHQKRAALIVLPFHKLHQMDGHMESLGDQYQHINQRVLHHAPCSVGILVDRGLGGAAQVAASDVSYTIVVIFFGGRDDREALAYAMRMVEHPGIGLHVLRFCLVQSSSTDVDDDAFLEDFRTKVANGNDSVRYEDKPAGGKEEVVEAIKAIGPCNLFLVGQGTPCMPLIDWSTDCPELGPLGTYLALPEFSTVASVLVMKQYDPTAKHYDLVEEVADIAVDVDTPGPSNRGTNTSFHTG

SEQ ID NO: 19334 - DNA, 654 bp, Sorghum bicolor
  misc_feature: Ceres ANNOT ID no. 8727106
  misc_feature: Encodes the peptide sequence at SEQ ID NO 19335
atgggcgggcgggtggatcacgagtactcttacctgttcaagatggtgctcatcggggacagcggcgtcggcaaatccaatatcctctctcgcttcacgcgcaaccacttctccctcgactccaagtccaccatcggcgtcgagttcgccaccaagtccctgcagatggatggcaaaacaataaaggctcagatctgggacacagctgggcaggaaaggtaccgtgcaattacaagtgcctactaccgtggtgccgtgggagccctgcttgtgtatgacatcacaaagaggcagagcttcgagaatgttcacaggtggcttcgtgaactccgtgaccatgctgactccagtattgtgataatgatggtcggtaacaaatctgacctaatccacttgagagctatctctgaggatgaaggcaaagcgctggctgagaaggaggggttattcttccttgagacgtcagctatggaggctataaacgttgaggaagccttccagactattatcacggaggtctatggcattgtcaacaggaaagcgctggctgccaaagaagcagctgctacaactgctacattgccttcccagggcaaaaccatcagcattgacagcactgcaggaaatacaaagagggcatgctgctctacctaa

SEQ ID NO: 19335 - protein, 217 aa, Sorghum bicolor
  misc_feature: Useful for making plants with altered lignin content
  misc_feature: Functional homolog of the protein sequence given in SEQ ID NO 14470
  misc_feature: Useful for making plants with altered alkaloid content
  misc_feature: Functional homolog of the protein sequence given in SEQ ID NO 13220
  misc_feature: Useful for making plants with altered terpenoid content
  misc_feature: Functional homolog of the protein sequence given in SEQ ID NO 13157
  misc_feature: Ceres ANNOT ID no. 8727106
  misc_feature (14)..(146): SWISSPROT Homolog: EC 2.7.11.1 Non-specific serine/threonine protein kinase
  misc_feature (14)..(175): Pfam ID: Ras Pfam Description: Ras family
  misc_feature (14)..(128): Pfam ID: Miro Pfam Description: Miro-like protein
MGGRVDHEYSYLFKMVLIGDSGVGKSNILSRFTRNHFSLDSKSTIGVEFATKSLQMDGKTIKAQIWDTAGQERYRAITSAYYRGAVGALLVYDITKRQSFENVHRWLRELRDHADSSIVIMMVGNKSDLIHLRAISEDEGKALAEKEGLFFLETSAMEAINVEEAFQTIITEVYGIVNRKALAAKEAAATTATLPSQGKTISIDSTAGNTKRACCST

SEQ ID NO: 19336 - DNA, 2613 bp, Sorghum bicolor
  misc_feature: Ceres ANNOT ID no. 8727525
  misc_feature: Encodes the peptide sequence at SEQ ID NO 19337
atggcagcctgccgccgcgacacctttctcgctgtcatcattgggatcaatgcagtcattttggcttccgcggcgaagtacaagccgccggagtccatattggtggattgcggttcagcaaaagagggccaggacgccgatgggaggaaatgggtgactgaccaaggcagcaactggctcattgatggcgggaagtcatccatcatggccgatgccgatgtgcaggatccatcgcttccctcacctgtcccgtacatgtcggcacgggtgttcaccaaggaagccgtgtataacttctccattggtgacaccgataggcactggctgcgcctccacttctacccagcagcctaccatggcgtcccggcagaacaattcttcttctcagtctctacgtccaccggaatcacgctgctccgcaacttcagcgtgtacatcactgccaaggcacttagccaggcatacatcatcagggagttcacactgccaccgatgacggatggcaagctgtcgctcacattcacaccaaccgcaatgaacaacgcatcatatgccttcgtcaatggcatcgagatcatctccatgcccgacatctttgctgatccggccacgatggttggcttgagtgaccagaccgtagacaccgccgctagcagcttacagacgatgtacaggttgaatgtcggtggttcttacattgcaccgacaaacgactctggtctatcacgagattggtatgatgacacgccatacctctatggagctgctgttggtgtgacatataaagctgatgacaaggtccagataaagttctcgagccctgaggcagagtatgcagcaccgacgagcctctacctcagcagcaggtcaatgggccctaatccaaaggtgaatcagaactacaatctgacctgggtgtttgaggttgacagtaacttcacatacatcgttcggctccacttttgtgagttgttgcttaccaaggtgaatcaacgggcgtttgacatctacatcaacaacaaaacagcacaggcagatgccgatgtcatcgggtggacatcggagaaggatgtgcccgtgtacaaggactacgcgacgttcatgcctgacagtccaggtgataagatcctatggatcgcactacacccttccgtgtcaatgaagccagagttctacgatgctgtcctgaatggtctcgagatattcaagatgagtgatagctctggtaaccttgctggtccaaatcctgacccgtccagaatgctagaggaagcagagatggatgtgacaacggggaaattcaaagccaagccaagcaacctcagggccatggtgattggcggtgcagctggcggtgcagcagcctttgggatagtagcagccatatgtgtcgtggcttatcattcaaagaagaggcgggtgctaggtaacagcgtgtcccattcctcaggatggctgccagtgtatggtggcaactcacatacaaacgccagcaagtcgtctggcggcaagagcgcggcactcaacccaaacatcaccgccatgtgtcggcacttctcgttccaggagattaaggcagcaacgaagaacttcgatgagtcactagtcattggtgtgggcgggtttggcaaggtgtacaggggcatcgttgatggcgacaccaaggtggcgatcaagcggagcaatccatcatctgagcagggtgttctggaattccaaactgagattgagatgctctcgaagcttcggcacaagcaccttgtgtcgcttatcggctgctgcgaggatgacggcgagatgatccttgtgtacgactacatggcacatggcaccctacgggagcacctgtacaagagtggaaagccagcactatcatggcggcagcgccttgagatcaccatcggagccgcacgaggcctgcattacctccacactggcgccaagtacaccatcatccaccgtgacgtcaagacgaccaacattctggtcgatgagaactgggtggccaaggtttccgactttggtttatccaagactggcccgacggcgatgaaccaaacgcacgttagcaccatggtgaagggcagctttggatatctcgacccagagtacttccggcggcaacaactcacagagaagtctgacgtctactcgtacggtgtggtgctctttgaggtgctctgcgcacgccctgcactgaacccgagcctaccaagggagcaggttagccttgccgaccatgccttgagctgccagaggaagggaacactacaagatataattgatccggtattgaagggcaagatagcaccagactgcctgaagaagtatgcggagacggcagagaaatgcctggctgaccatggagtagaccgaccttcgatgggcgacgtgctatggaatcttgaatttgcattgcagatgcaggatacctttgagaatggtgggaagccagagggggaaggaagcatgagcaacagtagtactgtgtctatggcggacagcatggctgcctcagccgcagcgctcgagctaatcagcgaggacatggacgaggaggacattgccaacagtgtggtgttctcgcagctcgttcacccaactggccggtaa

SEQ ID NO: 19337 - protein, 870 aa, Sorghum bicolor
  misc_feature: Useful for making plants with modulated biotic stress sensitivity
  misc_feature: Functional homolog of the protein sequence given in SEQ ID NO 14099
  misc_feature: Ceres ANNOT ID no. 8727525
  misc_feature (519)..(810): SWISSPROT Homolog: EC 2.7.11.1 Non-specific serine/threonine protein kinase
  misc_feature (531)..(802): Pfam ID: Pkinase_Tyr Pfam Description: Protein tyrosine kinase
MAACRRDTFLAVIIGINAVILASAAKYKPPESILVDCGSAKEGQDADGRKWVTDQGSNWLIDGGKSSIMADADVQDPSLPSPVPYMSARVFTKEAVYNFSIGDTDRHWLRLHFYPAAYHGVPAEQFFFSVSTSTGITLLRNFSVYITAKALSQAYIIREFTLPPMTDGKLSLTFTPTAMNNASYAFVNGIEIISMPDIFADPATMVGLSDQTVDTAASSLQTMYRLNVGGSYIAPTNDSGLSRDWYDDTPYLYGAAVGVTYKADDKVQIKFSSPEAEYAAPTSLYLSSRSMGPNPKVNQNYNLTWVFEVDSNFTYIVRLHFCELLLTKVNQRAFDIYINNKTAQADADVIGWTSEKDVPVYKDYATFMPDSPGDKILWIALHPSVSMKPEFYDAVLNGLEIFKMSDSSGNLAGPNPDPSRMLEEAEMDVTTGKFKAKPSNLRAMVIGGAAGGAAAFGIVAAICVVAYHSKKRRVLGNSVSHSSGWLPVYGGNSHTNASKSSGGKSAALNPNITAMCRHFSFQEIKAATKNFDESLVIGVGGFGKVYRGIVDGDTKVAIKRSNPSSEQGVLEFQTEIEMLSKLRHKHLVSLIGCCEDDGEMILVYDYMAHGTLREHLYKSGKPALSWRQRLEITIGAARGLHYLHTGAKYTIIHRDVKTTNILVDENWVAKVSDFGLSKTGPTAMNQTHVSTMVKGSFGYLDPEYFRRQQLTEKSDVYSYGVVLFEVLCARPALNPSLPREQVSLADHALSCQRKGTLQDIIDPVLKGKIAPDCLKKYAETAEKCLADHGVDRPSMGDVLWNLEFALQMQDTFENGGKPEGEGSMSNSSTVSMADSMAASAAALELISEDMDEEDIANSVVFSQLVHPTGR

SEQ ID NO: 19338 - DNA, 195 bp, Sorghum bicolor
  misc_feature: Ceres ANNOT ID no. 8727670
  misc_feature: Encodes the peptide sequence at SEQ ID NO 19339
atgcagatctttgtgaagaccctcactagcaagaccatcaccctcgagattgagtcctcggacataattgacaatgtcaagccaaagatccaggacaaggagggaatcctgccagatcagcaacgcctaatctttgcaggtaagcagcttgaggatgttgcaatccaattttgtattgttgtctatagtttttga

SEQ ID NO: 19339 - protein, 64 aa, Sorghum bicolor
  misc_feature: Useful for making plants with modulated nitrogen use efficiency
  misc_feature: Functional homolog of the protein sequence given in SEQ ID NO 13585
  misc_feature: Useful for making plants with modulated cold sensitivity
  misc_feature: Useful for making plants with modulated flowering time
  misc_feature: Functional homolog of the protein sequence given in SEQ ID NO 14303
  misc_feature: Ceres ANNOT ID no. 8727670
  misc_feature (6)..(64): Pfam ID: ubiquitin Pfam Description: Ubiquitin family
MQIFVKTLTSKTITLEIESSDIIDNVKPKIQDKEGILPDQQRLIFAGKQLEDVAIQFCIVVYSF

SEQ ID NO: 19340 - DNA, 222 bp, Sorghum bicolor
  misc_feature: Ceres ANNOT ID no. 8730033
  misc_feature: Encodes the peptide sequence at SEQ ID NO 19341
atgcatgcacaagttttcttccattctttctcctataaattctactttcctgatagacgtttgatccagtttgaatgtgggaagatgcatagggccttgatatttactcaaatcacaaagatgcttgacgccttcaaagagttcataaacttatatgggtatacatattttcatttagatatagcacaccaaagtagggaggatgaggagcacaagggctag

SEQ ID NO: 19341 - protein, 73 aa, Sorghum bicolor
  misc_feature: Useful for making plants with modulated flowering time
  misc_feature: Functional homolog of the protein sequence given in SEQ ID NO 14563
  misc_feature: Ceres ANNOT ID no. 8730033
MHAQVFFHSFSYKFYFPDRRLIQFECGKMHRALIFTQITKMLDAFKEFINLYGYTYFHLDIAHQSREDEEHKG

SEQ ID NO: 19342 - DNA, 1734 bp, Sorghum bicolor
  misc_feature: Ceres ANNOT ID no. 8730183
  misc_feature: Encodes the peptide sequence at SEQ ID NO 19343
atggcatccgcgaatgccatctccaccgcctccctcatctcgcccctctcgcagggcagggcgaggagggccaggaatggccggtcacagcgcttcgtagtgcgtgcggaggccaaagacatcgcctttgaccagaaatccagggcagccctgcaggccggcgtcgagaagctcgcaaacgccgtcggtgtcaccctggggccacgagggaggaatgtggtgctcgatgagtatggcagccccaaagttgtgaatgatggagtcactattgcccgggctattgagctgtatgatccaatggaaaatgctggtgcagcattgattcgtgaggttgctagcaagaccaatgattctgctggtgatggcactacaactgcttccgtccttgctcgtgaaatcatcaagctaggccttctgagtgtaacgtctggtgcaaatcctgtgtcacttaagaagggaatcgacaaaactgtgcagggtctaattcaggagcttgagaataaggctagaccagtcaagggtggtggtgatatcaaagctgttgcatctatctctgctggcaatgatgaatttatcggatccatgattgctgaagcaattgacaaagtggggcctgatggtgttctttcaattgaatcctcctcatcttttgagactactgttgaagttgaagaaggaatggagattgaccgtggttatatttctccacaatttgtgacaaaccttgagaaatctattgtggagtttgagaatgctaaggttcttattactgatcagaagatctcaagcataaaggaaattcttccaattctggagaagaccacacagctgagagcccctttgttcattattgctgaggacattactggtgaagctttggcaactcttgttgttaacaagcttcgaggaattctaaatgttgcagcaattaaggctccaagctttggtgagcggcggaaggctgtacttcaggacattgccattgtcacaggtgctgagttcctagcaaaagatcttggtttgttggttgaaaatgctacagaggcacaacttggtacagcaaggaaagtcacaatacatcagactacaacaaccctcatagcagatgcagccagtaaagatgaaatccaagcgagggttgcacagctaaagaaggagcttgctgagactgattcagtttatgatactgagaaattggctgagagaattgctaagcttgctggtggtgttgctgttatcaaggttggagccgcaactgagactgagcttgaggaccgccagctaagaattgaggatgcaaaaaatgccacttttgcagctatagaggagggcattgttcctggaggtggtacggcatacgtgcacctatctaccgttgtcccttcgatcaaagaaaaaattgaggaccctgatgagcgccttggtgctgatattattcaaaaggcattggtagcacctgcttcattgattgcacacaatgctggagtagagggtgaagtggttgttgagaagatcaaggacagtgtgtgggaggtgggctacaatgcaatgacggatacatacgagaacctgattgaggctggtgtgatcgaccctgctaaggtgactaggtgtgcgctccaaaatgcggcctcagtagctggaatggtcctaaccacacaggcaatagttgttgaaaagccaaagccgaagcctcaagtggcagagccatcagagggaagccttgccgtgtaa

SEQ ID NO: 19343 - protein, 577 aa, Sorghum bicolor
  misc_feature: Useful for making plants with modulated nitrogen use efficiency
  misc_feature: Functional homolog of the protein sequence given in SEQ ID NO 13023
  misc_feature: Ceres ANNOT ID no. 8730183
  misc_feature (58)..(561): Pfam ID: Cpn60_TCP1 Pfam Description: TCP-1/cpn60 chaperonin family
MASANAISTASLISPLSQGRARRARNGRSQRFVVRAEAKDIAFDQKSRAALQAGVEKLANAVGVTLGPRGRNVVLDEYGSPKVVNDGVTIARAIELYDPMENAGAALIREVASKTNDSAGDGTTTASVLAREIIKLGLLSVTSGANPVSLKKGIDKTVQGLIQELENKARPVKGGGDIKAVASISAGNDEFIGSMIAEAIDKVGPDGVLSIESSSSFETTVEVEEGMEIDRGYISPQFVTNLEKSIVEFENAKVLITDQKISSIKEILPILEKTTQLRAPLFIIAEDITGEALATLVVNKLRGILNVAAIKAPSFGERRKAVLQDIAIVTGAEFLAKDLGLLVENATEAQLGTARKVTIHQTTTTLIADAASKDEIQARVAQLKKELAETDSVYDTEKLAERIAKLAGGVAVIKVGAATETELEDRQLRIEDAKNATFAAIEEGIVPGGGTAYVHLSTVVPSIKEKIEDPDERLGADIIQKALVAPASLIAHNAGVEGEVVVEKIKDSVWEVGYNAMTDTYENLIEAGVIDPAKVTRCALQNAASVAGMVLTTQAIVVEKPKPKPQVAEPSEGSLAV

SEQ ID NO: 19344 - DNA, 570 bp, Sorghum bicolor
  misc_feature: Ceres ANNOT ID no. 8730404
  misc_feature: Encodes the peptide sequence at SEQ ID NO 19345
atgcctatatatagctctgctcggctcgccgtaggtgactcgttcaacaaggagaaagcagagagagggcaacatcgattagagatagatacagagggaaactggagagtcttgagggtgatggtttccagggagcagaagcgaggagttttgcatgagaagctgcagattctccgcagcgttactcattctcatgcgggggataaaatgtcaataatagcggacgcatcattgtacatcaaagatctacagcagaaaattgcgaagctaaaccaagagattgcatctgcacaacacgccaatgtttgccaaccattggtgagtgttggagtcctggacaagggtttcctcattaatgtgttcatggacaagagctgcccaccaggactacttgcttgtatccttgaggcatttgacgagattgggctcacagtgcttgaggctagggctacatgtgctggttcatttcgtctagaagctgtaggagaggaagaaggtgagggcctaatcgacgcacatgcagtggagaaagcagtagttcaagcaatcaagaattgtcctacaaactaa

SEQ ID NO: 19345 - protein, 189 aa, Sorghum bicolor
  misc_feature: Useful for making plants with modulated biomass
  misc_feature: Functional homolog of the protein sequence given in SEQ ID NO 13549
  misc_feature: Ceres ANNOT ID no. 8730404
MPIYSSARLAVGDSFNKEKAERGQHRLEIDTEGNWRVLRVMVSREQKRGVLHEKLQILRSVTHSHAGDKMSIIADASLYIKDLQQKIAKLNQEIASAQHANVCQPLVSVGVLDKGFLINVFMDKSCPPGLLACILEAFDEIGLTVLEARATCAGSFRLEAVGEEEGEGLIDAHAVEKAVVQAIKNCPTN

SEQ ID NO: 19346 - DNA, 1554 bp, Sorghum bicolor
  misc_feature: Ceres ANNOT ID no. 8730894
  misc_feature: Encodes the peptide sequence at SEQ ID NO 19347
atggcgtcctcgacggggagcttggagcacggcgggttcacgttcacgccgccgcccttcatcacctcgttcacggagctactctccgggacaggggacatgctaggaggagccggcggcgccgaccaggagcggtcgccgagggggctgttccaccgcggcgccaggggcggcgtgggcgtgcccaagttcaagtccgcgcagccgcccagcctgcccatctcatcgccgccgccgatgtcgccgtcctcctacttcgccatcccggccggcctcagccccgccgagctgctcgactcgcccgtcctgctccactcttcctccaacatcttggcgtctcccaccaccggcgccatcccggcgcagaggttcgactggaagcaggccgccgatctcatcgcgtctcagtctcatcagcaagacgacacccgggctgccgccgccgccggcggcttcaacgacttctccttccacacggccaccacctccaacgccatgcccgcgcagaccacgtccttcccttccttcaagcaggaacagcagcagcaagtcgaagcggcagcgacgaccaataagcagagcgccgtcgtggcgtcgagcaacaacaagcaggggagcagcggcggcgggaacagcagcaacacgaagctggaggacggttacaactggcgcaagtacgggcagaagcaggtgaaagggagcgagaacccgcgcagctactacaagtgcacgtaccacagctgctccatgaagaagaaggtggagcggtccctggccgacggccgcatcacgcagatcgtctacaagggcgcgcacaaccaccccaagccgctgtccacgcgccgcaactcgtcctccggtggggtcgtcgcggcgggggaggagcagcaggccgccgcaaacagcctctccgccgccgccgccgcggcgggtggctgtgggccggagcactccggcgccaccgccgagaactcgtccgtcaccttcggcgacgacgaggcggagaacgcgtcgcaccggagcgacggcgacgagcccgacgccaagcgctggaagcaggaggatggcgagaacgagggcagctctggcggcgccggcggcaagccggtgcgcgagccccggctggtggtgcagacgctgagcgacatcgacatcctggacgacgggttccggtggcgcaagtacgggcagaaagtggtgaaggggaacccgaacccgcggagctactacaagtgcaccacggtgggttgccccgtgcggaagcacgtggagcgcgcgtcccacgacacgcgcgccgtgatcaccacttacgagggcaagcacaaccacgacgtgcccgtgggccgcggcgccgcgagccgcgcggcggcggcggcggcggtggcgccgacgatgggagccttgatggccgccggcggccatcagcagcagcagcagccctacacgctggagatgctgagcggcggagtaggcggtggcgccgcatacggcggcggctacgcggccaaggacgagccgcgggacgacctgttcgtcgactcgctcctgtgctag

SEQ ID NO: 19347 - protein, 517 aa, Sorghum bicolor
  misc_feature: The sequence is a functional homolog of SEQ ID NO 223 in the 11/479,226 US patent application
  misc_feature: The sequence is a functional homolog of SEQ ID NO 84 in the 10/412,699 US patent application
  misc_feature: The sequence is a functional homolog of SEQ ID NO 202 in the 10/714,887 US patent application
  misc_feature: The sequence is a functional homolog of SEQ ID NO 202 in the 11/435,388 US patent application
  misc_feature: The sequence is a functional homolog of SEQ ID NO 86 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8730894
  misc_feature (386)..(445): Pfam ID: WRKY Pfam Description: WRKY DNA -binding domain
  misc_feature (217)..(276): Pfam ID: WRKY Pfam Description: WRKY DNA -binding domain
MASSTGSLEHGGFTFTPPPFITSFTELLSGTGDMLGGAGGADQERSPRGLFHRGARGGVGVPKFKSAQPPSLPISSPPPMSPSSYFAIPAGLSPAELLDSPVLLHSSSNILASPTTGAIPAQRFDWKQAADLIASQSHQQDDTRAAAAAGGFNDFSFHTATTSNAMPAQTTSFPSFKQEQQQQVEAAATTNKQSAVVASSNNKQGSSGGGNSSNTKLEDGYNWRKYGQKQVKGSENPRSYYKCTYHSCSMKKKVERSLADGRITQIVYKGAHNHPKPLSTRRNSSSGGVVAAGEEQQAAANSLSAAAAAAGGCGPEHSGATAENSSVTFGDDEAENASHRSDGDEPDAKRWKQEDGENEGSSGGAGGKPVREPRLVVQTLSDIDILDDGFRWRKYGQKVVKGNPNPRSYYKCTTVGCPVRKHVERASHDTRAVITTYEGKHNHDVPVGRGAASRAAAAAAVAPTMGALMAAGGHQQQQQPYTLEMLSGGVGGGAAYGGGYAAKDEPRDDLFVDSLLC

SEQ ID NO: 19348 - DNA, 924 bp, Sorghum bicolor
  misc_feature: Ceres ANNOT ID no. 8731088
  misc_feature: Encodes the peptide sequence at SEQ ID NO 19349
atggtgtcgccgcgcggggcaggaaaggctagccaggggcggaggcgcagggagctggtccttatcgaggaccccaagagccgcctggtgaccttctccaagcgcaagtcggggcttttaaagaaggcctcggagctctccctcctctgcggcgcgcgcgtcgccgccgtcgtcttctccgccacggggaagccgtccgcagtgggcgccccctccgtcgaacgcgttatcagccggttcaccccgctccccagcggcgagggcgacgatgaccgcgagcgcgaggtgatggaggtcacggcgcggcgggcgaaggagaccggcgcgcgcgtggccgaggagaagacgcggatgcacgccgtcggggagaaggtgctccgggccgcggcggcgggcggggttcgcttctggtggcaggcggacgcggaggcgctcggtgaggaggagctgcgggagttcgccaggaagctccgccggctcagggacaacgagatcgacgccatgtatcatagcgtcgaggtatcacggctcgacgccatggatcaaggcgtcgaggtagaaattccagaagacgagaaaacctatcggcagaggtattggatgtgttccaattttgcctggaagcctacgccaaaacaacgccgcagtaactttatttggatcgacactgagattaaggagtccgacaagcggcttctacaaggcctaaaggagtgggatgcagagcgtgcagagatattagagaagagacgtagagatgaggctcaaaagagggagcacaaggaagaggaggaaagaagacgtgttgctgcggctcgggaggagagggaaaagaagcttgagcgtgtgcgccgagcgaaggcagcgatggatgagaatccagatgcccagcggaagggaaagtggcctcgttgcactcagtag

SEQ ID NO: 19349 - protein, 307 aa, Sorghum bicolor
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8731088
  misc_feature (20)..(66): Pfam ID: SRF-TF Pfam Description: SRF-type transcription factor (DNA-binding and dimerisation domain)
MVSPRGAGKASQGRRRRELVLIEDPKSRLVTFSKRKSGLLKKASELSLLCGARVAAVVFSATGKPSAVGAPSVERVISRFTPLPSGEGDDDREREVMEVTARRAKETGARVAEEKTRMHAVGEKVLRAAAAGGVRFWWQADAEALGEEELREFARKLRRLRDNEIDAMYHSVEVSRLDAMDQGVEVEIPEDEKTYRQRYWMCSNFAWKPTPKQRRSNFIWIDTEIKESDKRLLQGLKEWDAERAEILEKRRRDEAQKREHKEEEERRRVAAAREEREKKLERVRRAKAAMDENPDAQRKGKWPRCTQ

SEQ ID NO: 19350 - DNA, 798 bp, Sorghum bicolor
  misc_feature: Ceres ANNOT ID no. 8731031
  misc_feature: Encodes the peptide sequence at SEQ ID NO 19351
atgccaaattgtccttcattcagtgggctgggctcggattttttagagcccaaggcccagaaccgtcaagtcgaaccctaccttgcgtccttgccctctcgtctttccctactaccgccgccaccatcctgcgctgcgcctgcacacgctctcggctctcccgctgctctcgaagccgtctcccccgaagctgcccagggtcagctcaagctagaggaaatgtttacagcaaggaggaagatccagaaggacaatggcatggagccaactgagtttgaagacacagttgcccaggcgttctttgacctcgaaaatgggaatcaggagcttaagagtgacttgaaggaactttacatcaatggagcaatgcagatggatatggctggcaacaggaaggctgttatcatccatgttccgtacagactgcaaaagtcttacaagaagattcatgtgaggcttgttcgggagcttgagaagaagttcagtgggaaggatgttgttctggttgctactcgaagaatagtgaggcctccgaagacaggctcagctattgtgcgcccacgtaaccgcactcttactgctgttcatgatggcattttggaggacgttgtgtatccagctgagattgttgggaagcgtattaggtaccacatggatggtgccaaagttttgaaggtcttcctggatccaaaggagcgaacaaacactgagaataagcttgacactttcagctcggtctaccggaggctctgtgggaaggaggtggtgtttgactaccctgtggccgagagcgcttaa

SEQ ID NO: 19351 - protein, 265 aa, Sorghum bicolor
  misc_feature: Useful for making plants with modulated biomass
  misc_feature: Functional homolog of the protein sequence given in SEQ ID NO 13013
  misc_feature: Ceres ANNOT ID no. 8731031
  misc_feature: Down-regulated in shoot tissues in response to salicylic acid treatment
  misc_feature (79)..(264): Pfam ID: Ribosomal_S7e Pfam Description: Ribosomal protein S7e
MPNCPSFSGLGSDFLEPKAQNRQVEPYLASLPSRLSLLPPPPSCAAPAHALGSPAALEAVSPEAAQGQLKLEEMFTARRKIQKDNGMEPTEFEDTVAQAFFDLENGNQELKSDLKELYINGAMQMDMAGNRKAVIIHVPYRLQKSYKKIHVRLVRELEKKFSGKDVVLVATRRIVRPPKTGSAIVRPRNRTLTAVHDGILEDVVYPAEIVGKRIRYHMDGAKVLKVFLDPKERTNTENKLDTFSSVYRRLCGKEVVFDYPVAESA

SEQ ID NO: 19352 - DNA, 654 bp, Sorghum bicolor
  misc_feature: Ceres ANNOT ID no. 8731093
  misc_feature: Down-regulated in shoot tissues in response to salicylic acid treatment
  misc_feature: Encodes the peptide sequence at SEQ ID NO 19353
atgggcggtgggtcgccgtgcgcgtcgtgcaagctgctccggcggcggtgcaccaaggactgcatcttcgcgccattcttccccgccgacgacccccacaaattcgccatcgtccacaaggtcttcggggccagcaacgtctccaagatgctccaggagctcccggtgcagcagcgcggcgacgcggtgagcagcctggtgtacgaggcgaacgcgcggatgcgggaccccgtctacggctgcgtcggggccatctccttcctgcagaaccaggtgtcgcagctgcagatgcagctcgccgtcgcgcaggccgagatcctctgcatccagatgcagcgccgggacgacgtcgacggaggaggaggcggccccaacgtcgacgacgtggtggtcccgccgccgtcgtcgctggtcgtcggtgcgggcggcggcgccgaccaccgccaccacaaccacatgacgatggcggccgcgatgcagcagcaggcgatgatggccaccgacgacgtggacgccttcctcatgcagaacggcgccggcgccaccggagccatagtcccgccgcagctcataggcatgggctacggtggcgccgcatcggcgggcgccatgggagagacgacggcgctcaagagggagtccctgtggacgtag

SEQ ID NO: 19353 - protein, 217 aa, Sorghum bicolor
  misc_feature: Useful for making plants with modulated biomass
  misc_feature: Functional homolog of the protein sequence given in SEQ ID NO 12922
  misc_feature: Ceres ANNOT ID no. 8731093
MGGGSPCASCKLLRRRCTKDCIFAPFFPADDPHKFAIVHKVFGASNVSKMLQELPVQQRGDAVSSLVYEANARMRDPVYGCVGAISFLQNQVSQLQMQLAVAQAEILCIQMQRRDDVDGGGGGPNVDDVVVPPPSSLVVGAGGGADHRHHNHMTMAAAMQQQAMMATDDVDAFLMQNGAGATGAIVPPQLIGMGYGGAASAGAMGETTALKRESLWT

SEQ ID NO: 19354 - DNA, 513 bp, Sorghum bicolor
  misc_feature: Ceres ANNOT ID no. 8731085
  misc_feature: Encodes the peptide sequence at SEQ ID NO 19355
atggatcaggtgctcaacaaggtggggagctactggttcagcaagagggccagcaaggaaatcgactccatcggcgacgacatcagctcgatctcaagcagcattggaggttcagccaaatggatggtgaacaaaattaaagggaagatgcagaaagcactgccagacctcctcaaggaatatgacatgccagcagggctcttcccacgggacgctactaactatgagttcaatgaagagacaaagaagctgacagtgtacatcccgtcagcctgtgatgttggttacaaggactcgtcagtgctgcggttcttcacctgtgtgaccggctaccttgagaaggggaagttttccgacatcgagggcatgaagacaaaagtgctggtctggaccaaggtgactgccatcaagaccgagggcccaaaggtccatttcactgctggcgtgaagaagactcggagccgtgatgcctatgaggtcgtcagagatggtatcaccatagataagttctag

SEQ ID NO: 19355 - protein, 170 aa, Sorghum bicolor
  misc_feature: Useful for making plants with modulated nitrogen use efficiency
  misc_feature: Functional homolog of the protein sequence given in SEQ ID NO 14627
  misc_feature: Ceres ANNOT ID no. 8731085
MDQVLNKVGSYWFSKRASKEIDSIGDDISSISSSIGGSAKWMVNKIKGKMQKALPDLLKEYDMPAGLFPRDATNYEFNEETKKLTVYIPSACDVGYKDSSVLRFFTCVTGYLEKGKFSDIEGMKTKVLVWTKVTAIKTEGPKVHFTAGVKKTRSRDAYEVVRDGITIDKF

SEQ ID NO: 19356 - DNA, 666 bp, Sorghum bicolor
  misc_feature: Ceres ANNOT ID no. 8731299
  misc_feature: Encodes the peptide sequence at SEQ ID NO 19357
atggcggacaaggagcccgtcgtggagcgacccgaggcggctgaggaggaggacgcctcggccgccgccgccgccgcgggggaggaggaggacacgggcgcccaggtggcccccatcgtgcggctcgaggaggtagccgtcaccaccggcgaggaggacgaggacgtcctgctcgacatgaaggcgaagctgtaccgttttgacaaagacgggaaccaatggaaggaacgaggcacgggcaccgtcaagcttctcaagcacaaggagagcagcaaggtccgcctagtcatgcgccaggccaagacgcttaagatctgcgcgaaccacctcgtggcctccaccacgaaaatgcaggagcatgccggcagcgacaagtcgtgcgtctggcacgctgccgattttgcagatggcgaacttaaggaggagatgtttgccatccggtttggttccgtagaaaattgcaagaaattcaaggagttgattgaggagattgctgagtcacttacaaagaacgaaggcaaggaaggtgaagatggttcttccacggctgaattgctggagaagctcactgtgagcgaggacaaatctgagggaagtggcaagtcggagtcaactgattctggcaaagtgaacgaaaccaaatctgacgcagccccagccgagtag

SEQ ID NO: 19357 - protein, 221 aa, Sorghum bicolor
  misc_feature: Useful for biocontainment applications
  misc_feature: Useful for making plants with modulated flowering time
  misc_feature: Functional homolog of the protein sequence given in SEQ ID NO 14207
  misc_feature: Ceres ANNOT ID no. 8731299
  misc_feature (46)..(167): Pfam ID: Ran_BP1 Pfam Description: RanBP1 domain
MADKEPVVERPEAAEEEDASAAAAAAGEEEDTGAQVAPIVRLEEVAVTTGEEDEDVLLDMKAKLYRFDKDGNQWKERGTGTVKLLKHKESSKVRLVMRQAKTLKICANHLVASTTKMQEHAGSDKSCVWHAADFADGELKEEMFAIRFGSVENCKKFKELIEEIAESLTKNEGKEGEDGSSTAELLEKLTVSEDKSEGSGKSESTDSGKVNETKSDAAPAE

SEQ ID NO: 19358 - DNA, 108 bp, Sorghum bicolor
  misc_feature: Ceres ANNOT ID no. 8731520
  misc_feature: Encodes the peptide sequence at SEQ ID NO 19359
atgagaggaactgttcgctatgctagtgttcatgcacatcttgggaaaacaggtagcatgagggatgatttagaatctctagcatatacactagtctttcttctatga

SEQ ID NO: 19359 - protein, 35 aa, Sorghum bicolor
  misc_feature: The sequence is a functional homolog of SEQ ID NO 32 in US patent 7179962
  misc_feature: Ceres ANNOT ID no. 8731520
  misc_feature (1)..(33): SWISSPROT Homolog: EC 2.7.11.1 Non-specific serine/threonine protein kinase
MRGTVRYASVHAHLGKTGSMRDDLESLAYTLVFLL

SEQ ID NO: 19360 - DNA, 1722 bp, Sorghum bicolor
  misc_feature: Ceres ANNOT ID no. 8731786
  misc_feature: Encodes the peptide sequence at SEQ ID NO 19361
atggcactccactccgccgccgctctctcggccctcctgctgctctccttctcaggccttacgctctccgacgagacgccgtccacgccggtgtcgccgtcggcggcttgcaacgccacgacggacccgaccttctgccggtccgtcctcccgccgcggggcaagggggacctctacacgtacggccgcttctcggtggccgagtccctggcgggcgcgcgcaagttcgccgccgtcgtggaccggtacctcgcgcgacaccggcacctctcctcgagcgccatcggcgcgctgcgggactgccagctcatggcggagctgaacgtggacttcctgacggccgccggcgcgacgatcaagagcacggacaccctcctggacccgcaggccgacgacgtgcacacgctgctgtcggcgatcctgaccaaccagcagacgtgcttcgacggcctgcaggccgcgtctgggtcgtggtccgaccgcggcggcctcgacgcgcccatcgccaacggcaccaagctctacagcctctcgctgtcgctcttcaccagggcgtgggtgccgacggcgaagccggcgcacccgcacaagtcgggcggcggcagcaatggcccgccgcaccacggccacggccacggtggcaagagcaagaagcccccggcggcggcggcggcggcgaggaggggcctgttcgacgtgaccgacgacgagatggtgcggcggatggcgatggaggggccagagagtacggtggcggtgaacaccgtggtcaccgtggaccagagcggcgccgggaacttcaccacgatcggggacgccgtggctgccgcgccgaaaaacctcaacggcagcaccggctactacgtggtctacgtgcttgccggcgtctacgaggagaacgtggtggtgcccaagcacaacaagtacatcatgatggtcggcgacggcatcggccagaccgtggtcaccggcaaccggagcgtcgtcgacggctggaccaccttccaatcggccaccttcgccgtggtggggcaaggattcgtggcgatgaacatgacgttccggaacacggcggggccggcgaagcaccaggcggtggcgttccgctccggcgcggacctgtcggcgtactacggctgcagcttcgaggcgtaccaggacacgctgtacacgcactccctccggcagttctaccgcggctgcgacgtctacggcaccgtggactacgtgttcggcaacgccgccgtcgtcttccagggctgcaccttctactccaggctgccgatgcaggggcagtgcaacacggtgacggcgcagggccggagcgaccccaaccagaacacgggcacctccatccagggctcctccctcgtggcggcgccggagctcgccgccaacaccgccttcgccacgctcagctacctcggccggccatggaagaacttctcgcgcacggtggtcatggagtcgtacgtcggcgggctcgtcgacccctccggctggatgccatggtcgggggacttcgcgctcgacacgctctactacgccgagtacaacaacagcgggccgggcgccgacaccagccgccgggtggcgtggccgggcttccacgtgctcggcgacatcaccgacgccggcaacttcaccgtcacaagcatggtgctaggcgaaaactggctgccgcagactggcgtgccattcaccagcggcttaatttcttga

SEQ ID NO: 19361 - protein, 573 aa, Sorghum bicolor
  misc_feature: Useful for making plants with altered cell wall content and/or composition
  misc_feature: Functional homolog of the protein sequence given in SEQ ID NO 14412
  misc_feature: Useful for making plants with altered carbohydrate content
  misc_feature: Functional homolog of the protein sequence given in SEQ ID NO 14381
  misc_feature: Useful for making plants with modulated time to senescence
  misc_feature: Functional homolog of the protein sequence given in SEQ ID NO 14413
  misc_feature: Ceres ANNOT ID no. 8731786
  misc_feature (249)..(571): SWISSPROT Homolog: EC 3.1.1.11 Pectinesterase
  misc_feature (256)..(557): Pfam ID: Pectinesterase Pfam Description: Pectinesterase
  misc_feature (25)..(181): Pfam ID: PMEI Pfam Description: Plant invertase/pectin methylesterase inhibitor
MALHSAAALSALLLLSFSGLTLSDETPSTPVSPSAACNATTDPTFCRSVLPPRGKGDLYTYGRFSVAESLAGARKFAAVVDRYLARHRHLSSSAIGALRDCQLMAELNVDFLTAAGATIKSTDTLLDPQADDVHTLLSAILTNQQTCFDGLQAASGSWSDRGGLDAPIANGTKLYSLSLSLFTRAWVPTAKPAHPHKSGGGSNGPPHHGHGHGGKSKKPPAAAAAARRGLFDVTDDEMVRRMAMEGPESTVAVNTVVTVDQSGAGNFTTIGDAVAAAPKNLNGSTGYYVVYVLAGVYEENVVVPKHNKYIMMVGDGIGQTVVTGNRSVVDGWTTFQSATFAVVGQGFVAMNMTFRNTAGPAKHQAVAFRSGADLSAYYGCSFEAYQDTLYTHSLRQFYRGCDVYGTVDYVFGNAAVVFQGCTFYSRLPMQGQCNTVTAQGRSDPNQNTGTSIQGSSLVAAPELAANTAFATLSYLGRPWKNFSRTVVMESYVGGLVDPSGWMPWSGDFALDTLYYAEYNNSGPGADTSRRVAWPGFHVLGDITDAGNFTVTSMVLGENWLPQTGVPFTSGLIS

SEQ ID NO: 19362 - DNA, 936 bp, Sorghum bicolor
  misc_feature: Ceres ANNOT ID no. 8731807
  misc_feature: Encodes the peptide sequence at SEQ ID NO 19363
atgtgtcgactcccacggcgccacgccgcgccacttgccgccgagcggcttggctggcggtttgcctcgcgatccgcgcgcggcgcgtgcgtcctggcgctggcgcggctttttctcacgaaagtgaagctccagtaccgtcacgtcacacgtgtccgtcttctaccaacaggaaggactgcccctgtgcaccgcactggccccggggggaggtttttggcctttggtgggagccccggccccaaaccaaaaccaggaaaaccacgctacaccagcacttttcgccgtcgctgcgtcctgcctaccagtgactcgcaaggttcgtctccatcgacaatgtgtggcggagccatcatcgccgacttcgtccccgccggcggccgtcgccaggcaaccgacgacaccatctccgcctcctccctcctctccggcgaggaccagcatctggaggagctcggcagcagggtgccggcgccggggcgcaagacggcgtaccgcgggatccggcgccgtccctggggccggtgggcggcggagatccgcgacccgcggaagggcgcgcgcgtctggctcggcacctacgccaccccggaggacgccgcgcgcgcctacgacgccgcggcgcgcgagatccgcggggccaaggccaagctcaacttcccgcccgccgtcggcgctggcgccggcgccggcgcgcgcgagccggcggccaagaggcgccggacgtcgtcgtccgcggcggccgaggagagctcgggctcgtctccggcagcgacgacgaccgtcgtggcgggcgtcggaggcggcggaggaggagaggagacgctgcgtgactgcatgtccgggctggaggccttcctggggctgcaggaggaagcggccgacgagggtggcgacgccgaggcgtgggacgccgtcgacctcatgttcgcgtag

SEQ ID NO: 19363 - protein, 311 aa, Sorghum bicolor
  misc_feature: Useful for making plants with altered lignin content
  misc_feature: Functional homolog of the protein sequence given in SEQ ID NO 13219
  misc_feature: Ceres ANNOT ID no. 8731807
  misc_feature (163)..(214): Pfam ID: AP2 Pfam Description: AP2 domain
MCRLPRRHAAPLAAERLGWRFASRSARGACVLALARLFLTKVKLQYRHVTRVRLLPTGRTAPVHRTGPGGRFLAFGGSPGPKPKPGKPRYTSTFRRRCVLPTSDSQGSSPSTMCGGAIIADFVPAGGRRQATDDTISASSLLSGEDQHLEELGSRVPAPGRKTAYRGIRRRPWGRWAAEIRDPRKGARVWLGTYATPEDAARAYDAAAREIRGAKAKLNFPPAVGAGAGAGAREPAAKRRRTSSSAAAEESSGSSPAATTTVVAGVGGGGGGEETLRDCMSGLEAFLGLQEEAADEGGDAEAWDAVDLMFA

SEQ ID NO: 19364 - DNA, 1308 bp, Sorghum bicolor
  misc_feature: Ceres ANNOT ID no. 8731895
  misc_feature: Encodes the peptide sequence at SEQ ID NO 19365
atggcgtccgagctcacctaccgcggaggcgggccgtccgcggccgccagcgccggcgccgggggatactccccgaagccgtccaagccgctggcctggctgccccgcgccgcccgctacgccgtcgccgagaaccgcccgctcttcgcgctcgccgggatgctcatcgccgccgccgtcatctccatcgcctccccgtccgcctcttccacctccaccaccggctccgccgccgccgtctcgtcctactccaacaacaacaacaacaacccgctcgcccgcttctccgtcgagcccgcccaccaccgcgacgtggccacgcgccacttcgtcggcggcaaggtgccgctcggcctcaagcggaaggcgctccgcgtcctcgtcaccggcggcgccggcttcgtcggcagccacctggtggaccgcctcctcgagcgcggcgacagcgtcatcgtcgtcgacaacttcttcaccggccgcaaggacaacgtcctgcaccacctcaacgacccgaacttcgagatgatccggcacgacgtcgtcgagcccatcctgctcgaggtcgaccagatctaccacctcgcctgcccggcgtccccccacaagaccaatgtggttggcactctgaacatgctcggattggcaaagaggatcaacgccaagttcctcctcaccagtaccagtgaggtctatggtgatcccctccagcacccacaggtggagacttactggggcaatgtcaatcccatcggtgtcaggagttgttacgatgagggcaagcgtacagctgaaacgttgaccatggattaccaccgtggtgccaaccttgaggttaggatcgcacgtatcttcaacacatatggccctcgcatgtgcattgacgatggccgtgttgtcagtaactttgttgctcaggctctgaggaaggagcccttgacggtttatggtgatggaaagcaaaccaggagtttccaatatgtttctgatctggttgagggtctgatgaagctgatggaaggcgaccatgtaggaccattcaacctgggtaaccccggcgagttcaccatgcttgagcttgccaaggttgtccaggacaccatcgaccccaatgcacagatcgagttccgtcagaacacccaggacgacccacacaagcgcaagcccgacatcagccgtgccaaggagctccttgggtgggagccgaagatccccctccgcgagggccttcccctcatggtcagtgacttccgcaagcgcatctttggcgaccaagacgccgccgccaccactggaaaccagcaaggttag

SEQ ID NO: 19365 - protein, 435 aa, Sorghum bicolor
  misc_feature: Useful for making plants with altered carbohydrate content
  misc_feature: Functional homolog of the protein sequence given in SEQ ID NO 13747
  misc_feature: Useful for making plants with altered cell wall content and/or composition
  misc_feature: Functional homolog of the protein sequence given in SEQ ID NO 13824
  misc_feature: Ceres ANNOT ID no. 8731895
  misc_feature: Up-regulated in shoot tissues in response to methyl jasmonate treatment
  misc_feature: Down-regulated in root tissues in response to methyl jasmonate treatment
  misc_feature (125)..(420): SWISSPROT Homolog: EC 4.1.1.35 UDP-glucuronate decarboxylase
  misc_feature (126)..(349): Pfam ID: Epimerase Pfam Description: NAD dependent epimerase/dehydratase family
MASELTYRGGGPSAAASAGAGGYSPKPSKPLAWLPRAARYAVAENRPLFALAGMLIAAAVISIASPSASSTSTTGSAAAVSSYSNNNNNNPLARFSVEPAHHRDVATRHFVGGKVPLGLKRKALRVLVTGGAGFVGSHLVDRLLERGDSVIVVDNFFTGRKDNVLHHLNDPNFEMIRHDVVEPILLEVDQIYHLACPASPHKTNVVGTLNMLGLAKRINAKFLLTSTSEVYGDPLQHPQVETYWGNVNPIGVRSCYDEGKRTAETLTMDYHRGANLEVRIARIFNTYGPRMCIDDGRVVSNFVAQALRKEPLTVYGDGKQTRSFQYVSDLVEGLMKLMEGDHVGPFNLGNPGEFTMLELAKVVQDTIDPNAQIEFRQNTQDDPHKRKPDISRAKELLGWEPKIPLREGLPLMVSDFRKRIFGDQDAAATTGNQQG

SEQ ID NO: 19366 - DNA, 276 bp, Sorghum bicolor
  misc_feature: Ceres ANNOT ID no. 8731925
  misc_feature: Up-regulated in shoot tissues in response to methyl jasmonate treatment
  misc_feature: Down-regulated in root tissues in response to methyl jasmonate treatment
  misc_feature: Encodes the peptide sequence at SEQ ID NO 19367
atggcatttgtcagtcctaggaatggaatcgacgtgagggggtattctgtttggtcattcatggatctgtatgagatattcggtgggttcaagacgcattatggcattattgctgtgaatttcgacactgaagaacggacaagacagctgagacgttctgctcactcgtactctgacttcttgaagaacaatgccgtgatcaaagtggagggtgattttgcagctaaagtctattctcaactctggtcgcttaagcttatccgtcgaatctattag

SEQ ID NO: 19367 - protein, 91 aa, Sorghum bicolor
  misc_feature: Useful for making plants with altered cell wall content and/or composition
  misc_feature: Functional homolog of the protein sequence given in SEQ ID NO 14703
  misc_feature: Ceres ANNOT ID no. 8731925
  misc_feature (8)..(65): SWISSPROT Homolog: EC 3.2.1.21 Beta-glucosidase
MAFVSPRNGIDVRGYSVWSFMDLYEIFGGFKTHYGIIAVNFDTEERTRQLRRSAHSYSDFLKNNAVIKVEGDFAAKVYSQLWSLKLIRRIY

SEQ ID NO: 19368 - DNA, 1530 bp, Sorghum bicolor
  misc_feature: Ceres ANNOT ID no. 8731931
  misc_feature: Encodes the peptide sequence at SEQ ID NO 19369
atggggggacgcttgctgcttttcttgccatggctgctgcagctgctgcttccatcacacgatgtaacggcgttccgtttcacagtggatgacttccctgacggatttgcgtttggagctgggactgcagcttttcagtatgagggtgcagtggatgaggatgggaagagcccaagcatttggaacacttatgctcactcagcaagaaacccgaatgagcacagtggtgattttgctgctgatggttatcacaagtataaggaggatgtaaagctaatgaaagacataggcctgaaggcttacaggttcaccatatcttggtcaagactaattcctaatgggagaggagcagtgaacccaaaagggctgcagttctacaacgatatgataaatgagctagtgaaagaaggtattcaggtacatgctgccctttaccatctagacctcccccaaattcttgaggatgagtacaatggatggctgagccccagaattgtagacgacttcacagcatatgcggacgtttgttttcgcgagtttggcgatagggtggcacactggacaactatgatggaaccaaacatcattgctcaaggttcctatgatattggaattgtggcccctggacgttgttcatatccatttgggcatgattgcacagctggcaactccaccgtggagccttacctgtttctacactacaatctgctagctcactcctcggttgtcaggctataccgggagaagtaccaagctgtgcggaagggcgttgtgggcataaacctctactccttgtgcatctactcattgacagatttagctgaagatatccaggcaacggaaagagccaacgacttcttgtttggcagcatcctgaaccctttcttatttggagactacccggagagcatgaagaaggctgccggtgcccgccttccgtccttctccagctatgaatccgagcttgttaccggcgcatttgacttcattggactgaatcactacagctccatatatgcgagcaacaatcctgatgcgtcaaagatgcctgtgcgagatcaagctgctgacgttggagctttgttcagagacaccagggacgggccagctgctatacagtatccagcaggcacaatggttgatcctcaagggctagagcatgtactcaaatacattcgtgaaaagtacgggaacatctcaatttatatccaggaaaacggaaggcctgatgacagcctgatggatgtagacaggattgacttcctgaaggtgtacattgcaagcacattgaaagccataagggacggagcagacgtcaaaggatactctgtgtggtcattactggatctctacgagatgttcgggggttacaaggcgcatttcggcctcatcagcgtcgatttcaatgacctgaggcgtcagaggcagcctaggctgtctgcgtactggtactcagacttcttgaagaataatgttgccattcaggtggacaatggtgaagcaactgcaacttctcatgaacaaatttaa

SEQ ID NO: 19369 - protein, 509 aa, Sorghum bicolor
  misc_feature: Useful for making plants with altered carbohydrate content
  misc_feature: Functional homolog of the protein sequence given in SEQ ID NO 14462
  misc_feature: Useful for making plants with altered cell wall content and/or composition
  misc_feature: Functional homolog of the protein sequence given in SEQ ID NO 14704
  misc_feature: Ceres ANNOT ID no. 8731931
  misc_feature (46)..(467): SWISSPROT Homolog: EC 3.2.1.21 Beta-glucosidase
  misc_feature (28)..(493): Pfam ID: Glyco_hydro_1 Pfam Description: Glycosyl hydrolase family 1
MGGRLLLFLPWLLQLLLPSHDVTAFRFTVDDFPDGFAFGAGTAAFQYEGAVDEDGKSPSIWNTYAHSARNPNEHSGDFAADGYHKYKEDVKLMKDIGLKAYRFTISWSRLIPNGRGAVNPKGLQFYNDMINELVKEGIQVHAALYHLDLPQILEDEYNGWLSPRIVDDFTAYADVCFREFGDRVAHWTTMMEPNIIAQGSYDIGIVAPGRCSYPFGHDCTAGNSTVEPYLFLHYNLLAHSSVVRLYREKYQAVRKGVVGINLYSLCIYSLTDLAEDIQATERANDFLFGSILNPFLFGDYPESMKKAAGARLPSFSSYESELVTGAFDFIGLNHYSSIYASNNPDASKMPVRDQAADVGALFRDTRDGPAAIQYPAGTMVDPQGLEHVLKYIREKYGNISIYIQENGRPDDSLMDVDRIDFLKVYIASTLKAIRDGADVKGYSVWSLLDLYEMFGGYKAHFGLISVDFNDLRRQRQPRLSAYWYSDFLKNNVAIQVDNGEATATSHEQI

SEQ ID NO: 19370 - DNA, 1578 bp, Sorghum bicolor
  misc_feature: Ceres ANNOT ID no. 8731936
  misc_feature: Encodes the peptide sequence at SEQ ID NO 19371
atgaagagcggcagctgcaggcacgtcttcctcgtggtgtcgctgcagctgcttcttgtggcgccatggcagggcgagacggcagcagcagctcgagctctcaacttcaccaggcaggattttcccagggccttcgtctttggggccggcacatcagcttatcagtacgaaggggcaaccgatgaagatggaaggagcccaagcatatgggacacgtttactcatgcagggaggatgccggacaaaagcactggcgatctaggggcagacggctaccacaaatacaaggaagatgtggaattgatgagtgatactggcctggaggcctaccgcttctccatttcttggtccaggcttcttccaagaggaagaggacccatcaaccccaagggtcttcagtattacaacaacctcatcaatgagctaatcaaacggggaatcgagatacacgtgaccctgtaccacctggatttccctcagatcctggaggacgagtaccatggctggctcagccccagggtggtggaggacttcacggcgtacgcggacgtgtgcttccgggagttcggcgaccgggtgaagcactggacgaccatggacgagccgaacgtgatctccatcgcggcctacgacaacggcgccttcccgccgtgccgctgctccgcgccgttcggggtcaactgcaccgcgggcaactccagcgtggagccctacgtcgtcggctaccactccatcctggcgcacgccgccgccgccagactctacagggagaagtaccaggcgacgcagaacggcgtcgtcggcatgaacgtctacagcttctggaactacccgttctcgtcagcccccgctgatgttgccgccacgcagagatcactcgacttcatgattggctggatcgtgaaccccttggtgtttggagactaccctgaagtgatgaagaggataatcgggtcccggcttcccagattcaccaaagaacagtctgagatgatccgtgggacggctgatttcattggcataaaccactacacgtcagtgtacgtgagtgatcgatccaacgcagaagacaccacgggtccccgggactataacactgatgtggctgctaccttcagattttctcgcgatgatccagccactggccagtttatcccaatcaacatgccaagcgatccacagggcctgcaatgtatgcttgagtatctcagccaaacctacaacaacattcctgtctacatccaagaaaatggctatggggcgttcttcaatgattccattcatgaccatgagagagcggagtacttgagtggctacattggcagtgcactcgctgcacttaggaatggagccaatgtgaagggatacttcgtttggtcattcctggatgtatttgagctgcttgcaggctacatttcccgattcggcctctatcatgttgattttcaggatccggcgctgccaagggagccaaaattctcagcccagtggtatggcaaatttttgaggagcgaaatcggaataaacatggagaacattatcagtactgatgatgcacgctcacatgctgaacaatga

SEQ ID NO: 19371 - protein, 525 aa, Sorghum bicolor
  misc_feature: Useful for making plants with altered carbohydrate content
  misc_feature: Functional homolog of the protein sequence given in SEQ ID NO 14462
  misc_feature: Useful for making plants with altered cell wall content and/or composition
  misc_feature: Functional homolog of the protein sequence given in SEQ ID NO 14705
  misc_feature: Ceres ANNOT ID no. 8731936
  misc_feature (35)..(481): SWISSPROT Homolog: EC 3.2.1.21 Beta-glucosidase
  misc_feature (37)..(507): Pfam ID: Glyco_hydro_1 Pfam Description: Glycosyl hydrolase family 1
MKSGSCRHVFLVVSLQLLLVAPWQGETAAAARALNFTRQDFPRAFVFGAGTSAYQYEGATDEDGRSPSIWDTFTHAGRMPDKSTGDLGADGYHKYKEDVELMSDTGLEAYRFSISWSRLLPRGRGPINPKGLQYYNNLINELIKRGIEIHVTLYHLDFPQILEDEYHGWLSPRVVEDFTAYADVCFREFGDRVKHWTTMDEPNVISIAAYDNGAFPPCRCSAPFGVNCTAGNSSVEPYVVGYHSILAHAAAARLYREKYQATQNGVVGMNVYSFWNYPFSSAPADVAATQRSLDFMIGWIVNPLVFGDYPEVMKRIIGSRLPRFTKEQSEMIRGTADFIGINHYTSVYVSDRSNAEDTTGPRDYNTDVAATFRFSRDDPATGQFIPINMPSDPQGLQCMLEYLSQTYNNIPVYIQENGYGAFFNDSIHDHERAEYLSGYIGSALAALRNGANVKGYFVWSFLDVFELLAGYISRFGLYHVDFQDPALPREPKFSAQWYGKFLRSEIGINMENIISTDDARSHAEQ

SEQ ID NO: 19372 - DNA, 1365 bp, Sorghum bicolor
  misc_feature: Ceres ANNOT ID no. 8732040
  misc_feature: Encodes the peptide sequence at SEQ ID NO 19373
atggcgtttttttatgaaagaagagatctgcggggaaaggatcaaaataaatcaaaagcacatggtggaccagactctaagaaggatgcagtcatcctgagggatgggagcaatcaacatattgcagcacacactttcacttttcgtgaacttgcagctgccactaagaacttcagacaagattgcttattgggtgagggaggttttggtcgtgtttataaaggacgtttggagaatgggcaggttgttgcagtgaagcaacttgatcgcaatggtcttcaaggaaacagggagtttctggttgaggttctaatgcttagtctgttgcaccatgacaacctagtgaacctaattggatactgtgctgatggggaccaacgtcttcttgtatacgagtttatgccattgggatcacttgaggatcatttgcatgatattccacctgaaaaggaacctctggactggaatacacgtatgaagattgctgctggtgccgccaagggcttagagtacttgcatgataaggcaagtcctcctgttatttacagggatttcaagtcctcaaacattctacttggtgaagggtttcatccgaagctatcagactttggacttgccaaacttggtcctgttggtgacaagactcatgtttcaacacgtgttatgggaacttatggctactgtgctccagagtatgcaatgacagggcagcttacagttaaatctgatgtatatagttttggtgttgtgttccttgaactgattactggccgcaaagcaattgacaacacaaaaccccacggagagcaaaacctagttgcatgggctcgtcctctattcaaggaccgcagaaaatttcctaaaatggctgatccattacttcagggtcgcttccccatgaggggactatatcaagctttagctgttgctgcgatgtgtttgcaagagcaggctgctactcgcccctttataggtgacgtggtcactgctctgtcatacttagcttctcagacatatgatccaaatgcgcctgttcaacataatcggagtaattcatctactccgagggttagccgaggtggcgggagcaatgaccaacgccgtctccgctcaccgaatcaccattctccagatttgagaagggaagccaccgcagcatcaaaatatgaagctgaggttagcaggacaaactctggtagtggttctggtcgccggtctggcttggatgatgtggatatgtcaggttcacaattgggtagtcctgctcacgcaggaaggaagaggggatctcctaggactgctgaaagccagcgtgctatagcagagaccaaaacttgtggggaaaaatcaagagggagaaagtga

SEQ ID NO: 19373 - protein, 454 aa, Sorghum bicolor
  misc_feature: Useful for making plants with modulated drought sensitivity
  misc_feature: Functional homolog of the protein sequence given in SEQ ID NO 14078
  misc_feature: Ceres ANNOT ID no. 8732040
  misc_feature (12)..(377): SWISSPROT Homolog: EC 2.7.11.1 Non-specific serine/threonine protein kinase
  misc_feature (58)..(331): Pfam ID: Pkinase Pfam Description: Protein kinase domain
MAFFYERRDLRGKDQNKSKAHGGPDSKKDAVILRDGSNQHIAAHTFTFRELAAATKNFRQDCLLGEGGFGRVYKGRLENGQVVAVKQLDRNGLQGNREFLVEVLMLSLLHHDNLVNLIGYCADGDQRLLVYEFMPLGSLEDHLHDIPPEKEPLDWNTRMKIAAGAAKGLEYLHDKASPPVIYRDFKSSNILLGEGFHPKLSDFGLAKLGPVGDKTHVSTRVMGTYGYCAPEYAMTGQLTVKSDVYSFGVVFLELITGRKAIDNTKPHGEQNLVAWARPLFKDRRKFPKMADPLLQGRFPMRGLYQALAVAAMCLQEQAATRPFIGDVVTALSYLASQTYDPNAPVQHNRSNSSTPRVSRGGGSNDQRRLRSPNHHSPDLRREATAASKYEAEVSRTNSGSGSGRRSGLDDVDMSGSQLGSPAHAGRKRGSPRTAESQRAIAETKTCGEKSRGRK

SEQ ID NO: 19374 - DNA, 276 bp, Sorghum bicolor
  misc_feature: Ceres ANNOT ID no. 8732065
  misc_feature: Encodes the peptide sequence at SEQ ID NO 19375
atggggattgcttggtcgatgtgtacgctaataaactcaaatttgctaatcacagtctccctaccgtccagtgttacaggaaaaaaaatttcgcgcttgaagaacgcgcacctgagggcgctccccgacgcggcggagaggctggcgctgtgcaaggccgacctgctcgactacgacgcgctggggtcggccgttgccggctgccacggcgtcttccacactgcgtcgcccggatccgatccggtacgtatacgtgtaacctatagtagtacttga

SEQ ID NO: 19375 - protein, 91 aa, Sorghum bicolor
  misc_feature: Useful for making plants with altered carbohydrate content
  misc_feature: Functional homolog of the protein sequence given in SEQ ID NO 14118
  misc_feature: Useful for making plants with altered cell wall content and/or composition
  misc_feature: Useful for making plants with altered lignin content
  misc_feature: Functional homolog of the protein sequence given in SEQ ID NO 13818
  misc_feature: Ceres ANNOT ID no. 8732065
  misc_feature (4)..(77): SWISSPROT Homolog: EC 1.1.1.219 Dihydrokaempferol 4-reductase
MGIAWSMCTLINSNLLITVSLPSSVTGKKISRLKNAHLRALPDAAERLALCKADLLDYDALGSAVAGCHGVFHTASPGSDPVRIRVTYSST

SEQ ID NO: 19376 - DNA, 435 bp, Sorghum bicolor
  misc_feature: Ceres ANNOT ID no. 8732015
  misc_feature: Encodes the peptide sequence at SEQ ID NO 19377
atggagaccaacggcggcaacgggcgtggcaaccacgaggagccccatccgcagcaccacttcgtgctggtgcacggcatgtgccacggcgcgtggtgctggtacaaggcggccacggcgctgcgtcgcgcgggccaccgcgtgacggcgccggacatggccggctgcggcgcgcacccggcgcgcgtcgacgaggtgcgcagcttcgaggagtactcccgcccgctgctggacgcggtggcggcgctgccgcccggcgagcgcgccgtgctcgtcgggcacagccacggcggatgcagcgtcgcgctcgccgccgagaggttcccggacaaggtcgccgcggtcgtgttcgtggccgcgtccatgccggccgtcggccgctccatggccgccgcgaccaccgacgagtataaaattaatatggttctcagctga

SEQ ID NO: 19377 - protein, 144 aa, Sorghum bicolor
  misc_feature: Useful for making plants with modulated drought sensitivity
  misc_feature: Useful for making plants with modulated water use efficiency
  misc_feature: Functional homolog of the protein sequence given in SEQ ID NO 13482
  misc_feature: Ceres ANNOT ID no. 8732015
  misc_feature (18)..(129): SWISSPROT Homolog: EC 3.1.1.78 Polyneuridine-aldehyde esterase
METNGGNGRGNHEEPHPQHHFVLVHGMCHGAWCWYKAATALRRAGHRVTAPDMAGCGAHPARVDEVRSFEEYSRPLLDAVAALPPGERAVLVGHSHGGCSVALAAERFPDKVAAVVFVAASMPAVGRSMAAATTDEYKINMVLS

SEQ ID NO: 19378 - DNA, 1302 bp, Sorghum bicolor
  misc_feature: Ceres ANNOT ID no. 8732029
  misc_feature: Encodes the peptide sequence at SEQ ID NO 19379
atggccgaatggcactgggcatggcgtggcgcaagcggccgcattgacaaaacgccgcagcaccgcaattttggcgtcccagttgccatgtgggggagccgagccgaggccggattcgatgtcacgcgcacccggatgtcattgccgatcgcccttgtagtcggcattgccgccggtggcgccaccttgctcgcggcggcggccgtgctgctcgcgctctggtgcgctgcgcggcggagggcgcggcgtaaccgcaactccgacaccggctcctccgacccctcaacgctagtggagtggggaaaggggggcaggagctcgttggcaccggagccggagcatcaggttgcgaggcaattctcgctcgaggacctggtgcaggccaccaagaacttcagcgacgcgaacatcgtcggcgccgggagcttcgggttggtgtacatgggcctgcttctcgatggcactgttgtcgcgatcaagaggcgcgtgggggcagcaacgcaggtgtttgctgatgaggttaggtggctttcagagattcgtcaccgaaacatcgtaactctcattggttactgtcaagaagggggtctacaaatgctggtgtatgagtacctgcccaatggcagtgtctgtggccatctgtatgcttcatacaatctaccagataccaggaaaggctccgcaacacggcttgagttcaaacaaaggctctcaatagccattggagcagctaaaggtttgaatcatctacacagtcttgatcctcctttgatacacaaagacttcaagacaaacaatgtgctggttgatgaaaatttcattgcaaaggtggctgatgctggacttgttaggttaattagaggatctgacgatgctggcccatcacatgggtttagtaacagtgtttaccaagatccagaggtacaatcgatgactcagttctctgaaagcagcgatgtgtacagctttggagttttccttttggagctaattactggcagggaagcggcgtccttgatacctacagattccagagaatatctggcccactggatggaagcgcatttcagttcaaatgaactgattgacccaagattagccggcaacttcactgcagaaggtatgaaggagcttgtcggcctggcctttcaatgcttgaacccatcatcgagacgccgaccaaggatgaggctagtcgcgaccgaactagaccggattctggagacggagatgtccatgacaacattcatgggcgacggaaccgccatcgtcacgctcgggagccaattgttcacgtcatga

SEQ ID NO: 19379 - protein, 433 aa, Sorghum bicolor
  misc_feature: Useful for making plants with altered cell wall content and/or composition
  misc_feature: Functional homolog of the protein sequence given in SEQ ID NO 14487
  misc_feature: Ceres ANNOT ID no. 8732029
  misc_feature (118)..(417): SWISSPROT Homolog: EC 2.7.11.1 Non-specific serine/threonine protein kinase
  misc_feature (132)..(403): Pfam ID: Pkinase_Tyr Pfam Description: Protein tyrosine kinase
MAEWHWAWRGASGRIDKTPQHRNFGVPVAMWGSRAEAGFDVTRTRMSLPIALVVGIAAGGATLLAAAAVLLALWCAARRRARRNRNSDTGSSDPSTLVEWGKGGRSSLAPEPEHQVARQFSLEDLVQATKNFSDANIVGAGSFGLVYMGLLLDGTVVAIKRRVGAATQVFADEVRWLSEIRHRNIVTLIGYCQEGGLQMLVYEYLPNGSVCGHLYASYNLPDTRKGSATRLEFKQRLSIAIGAAKGLNHLHSLDPPLIHKDFKTNNVLVDENFIAKVADAGLVRLIRGSDDAGPSHGFSNSVYQDPEVQSMTQFSESSDVYSFGVFLLELITGREAASLIPTDSREYLAHWMEAHFSSNELIDPRLAGNFTAEGMKELVGLAFQCLNPSSRRRPRMRLVATELDRILETEMSMTTFMGDGTAIVTLGSQLFTS

SEQ ID NO: 19380 - DNA, 972 bp, Sorghum bicolor
  misc_feature: Ceres ANNOT ID no. 8732156
  misc_feature: Encodes the peptide sequence at SEQ ID NO 19381
atggcattgctcctcggcgtctttgcatccatcccacaaagtgttgaggccatcggggtgtgctacggcatgagcgccaacaacctgccgccggcgagcacggtggtgagcatgtacaagtcgaacggcatcacggcgatgcggctgtacgcgccggaccagggcgcgctccaggccgtgggcggctcgggcatcagcgtcaccgtcggcgcccccaacgacgtgctgtcctccatcgctggcagcccggcggcggcggcgtcgtgggtccgcaacaacatccaggcgtacccttccgtctccttccgctacgtgtgcgtgggcaacgaggtggccggcggcgcggcgcagaacctggcgcccgccatggagaacgtgcacgcggcgctggcggcggcggggctgggccacatcaaggtgacgacgtcggtctcccaggccatcctcggcgtgtacagcccgccgtcggcggcgcagttcacggcggaggcgcagggtttcatgggccccgtgctgcagttcctgtcccggacgggctccccgctgatggccaacatctacccgtacctggcctgggcgtacaacccgagcgccatggacatgagctacgcgctcttcacggcgtcgggcaccgtggtccaggacggcgcgtacgggtaccagaacctcttcgacaccaccgtcgacgccttctacgtcgccatgggcaggaacggaggctccggcgtgccgctggtggtgtcggagagcgggtggccgtccggcggcggcgtgcaggcgacgccggcgaacgccagggtgtacaaccagtacctggtgaaccacgtccggcgagggacgccgaggcacccgggcgccatcgagacgtacctcttctccatgttcaacgagaaccagaaggagagcggcgtggagcagaactggggcctcttctacccaaacatgcagcgggtctaccccatcagcttctag

SEQ ID NO: 19381 - protein, 323 aa, Sorghum bicolor
  misc_feature: Useful for making plants with altered carbohydrate content
  misc_feature: Functional homolog of the protein sequence given in SEQ ID NO 14488
  misc_feature: Useful for making plants with altered cell wall content and/or composition
  misc_feature: Functional homolog of the protein sequence given in SEQ ID NO 14489
  misc_feature: Ceres ANNOT ID no. 8732156
  misc_feature (1)..(323): SWISSPROT Homolog: EC 3.2.1.39 Glucan endo-1,3-beta-D-glucosidase
  misc_feature (18)..(323): Pfam ID: Glyco_hydro_17 Pfam Description: Glycosyl hydrolases family 17
MALLLGVFASIPQSVEAIGVCYGMSANNLPPASTVVSMYKSNGITAMRLYAPDQGALQAVGGSGISVTVGAPNDVLSSIAGSPAAAASWVRNNIQAYPSVSFRYVCVGNEVAGGAAQNLAPAMENVHAALAAAGLGHIKVTTSVSQAILGVYSPPSAAQFTAEAQGFMGPVLQFLSRTGSPLMANIYPYLAWAYNPSAMDMSYALFTASGTVVQDGAYGYQNLFDTTVDAFYVAMGRNGGSGVPLVVSESGWPSGGGVQATPANARVYNQYLVNHVRRGTPRHPGAIETYLFSMFNENQKESGVEQNWGLFYPNMQRVYPISF

SEQ ID NO: 19382 - DNA, 1014 bp, Sorghum bicolor
  misc_feature: Ceres ANNOT ID no. 8732170
  misc_feature: Encodes the peptide sequence at SEQ ID NO 19383
atggcaagccagagtgcagcctccatgttggctacggctgcattgcttctcggcgtctttgccaacatcgctccaaccgtggtggagtccatcggggtgtcctacggcatgagcggcgacaacctgccgccggcgagcagcgtgatcggcatgtacaaggacaacggcatctcgctgatgcggatctacgcgccggaccaggcggcgctccgggccgtgggcggcacgggcatccgcgtggtggtcggcgcgcccaacgacgtgctgtccagcctcgccgccagcccggccgcggccgcgtcgtgggtccgcaacaacatccaggcgtaccccaaggtctccttccgctgcgtctgcgtgggcaacgaggtggccggtggcgcggcgcagaacctggtcccggccatggagaacgtccgcgccgcgctggccgccgccgggctggacggcatcaaggtcaccacgtccgtgtcgcaggcaatcctcggcgggtacaagccgccgtccgccgccgagttcaccgacgaggcgcaggggttcatgggccccgtcctcgacttcctggcgcgcaccggcgcgcctctcatggccagcgtctacccttacttcacctacgccaccaacccgtcggccatggacgtcagctacgcgctcttcaccgctccgggcaccgtcctcaaggacggcgactacgagtaccagaacctcttcgacgccaccgttgactccttctacgtggcgatgggaaaccacggcggctccggcgtgacccttgtggtgtcggagagcgggtggccgtccgctggcggcgtcgcggcgtcgccggagaacgcggccatctacaaccagaacctcatcaaccacgtcggccggggaacgccgcgccacccgggcgccatcgagacgatcctcttctccatgttcaacgagaacctcaaggagaacggcgtggagcagaactgggggctcttctaccccaacatgcagcgcgtctaccccatcagcttcaactga

SEQ ID NO: 19383 - protein, 337 aa, Sorghum bicolor
  misc_feature: Useful for making plants with altered carbohydrate content
  misc_feature: Functional homolog of the protein sequence given in SEQ ID NO 14488
  misc_feature: Useful for making plants with altered cell wall content and/or composition
  misc_feature: Functional homolog of the protein sequence given in SEQ ID NO 14489
  misc_feature: Ceres ANNOT ID no. 8732170
  misc_feature (18)..(337): SWISSPROT Homolog: EC 3.2.1.39 Glucan endo-1,3-beta-D-glucosidase
  misc_feature (31)..(336): Pfam ID: Glyco_hydro_17 Pfam Description: Glycosyl hydrolases family 17
MASQSAASMLATAALLLGVFANIAPTVVESIGVSYGMSGDNLPPASSVIGMYKDNGISLMRIYAPDQAALRAVGGTGIRVVVGAPNDVLSSLAASPAAAASWVRNNIQAYPKVSFRCVCVGNEVAGGAAQNLVPAMENVRAALAAAGLDGIKVTTSVSQAILGGYKPPSAAEFTDEAQGFMGPVLDFLARTGAPLMASVYPYFTYATNPSAMDVSYALFTAPGTVLKDGDYEYQNLFDATVDSFYVAMGNHGGSGVTLVVSESGWPSAGGVAASPENAAIYNQNLINHVGRGTPRHPGAIETILFSMFNENLKENGVEQNWGLFYPNMQRVYPISFN

SEQ ID NO: 19384 - DNA, 414 bp, Sorghum bicolor
  misc_feature: Ceres ANNOT ID no. 8732187
  misc_feature: Encodes the peptide sequence at SEQ ID NO 19385
atgaagaggaagagcccatggtcgctgctgcagctgctttgctgcgccgcaatggtggtcgcgctcctcctctcccaacaaggaagccaggccgcttatttcgtgccgtcgccgggtccagctccggcgccgaccaattcctccgctgctcctcctcctcctccgccagccaagcccaacgcattcccactcccaatgtacggtgtcacccccggcagcctccagccccaagagtgcggcggccggtgcgcggcgcggtgctcggcgacggcgtaccggaagccgtgcctcttcttctgccggaagtgctgcgcgacgtgcctgtgcgtgccggcgggcacctacggcaacaagaacacctgcccctgctacaacaactggaagaccaagaggggaggccccaagtgcccctag

SEQ ID NO: 19385 - protein, 137 aa, Sorghum bicolor
  misc_feature: Useful for making plants with altered alkaloid content
  misc_feature: Useful for making plants with modulated nitrogen use efficiency
  misc_feature: Functional homolog of the protein sequence given in SEQ ID NO 12973
  misc_feature: Useful for making plants with altered terpenoid content
  misc_feature: Functional homolog of the protein sequence given in SEQ ID NO 14097
  misc_feature: Ceres ANNOT ID no. 8732187
  misc_feature (10)..(137): Pfam ID: GASA Pfam Description: Gibberellin regulated protein
MKRKSPWSLLQLLCCAAMVVALLLSQQGSQAAYFVPSPGPAPAPTNSSAAPPPPPPAKPNAFPLPMYGVTPGSLQPQECGGRCAARCSATAYRKPCLFFCRKCCATCLCVPAGTYGNKNTCPCYNNWKTKRGGPKCP

SEQ ID NO: 19386 - DNA, 1059 bp, Sorghum bicolor
  misc_feature: Ceres ANNOT ID no. 8732274
  misc_feature: Encodes the peptide sequence at SEQ ID NO 19387
atgagcgggaggaagaatgcgggcaaggtttccccctggttgctcggcctcatctctttaggatgcttctttgtgacctacaacctcctgacgatgcacggccggggacgggatgggccgcgcaagttcctcggcggcggcgaggatcacgactcaacgggctccggttcggaccccgcgaagcggttccacgtcgcgcttacggcgacggacgcactgtacagtcagtggcagtcgcggataatgcactactggtacaaggagatgagggaccgacctggctctgacatgggtggcttcactaggatccttcactcggggaagcctgatggattgatggatgagatacccaccatggtggttgacccccttcctgaaggcaaggataagggatatattgtcttaaataggccttgggcgtttgtccagtggatccagagagcaaagatcgtagaagattatatactaatggcagagccagatcatgtctttgtgaagcctttgccaaacttagcgcatggtgatgaaccggcagcatttccgtttttctacatcaaaccaactgataatgagaagatattgaggaaattttttccagaagaaaaagggcctgtttcaaatattgatcctattggcaactctccagttataatcaagaaggctcagcttgagaagattgctccaacctggatgaatgtttcattaaaaatgaaagaggatcaggagacagacaaagcatttggatgggtcttggaaatgtatgcatatgcagttgctagtgcactgcatggtgtgcgccatagtctccgtaaagattttatgattcagcctccatgggacctgaaaacggacaacacattcatcatccattatacatatggatgcgattattcaatgaagggtcagctaacttatgggaaaatcggtgaatggcgttttgacaaaagatcttaccttcaatcaccaccaccaagaaatctttctctgccccctccaggagttcctgaaagtgtgattccccgtcacatcgaatctttagacgcatgcatggaatattaa

SEQ ID NO: 19387 - protein, 352 aa, Sorghum bicolor
  misc_feature: Useful for making plants with modulated drought sensitivity
  misc_feature: Functional homolog of the protein sequence given in SEQ ID NO 13235
  misc_feature: Ceres ANNOT ID no. 8732274
MSGRKNAGKVSPWLLGLISLGCFFVTYNLLTMHGRGRDGPRKFLGGGEDHDSTGSGSDPAKRFHVALTATDALYSQWQSRIMHYWYKEMRDRPGSDMGGFTRILHSGKPDGLMDEIPTMVVDPLPEGKDKGYIVLNRPWAFVQWIQRAKIVEDYILMAEPDHVFVKPLPNLAHGDEPAAFPFFYIKPTDNEKILRKFFPEEKGPVSNIDPIGNSPVIIKKAQLEKIAPTWMNVSLKMKEDQETDKAFGWVLEMYAYAVASALHGVRHSLRKDFMIQPPWDLKTDNTFIIHYTYGCDYSMKGQLTYGKIGEWRFDKRSYLQSPPPRNLSLPPPGVPESVIPRHIESLDACMEY

SEQ ID NO: 19388 - DNA, 2355 bp, Sorghum bicolor
  misc_feature: Ceres ANNOT ID no. 8732362
  misc_feature: Encodes the peptide sequence at SEQ ID NO 19389
atgctcgtccaggaccgcgtgtccccgcacgcggccgccgccgccgccgccgcgggccagaaccagaagccgtcctcgtccccgcgcggcgcgccgggggcggaccgccggcacccgcggcctttcgccaagaacctcgacttcgcgacgtgggcgtccgagcactcctccaagctcctcctcctcctcttcgcggtcgcctccgccgccgccgtcttcctcctgcgcggcgcggcgccagacgccgccgcgctgctctgcctcgaccgctccgcccgctcgggctcgggcggccccgccaagctcccgtacccggacgtcgcctggtccaaggtcccgccgctcgcgatcgcggccggtagccccttcgcgtcgttccgggccgagcggtggatcgtggtcgccgtctcgtccccgcccaccgccgcgctggccgcgctcgcgcgcgtcaagggctggcagctcctcgccgtcggcgattcccgcacgcccgcggggtgggagctcaagggcgccatcttcctctccctcgagctgcaggcgcagctcgggtaccgctccgtcgacttcctgccctacggctcccacgtccgcaagacggcgggctacctcttcgccatccagcacggggccaaggtcatcttcgacgccgacgaccgcgccgaggtgcccgggaacgatctggggaagcatttcgacgtcgatttgggatctggagtcaccaaccacccagtgctactacagtacagccacgcggatcccaatcgcactgtggtgaacccctacgtgcactttggccagcgctcggtctggccacgggggctgccgctcgataaggttggggaggtggcccatgaggtgttctacactgaggtcttcagtggtcggcagttcattcagcaggggctgtcagacgggttgccagatgtagatgctgtgttctacttcactagaaagccaccaacttcggcgttcgatctgaggtttgattcagaagctccgaaggtggcactaccacagggcatgatggcaccagtgaactcgttcaatacattgttccagtcaccagctttctgggggctcatgatgccggtgtctgtgagctcaatggcggcagatgtgatccgtgggtactgggcgcaacggatcttgtgggagattggtggatatgtggctttctatcctccgactatttacaggaaggatcatattcaggcatacccatttgcagaggagaaggatctgcacgtgaatgttggtcggctgatcaagttcctgaatgagtggaggtcgaacaagaggacactctttgagaagattcttgatttgagctatgccatggctgaggaagggttctggatggagcaggatgtgagattaacagctgcttggctgcaggatctgctcgctgtgggctatcggcagcctcgtctcatgtcattggagattgataggcagcgtgcaaccattggagagggcgacatgaaggagtttgtgcccaagaagctgccatctgtgcatcttggggtcgatgagattggcacagttaactatgagattggaaatcttattaagtggagaaagaactttggaaatgttgtgatgatcatgcatgttagcgggcctgtggatcgcacagcacttgagtggaggctgctttatggaaggattttcaagacggtcatcattcttgctgagcagagcaatgcagagctcgctgttgaacgatgcacattgtcacacgcttataagtatttgcccaaggtttttgaaagatacagtggtgctgatggatttgtgttcctccaagaccacatgattcttaactactggaacctgatgcaagctgacaaggaaaaactttggattacaaataagattgcacattcctgggttactgttccattggagacgaataaagaggaatggtttgtcaagcaaggtgcgatggtcaagcaggtcattggcagttccccagttcatttccaaacaaactacaaggaaagcatgggcgaagataagattgcattctgtggtagtgaactattctatgtgccccggcggtttgttgaggactttgttgatcttgtgggtcttgttggtgatttggatttgcatcacaagattgcggtcccaatgttcttcttggcaatggacccgcctcaaaattttgactccgatgctctggctggaacagtgttcaagaaccagttgccagccaatgcgacgttctcatctatttatacagctcaagcacctgctgttttccctgtgaaagttatgaatgagattgatttcataaaggtgattcggctaatgtccataggagacccacttctgatggagttggtataa

SEQ ID NO: 19389 - protein, 784 aa, Sorghum bicolor
  misc_feature: Useful for making plants with altered cell wall content and/or composition
  misc_feature: Functional homolog of the protein sequence given in SEQ ID NO 14014
  misc_feature: Ceres ANNOT ID no. 8732362
MLVQDRVSPHAAAAAAAAGQNQKPSSSPRGAPGADRRHPRPFAKNLDFATWASEHSSKLLLLLFAVASAAAVFLLRGAAPDAAALLCLDRSARSGSGGPAKLPYPDVAWSKVPPLAIAAGSPFASFRAERWIVVAVSSPPTAALAALARVKGWQLLAVGDSRTPAGWELKGAIFLSLELQAQLGYRSVDFLPYGSHVRKTAGYLFAIQHGAKVIFDADDRAEVPGNDLGKHFDVDLGSGVTNHPVLLQYSHADPNRTVVNPYVHFGQRSVWPRGLPLDKVGEVAHEVFYTEVFSGRQFIQQGLSDGLPDVDAVFYFTRKPPTSAFDLRFDSEAPKVALPQGMMAPVNSFNTLFQSPAFWGLMMPVSVSSMAADVIRGYWAQRILWEIGGYVAFYPPTIYRKDHIQAYPFAEEKDLHVNVGRLIKFLNEWRSNKRTLFEKILDLSYAMAEEGFWMEQDVRLTAAWLQDLLAVGYRQPRLMSLEIDRQRATIGEGDMKEFVPKKLPSVHLGVDEIGTVNYEIGNLIKWRKNFGNVVMIMHVSGPVDRTALEWRLLYGRIFKTVIILAEQSNAELAVERCTLSHAYKYLPKVFERYSGADGFVFLQDHMILNYWNLMQADKEKLWITNKIAHSWVTVPLETNKEEWFVKQGAMVKQVIGSSPVHFQTNYKESMGEDKIAFCGSELFYVPRRFVEDFVDLVGLVGDLDLHHKIAVPMFFLAMDPPQNFDSDALAGTVFKNQLPANATFSSIYTAQAPAVFPVKVMNEIDFIKVIRLMSIGDPLLMELV

SEQ ID NO: 19390 - DNA, 291 bp, Sorghum bicolor
  misc_feature: Ceres ANNOT ID no. 8732346
  misc_feature: Encodes the peptide sequence at SEQ ID NO 19391
atggctaaggccagcaccagcaggctgctcttctccctctcgctcgtcgtcctcctgctcctcgtggagaccactgctccccatggacaggctgacgccatcgactgcggcgcgagctgctcgtaccggtgcagcaattcggggcggcccaagatgtgcctgagggcgtgcggcacctgctgccagcgctgcggctgcgtcccgccgggcacctccggcaacgaggacgtcgtcgtctgcccctgctacgccaacatgacaacccacgacggcaagcacaagtgcccgtga

SEQ ID NO: 19391 - protein, 96 aa, Sorghum bicolor
  misc_feature: Useful for making plants with altered terpenoid content
  misc_feature: Functional homolog of the protein sequence given in SEQ ID NO 14097
  misc_feature: Useful for making plants with modulated oxidative stress sensitivity
  misc_feature: Functional homolog of the protein sequence given in SEQ ID NO 13910
  misc_feature: Ceres ANNOT ID no. 8732346
  misc_feature (6)..(96): Pfam ID: GASA Pfam Description: Gibberellin regulated protein
MAKASTSRLLFSLSLVVLLLLVETTAPHGQADAIDCGASCSYRCSNSGRPKMCLRACGTCCQRCGCVPPGTSGNEDVVVCPCYANMTTHDGKHKCP

SEQ ID NO: 19392 - DNA, 1140 bp, Sorghum bicolor
  misc_feature: Ceres ANNOT ID no. 8732423
  misc_feature: Encodes the peptide sequence at SEQ ID NO 19393
atggagtggacaggaggacagtgcaacgaagcaacgtgcggcgactttgctccagcgacgacagaatccatgtgtataaaatgccggcagtccgcgccttacccggcagcaaagacccaaagtaggtcgacgtcaggaggagccccgaccccgagccggcaggcgacgacagcggcggcagtcctgtggctgtgcgtcctggccgcggcggtcgcgctcgcgagcggccagccgcagtgcgggtcgcaggccggcggcgcgacgtgccgtgactgcctctgctgcagccaatttggcttctgcggcgacacctccgcctactgcggcgccgggtgccagagccagtgcaccggctgcggcccgccgggccccggcgtggcgtccgtggtgccgagggacctcttcgagcggctcctcctccaccgcaacgacgcggcgtgccccgctcgcgggttctacacctacgacgcgttcctcgccgccgccgccgcgttcccggccttcggcacgacgggcggcgacgagcagcggaagcgggaggtcgccgcgttcctgggccagacctcccacgagaccacgggcgggtggccgaccgcccccgacgggcccttctcctggggctactgcttcaagcaggagcgcagtccgccgtccgactactgccagccccggccggagtggccctgcgcgcccggcaagaagtacttcggccgcggccccatccagatctccttcaactacaactacggcccggcggggagagccatcggcgtggacctgctgaacaacccggacctggtggcgaccgaccccgtggtatccttcaagacggcgctgtggttctggatgacggcgagggacaacaagccgtcgtgccacgcggtgatcacggggcagtggacgccgacggcggcggacagggcggccggccggggcgcgccggggtacggcgtgatcaccaacatcatcaacggcgggatcgagtgcgggcacggggccgacccccgggtgacggaccggatcgggttctacaagcgctactgcgatgtcttccgcatcggctacgggagcaacctcgactgcgacggccagaggccgttcaatagcgcggtggccgttgagcagctggcggcgcagtga

SEQ ID NO: 19393 - protein, 379 aa, Sorghum bicolor
  misc_feature: Useful for biocontainment applications
  misc_feature: Useful for making plants with modulated biomass
  misc_feature: Functional homolog of the protein sequence given in SEQ ID NO 13042
  misc_feature: Ceres ANNOT ID no. 8732423
  misc_feature (79)..(367): SWISSPROT Homolog: EC 3.2.1.14 Chitinase
  misc_feature (129)..(361): Pfam ID: Glyco_hydro_19 Pfam Description: Chitinase class I
  misc_feature (77)..(116): Pfam ID: Chitin_bind_1 Pfam Description: Chitin recognition protein
MEWTGGQCNEATCGDFAPATTESMCIKCRQSAPYPAAKTQSRSTSGGAPTPSRQATTAAAVLWLCVLAAAVALASGQPQCGSQAGGATCRDCLCCSQFGFCGDTSAYCGAGCQSQCTGCGPPGPGVASVVPRDLFERLLLHRNDAACPARGFYTYDAFLAAAAAFPAFGTTGGDEQRKREVAAFLGQTSHETTGGWPTAPDGPFSWGYCFKQERSPPSDYCQPRPEWPCAPGKKYFGRGPIQISFNYNYGPAGRAIGVDLLNNPDLVATDPVVSFKTALWFWMTARDNKPSCHAVITGQWTPTAADRAAGRGAPGYGVITNIINGGIECGHGADPRVTDRIGFYKRYCDVFRIGYGSNLDCDGQRPFNSAVAVEQLAAQ

SEQ ID NO: 19394 - DNA, 897 bp, Sorghum bicolor
  misc_feature: Ceres ANNOT ID no. 8732434
  misc_feature: Encodes the peptide sequence at SEQ ID NO 19395
atggagaccctcctctccccctccacattgttcacgccatcactccgtggctctaggagaccgtctctgaccgctagcgtctcgtccaggtccaccgtcgtcgtctcctgcgcgctcaggaggccacaggccgccggcgccgccgtcgctgccaccacctcctcctccaatggagacggcggcatcgacgtcgtcggcaggagctggatgtcgttcctgcaccacggcctggcggcggccgcgctgtcgctcgccatcagcctggccccggcgcccgcgccggcggtggcgtcggagttcgacgtgctgaacgacgggccccccgtggactcgtacgtggtggacgacgccggcgtgctgagccgcgtcaccaagtccgacgtcaagcggctggcccgcgacctcgaggcccgcaagaacatccgcctcaacttcatcaccgtccgcaagctcacgagcaaagctgacgcgttcgagtacgcggaccaagtcctggagaagtggtaccccacgattgaggagggcaacaacaagggcatcgtcgtgctcgtcaccagccagaaggagggcgccgtcaccggaggccccgccttcatccaggccgtcggcgaccagattctcgacgccaccgtgtctgagaaccttccagtgctcgcgaccgacgagaagtacaacgaggcgatcttcagcacggcgaggcggctggcggcggcgatcgaagggctgccggacacgggtggcccgtcgttcaaggagaacaagcgtgagtccaacttcaagaccaaggaggagacggaggagaagcgcgggcagttcacgctcgtcgtcggcggcctgctcgtcatcgccttcgtcgtgcccatggcgcagtactacgcctacatttccaagaagtga

SEQ ID NO: 19395 - protein, 298 aa, Sorghum bicolor
  misc_feature: Useful for biocontainment applications
  misc_feature: Functional homolog of the protein sequence given in SEQ ID NO 14706
  misc_feature: Ceres ANNOT ID no. 8732434
METLLSPSTLFTPSLRGSRRPSLTASVSSRSTVVVSCALRRPQAAGAAVAATTSSSNGDGGIDVVGRSWMSFLHHGLAAAALSLAISLAPAPAPAVASEFDVLNDGPPVDSYVVDDAGVLSRVTKSDVKRLARDLEARKNIRLNFITVRKLTSKADAFEYADQVLEKWYPTIEEGNNKGIVVLVTSQKEGAVTGGPAFIQAVGDQILDATVSENLPVLATDEKYNEAIFSTARRLAAAIEGLPDTGGPSFKENKRESNFKTKEETEEKRGQFTLVVGGLLVIAFVVPMAQYYAYISKK

SEQ ID NO: 19396 - DNA, 1422 bp, Sorghum bicolor
  misc_feature: Ceres ANNOT ID no. 8732538
  misc_feature: Encodes the peptide sequence at SEQ ID NO 19397
atggcgcggttcatcctgagcctgatggagctcggggtcagcgccaccgtgcacatgctcttcggcctctacgtcttcagcacggccgtcgccgccgacatctcgcaggccgccgcggcgtcggggtgcctcctgctgcgccgcccatgggcgcctcccgagggagcgccgctcgtcgacgtcgccgccgcgggggagagcgacgaccgcaggggcgccgcgcccgtcatcctccacgcctcgccgccgcccatcgtcctcgtccacggcatcttcggattcggcaaagggaggctcggtggcctctcctacttcgccggcgccgagaagaaggacgaccgcgtgctcgtcccggatttggggtcgctcaccagcatccatgacagggcgcgcgagctgttctactaccttaagggcgggcaggtggactacggcgaggagcacagcaaggcttgcggccacagcaggtttgggagaatatatcacacagggcactatcctgcgtgggacgagcacagcccggtgcattttgtcgggcactctgctggcgcacaggttgtgagggtgctgcatcagatgcttgccgacaaggctttccctggtcatgatacttctgaagattgggttctgagcctgacttccttgtcgggcgcacttaatggaaccacaagaacttactacgatggcatgctggttgaagatggtaggtccatgaaatatatctgtcttcttcagctctgccggctcggagttattgtgtacgattggctagatattccttggctgaagaattactacaattttggttttgaccactatgagatgtcacggaggaaagtaggcttttcaggtctaattaatctgcttgtggggcacacgggcccatttgccagcggagattggattctacctgaccttacaatccaaggatccatgaaactaaactctagacttaggacctttcccaatacattctacttcagttatgctacaaagaaaacaagaaaattatttggaattacagtgccttcaagtgttcttggagtgcaccccatgctctttctgagagtcctccagatgtgtatgtggcggcaccctcaaagtgcacctctgccttacaaaggatacagggatgaagattgggaagacaatgatggggctttgaacacaatctctatgacacacccccgcattcccattgagcatccacaccgtctggtagtggacgattctgactgccatcctttgcaacctgggatatggtattacaagattattgaagctgaccacattctattcattgtgaatcgggaaagagctggagtgcagttcgatttgctgtacgatggcatttttcagcgctgcagaaagcatgcctttaggaagagcccacctactgtaccaaacgaaacaagtcaatag

SEQ ID NO: 19397 - protein, 473 aa, Sorghum bicolor
  misc_feature: Useful for making plants with modulated cold sensitivity
  misc_feature: Functional homolog of the protein sequence given in SEQ ID NO 12936
  misc_feature: Ceres ANNOT ID no. 8732538
  misc_feature (120)..(396): SWISSPROT Homolog: EC 3.1.1.3 Triacylglycerol lipase
MARFILSLMELGVSATVHMLFGLYVFSTAVAADISQAAAASGCLLLRRPWAPPEGAPLVDVAAAGESDDRRGAAPVILHASPPPIVLVHGIFGFGKGRLGGLSYFAGAEKKDDRVLVPDLGSLTSIHDRARELFYYLKGGQVDYGEEHSKACGHSRFGRIYHTGHYPAWDEHSPVHFVGHSAGAQVVRVLHQMLADKAFPGHDTSEDWVLSLTSLSGALNGTTRTYYDGMLVEDGRSMKYICLLQLCRLGVIVYDWLDIPWLKNYYNFGFDHYEMSRRKVGFSGLINLLVGHTGPFASGDWILPDLTIQGSMKLNSRLRTFPNTFYFSYATKKTRKLFGITVPSSVLGVHPMLFLRVLQMCMWRHPQSAPLPYKGYRDEDWEDNDGALNTISMTHPRIPIEHPHRLVVDDSDCHPLQPGIWYYKIIEADHILFIVNRERAGVQFDLLYDGIFQRCRKHAFRKSPPTVPNETSQ

SEQ ID NO: 19398 - DNA, 1422 bp, Sorghum bicolor; identical to SEQ ID NO: 19396
  misc_feature: Ceres ANNOT ID no. 8732542
  misc_feature: Encodes the peptide sequence at SEQ ID NO 19399

SEQ ID NO: 19399 - protein, 473 aa, Sorghum bicolor; identical to SEQ ID NO: 19397
  misc_feature: Useful for making plants with modulated cold sensitivity
  misc_feature: Functional homolog of the protein sequence given in SEQ ID NO 12936
  misc_feature: Ceres ANNOT ID no. 8732542
  misc_feature (120)..(396): SWISSPROT Homolog: EC 3.1.1.3 Triacylglycerol lipase

SEQ ID NO: 19400 - DNA, 1242 bp, Sorghum bicolor
  misc_feature: Ceres ANNOT ID no. 8732614
  misc_feature: Encodes the peptide sequence at SEQ ID NO 19401
atgagggaaatcctgcaaatccagggagggcagtgcgggaaccagatcggctccaagttctgggaggtgctggagcgcgtcaacgtcgtctactacaacgaggcctcctgcggcaggttcgtgccgcgcgcggtgctcatggaccggacctcgagcccggcaccatggacgcgcgccgtccgctcgggcccctacggcaatatcttccgcccggaaaacttcgtcttcggccagtccggcgccggcaacaactgggccaagggcgccgagctcatcgactcggtcctcgacgtcgtccgcaaggaggccgagagctgcgactgcctccagggttttgaggtctgccactcgctcggcggtggcacggggtctggcttgggtaccctgctcatttccaagatcagggaggagtgtcggacacggtggtgggagccctataacgccacgctctccgtccaccagctcgtggagaacgccgacgagtgcatggtgctggacaatgaggcactatatgacatctgcttccgcacactgaagctcaccactcctagctttggtgatctgaaccacttgatcaatgccaccatgattggtgtcacctgctgccttcgcttcccagggcagctgaactctgacctccgcaagcttgctgtcaacctgattcccttcccacgcctgcacttcttcatggttagctttgcgccactcacctcacgcggctcccagcagtaccgctccctcaaggtccctgacctgacctgtcatgaccttagccatagaccgatgtgggcgtgcaagaacatgatgtgtgccgcggatccgtgccatggccgctacctgacggcctctaccatgttccggggcaagatgagcaccaaggaggtggaggagcagatgctcagcgtgcagagcaagggctcgtcctgctttgtggagtggattctgaacaacgtgaaatccagcgtttgtgacatccccccgcgtggcctcaccatggcctccaccttcgtcggcagctccacctccattcaggagatgttccggcgtgtgagtcatccgttcacggccatgttcaggaggaaggccttcttgcattggtacacgtgtgagggcatggatgagatggagttcactgaggcggagagcaacatgaacgacctcgtctccgagtaccagcagtaccaggacgctacagccgacgaggaggccggctatgaggacgagaacgcaggggaagagtga

SEQ ID NO: 19401 - protein, 413 aa, Sorghum bicolor
  misc_feature: Useful for making plants with modulated flowering time
  misc_feature: Functional homolog of the protein sequence given in SEQ ID NO 14090
  misc_feature: Ceres ANNOT ID no. 8732614
  misc_feature (26)..(207): Pfam ID: Tubulin Pfam Description: Tubulin/FtsZ family, GTPase domain
  misc_feature (209)..(352): Pfam ID: Tubulin_C Pfam Description: Tubulin/FtsZ family, C-terminal domain
MREILQIQGGQCGNQIGSKFWEVLERVNVVYYNEASCGRFVPRAVLMDRTSSPAPWTRAVRSGPYGNIFRPENFVFGQSGAGNNWAKGAELIDSVLDVVRKEAESCDCLQGFEVCHSLGGGTGSGLGTLLISKIREECRTRWWEPYNATLSVHQLVENADECMVLDNEALYDICFRTLKLTTPSFGDLNHLINATMIGVTCCLRFPGQLNSDLRKLAVNLIPFPRLHFFMVSFAPLTSRGSQQYRSLKVPDLTCHDLSHRPMWACKNMMCAADPCHGRYLTASTMFRGKMSTKEVEEQMLSVQSKGSSCFVEWILNNVKSSVCDIPPRGLTMASTFVGSSTSIQEMFRRVSHPFTAMFRRKAFLHWYTCEGMDEMEFTEAESNMNDLVSEYQQYQDATADEEAGYEDENAGEE

SEQ ID NO: 19402 - DNA, 999 bp, Sorghum bicolor
  misc_feature: Ceres ANNOT ID no. 8732612
  misc_feature: Encodes the peptide sequence at SEQ ID NO 19403
atgagggaggaggaggagcccagctggttcgcgcgcggcggcggcggcgacgagcaccagctcccgcggccggacgagctcatgccgctcacgcagacgctcatcacgcccgatctcgccgtcgccttcgacatcgccacgcacggcggcggggcgggtgcggggggcgccggtggcgcgggcggtggtatgcccgacatcaacggcaacggcggcggcggcggcgcgtcgtcggccgcgggctccagcggcggcgccggcgggggcggcgccggcgacgagccggcgcggacgctcaagcggccgcgcctcgtgtggacgccgcagctgcacaagcgcttcgtcgacgccgtggcgcacctcggcatcaagaacgccgtgcccaagaccataatgcagctgatgagcgtcgacggcctcacgcgcgagaacgtcgcgtcccagctccagaagtaccgcctctacctcaagcgcatgcaggggctcggcggcggaggcggaggcggaggtggaggcggaggcggtggaggtgcggggggaagccactcctcggggtccggcaccgacgcccacaccgagcacctcttcgccacggggcccgtccccttcctcccgccgggccacggccaccgcgcgcccgtcgacacctacccgcccttctcccccatgggcggcgccgcgcaccaccaccaccagcagcaccacgcgacgcagatcggacacttccaccaccccgccgccgcgcgcccgctcgcccaccactacggtgcttcggctaccgccggtttcgaccacggcggcttcctgagccgcgtcgccgcgccgcccgtcgtcggcccgcccgggatgcaccaccaccgcatggtcggcgccggcgccgggatggggatgatggcgcccgcctccttcgccgacgacatggacctcggatcccgaggcgctggcggcagcggcggccgccgcgagctcacgctgttcccgacgtccggggaccactga

SEQ ID NO: 19403 - protein, 332 aa, Sorghum bicolor
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
  misc_feature: Ceres ANNOT ID no. 8732612
  misc_feature (103)..(153): Pfam ID: Myb_DNA-binding Pfam Description: Myb-like DNA-binding domain
MREEEEPSWFARGGGGDEHQLPRPDELMPLTQTLITPDLAVAFDIATHGGGAGAGGAGGAGGGMPDINGNGGGGGASSAAGSSGGAGGGGAGDEPARTLKRPRLVWTPQLHKRFVDAVAHLGIKNAVPKTIMQLMSVDGLTRENVASQLQKYRLYLKRMQGLGGGGGGGGGGGGGGGAGGSHSSGSGTDAHTEHLFATGPVPFLPPGHGHRAPVDTYPPFSPMGGAAHHHHQQHHATQIGHFHHPAAARPLAHHYGASATAGFDHGGFLSRVAAPPVVGPPGMHHHRMVGAGAGMGMMAPASFADDMDLGSRGAGGSGGRRELTLFPTSGDH

SEQ ID NO: 19404 - DNA, 927 bp, Sorghum bicolor
  misc_feature: Ceres ANNOT ID no. 8732629
  misc_feature: Encodes the peptide sequence at SEQ ID NO 19405
atggccgcctcgtcagcatcatcggtgccggtcgtctccacgggatccgtgatcactgtggcggcctcgccgccgccgccgccgcccactggtggtggtggtggtggtggcggctcgatctctgctggtagcacaggcgtcgtcgtcggcggcggcgcaggcacagggtcgccgtgcgcggcgtgcaagttcctgcggcgcaagtgccagccggactgcgtgttcgcgccctacttcccgccggacaacccgcagaagttcgtgcacgtgcaccgcgtcttcggcgccagcaacgtgaccaagatcctcaacgagctccacccctaccagcgcgaggacgccgtcaattcgctcgcctacgaggccgacatgcgcctccgcgaccccgtctacggctgcgtcggcgtcatctccatcctccagcaccgcctccgcctcgtccagcaggagctcgcccgcgccacctacgagctctccaagtaccaggcggcggcggcggcggctgaagccgcatctgtgggcgtgggatcccatggtgatgcggcagcagggatggcggcagtggatttcataggcaacgcggtggccaacgactgcacgcaaaactttatcaatgtcgggcactccacggcggcggcggcgtcgatcagtggagctggcggcgggttcatgcagcagcaagacagcttcggcgcctccgtgcagatgctggccaggagctacgaaggtggagctgctgcgagggtgggcatgaacggaggaggtggatcaggctatggcggcttcgcgtactcgtcggccatgggcgtggtggggcatggtggcatagtgtctgctggtcttggcgggcagcagatcaacggtggacaacagttcttgaagcccagcacgaccgccggggatgaccagcccactgccacgcagtag

SEQ ID NO: 19405 - protein, 308 aa, Sorghum bicolor
  misc_feature: Useful for making plants with modulated biomass
  misc_feature: Functional homolog of the protein sequence given in SEQ ID NO 12922
  misc_feature: Ceres ANNOT ID no. 8732629
MAASSASSVPVVSTGSVITVAASPPPPPPTGGGGGGGGSISAGSTGVVVGGGAGTGSPCAACKFLRRKCQPDCVFAPYFPPDNPQKFVHVHRVFGASNVTKILNELHPYQREDAVNSLAYEADMRLRDPVYGCVGVISILQHRLRLVQQELARATYELSKYQAAAAAAEAASVGVGSHGDAAAGMAAVDFIGNAVANDCTQNFINVGHSTAAAASISGAGGGFMQQQDSFGASVQMLARSYEGGAAARVGMNGGGGSGYGGFAYSSAMGVVGHGGIVSAGLGGQQINGGQQFLKPSTTAGDDQPTATQ

SEQ ID NO: 19406 - DNA, 477 bp, Sorghum bicolor
  misc_feature: Ceres ANNOT ID no. 8732652
  misc_feature: Encodes the peptide sequence at SEQ ID NO 19407
atggcggccgacggcgaggcggcggcgctggagttcacaccgacgtggatcgtcgcggcggtctgctcgctcatcgtgctcctctcgctcgtcgccgagcgatgcctccactacctcggcaagacgctcaagaagaagaaccagaagccgctcttcgaggcgctgctcaaggtcaaagaagagttgatgcttctggggttcatctccctgctgctgacggtgttccaggggatgatccagaggacatgcatccctgaacactggacattccacatgctgccatgcgagaaggcagatgagaaggccaatgaggccgccaccacggagcatttcgttgctgtcgggacccttggcaggatcggtaggcgcctgctgagtgaaggcgctgctgaggctgagcactgccataagaaggtgatcagactcttggaaattggaattttggtgtccattacaattatttttgtttttatctga

SEQ ID NO: 19407 - protein, 158 aa, Sorghum bicolor
  misc_feature: Useful for making plants with modulated biotic stress sensitivity
  misc_feature: Functional homolog of the protein sequence given in SEQ ID NO 13615
  misc_feature: Ceres ANNOT ID no. 8732652
  misc_feature (5)..(152): Pfam ID: Mlo Pfam Description: Mlo family
MAADGEAAALEFTPTWIVAAVCSLIVLLSLVAERCLHYLGKTLKKKNQKPLFEALLKVKEELMLLGFISLLLTVFQGMIQRTCIPEHWTFHMLPCEKADEKANEAATTEHFVAVGTLGRIGRRLLSEGAAEAEHCHKKVIRLLEIGILVSITIIFVFI

SEQ ID NO: 19408 - DNA, 1260 bp, Sorghum bicolor
  misc_feature: Ceres ANNOT ID no. 8732657
  misc_feature: Encodes the peptide sequence at SEQ ID NO 19409
atgagcagagacctcgaggacgggcacggcgctgtcggcagcgttatcgcagcggcaggaggagaggccgcggaggtggcggtgggtggtgacggcggcggcgaggccggcgacgcgcacgacaacgacgtggtgatgccggggttccggttccaccccacggaggaggagctgatcgagttctacctccggcgcaaggtcgagggaaaacgcttcaacgtcgagctcatcgccttcctcgacctctaccgcttcgacccatgggagctcccagcaatggcggtgatgggcgggaaggagtggttcttctacgtgccgagggaccggaagtaccggaacggagacaggccgaaccgggtgacggcgtcggggtactggaaggcgacgggcgctgaccggatgatccgaggcgagaacaaccgccccatcgggctgaagaagacgctcgtgttctactccggcaaggcgcccaagggcgtccgcagcagctggatcatgaacgagtaccgcctcccgccaccggccaccgacgccgaccctctgattcccaagtccgagatctctctctgccgcgtctacaagcgctctggcatcgacgacggccacgggcagtcatcctccagcacccaacaagcttcctcagcgcggcggacctcctcccgcactggtgtgccgacgacgaccgttcggcagcgatcgtcgccgtcatcgacgccactgtcaccgacgcagcagatcagcagcttccatctgctccaaggagaatcatcgtctgcgtcaccgccggcgcccataatggatcatcaagtggtcaccgtgcacagcgcgccaccgcagcttctgcctcatcacccaatgccatgcacgtacgcgccggtgacgacgatgtcaacagtggaagctgcgccgcaatcagcacaggccggcgcggcgactgccctcgcctccacgtactcggtcttcaacatggccgccggcgccgccgctatggccggcagctcaaggtccgtcgacgagctgagcacgctggttggtcccactcccgcccaggcctacgccagcctctcggccgcgacgggcggccacctcctcccattactgacgacgcctccactgccaatgctacaaatgacgccgcatggtgcgctgccgatcgtggcgccgccatcgtcttcatcagtcgctgacaagcttagctgggactggaaccccatacctgacacgacagaccgggattacaatccttctggttttaagtga

SEQ ID NO: 19409 - protein, 419 aa, Sorghum bicolor
  misc_feature: The sequence is a functional homolog of SEQ ID NO 745 in the 11/479,226 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 891 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 344 in the 10/666,642 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Ceres ANNOT ID no. 8732657
  misc_feature (45)..(172): Pfam ID: NAM Pfam Description: No apical meristem (NAM) protein
MSRDLEDGHGAVGSVIAAAGGEAAEVAVGGDGGGEAGDAHDNDVVMPGFRFHPTEEELIEFYLRRKVEGKRFNVELIAFLDLYRFDPWELPAMAVMGGKEWFFYVPRDRKYRNGDRPNRVTASGYWKATGADRMIRGENNRPIGLKKTLVFYSGKAPKGVRSSWIMNEYRLPPPATDADPLIPKSEISLCRVYKRSGIDDGHGQSSSSTQQASSARRTSSRTGVPTTTVRQRSSPSSTPLSPTQQISSFHLLQGESSSASPPAPIMDHQVVTVHSAPPQLLPHHPMPCTYAPVTTMSTVEAAPQSAQAGAATALASTYSVFNMAAGAAAMAGSSRSVDELSTLVGPTPAQAYASLSAATGGHLLPLLTTPPLPMLQMTPHGALPIVAPPSSSSVADKLSWDWNPIPDTTDRDYNPSGFK

SEQ ID NO: 19410 - DNA, 234 bp, Sorghum bicolor
  misc_feature: Ceres ANNOT ID no. 8732677
  misc_feature: Encodes the peptide sequence at SEQ ID NO 19411
atgatcgtccgtccgtcgacggcgtcggcatcacaggcaaaaaaaaattcgcgcttgaagaacacgcacctgagggcgctccccggtgcagcggagaggctggcgctgtgcaaggccgacctactcgactacgacgcgctgcggtcggccgttgccggctgccacgacgtcttccacatcgcgtcgcccgtcaccgacgatccggtacgtatacgtgtaacctatagtacttga

SEQ ID NO: 19411 - protein, 77 aa, Sorghum bicolor
  misc_feature: Useful for making plants with altered carbohydrate content
  misc_feature: Functional homolog of the protein sequence given in SEQ ID NO 14118
  misc_feature: Useful for making plants with altered cell wall content and/or composition
  misc_feature: Useful for making plants with altered lignin content
  misc_feature: Functional homolog of the protein sequence given in SEQ ID NO 13818
  misc_feature: Ceres ANNOT ID no. 8732677
  misc_feature (20)..(67): SWISSPROT Homolog: EC 1.1.1.219 Dihydrokaempferol 4-reductase
MIVRPSTASASQAKKNSRLKNTHLRALPGAAERLALCKADLLDYDALRSAVAGCHDVFHIASPVTDDPVRIRVTYST

SEQ ID NO: 19412 - DNA, 774 bp, Sorghum bicolor
  misc_feature: Ceres ANNOT ID no. 8732666
  misc_feature: Encodes the peptide sequence at SEQ ID NO 19413
atggaccccggcgccggcgcgcactactccgcccgtaccgcggaggaggtcttccgcgacttccgcggccgccgcgcgggcatgatcaaggccctcaccaacgatgtggagaagttctaccagctgtgcgaccccgaaaaggaaaacttgtgcctttatggctaccccaacgaaacatgggaagtaactttgccagcagaggaagttcctccggagatccctgaaccagctttgggtataaactttgctagggatggcatgaatgagaaggattggttggcgctagttgctgttcatagcgattcctggttactagctgttgcattctactttgcggcccggtttgggtttgacaaagaggccaggcggcgactcttcaacatgataaataacttgcccacgatatttgaagtagtgactggggttgccaagaaacaaaacaaggagaagggccccaatagtaccagcaaaagcaacaaaccaagttcgaaaatgacatcaagacccgagtctcattcgaaggcgacaaaagtggcagcgccccccaaggatgacgatgatgagagcggtgaagaatatgaagaagaggaagagcgtgataacaccttatgtggatcctgtgggacaaatgatggcaaggatgaattctggatctgttgtgatagttgtgagcggtggtaccatgggaagtgtgttaagatcacacctgcgcgtgccgagcacatcaagcactacaaatgcccagattgcagcaacaagagggcaagagcctag

SEQ ID NO: 19413 - protein, 257 aa, Sorghum bicolor
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1981 in the 11/479,226 US patent application
  misc_feature: Useful for making plants with altered alkaloid content
  misc_feature: Functional homolog of the protein sequence given in SEQ ID NO 13176
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Useful for making plants with altered lignin content
  misc_feature: Useful for making plants with modulated flowering time
  misc_feature: Functional homolog of the protein sequence given in SEQ ID NO 13473
  misc_feature: Ceres ANNOT ID no. 8732666
  misc_feature (201)..(250): SWISSPROT Homolog: EC 2.1.1.43 Histone-lysine N-methyltransferase
  misc_feature (203)..(253): Pfam ID: PHD Pfam Description: PHD-finger
MDPGAGAHYSARTAEEVFRDFRGRRAGMIKALTNDVEKFYQLCDPEKENLCLYGYPNETWEVTLPAEEVPPEIPEPALGINFARDGMNEKDWLALVAVHSDSWLLAVAFYFAARFGFDKEARRRLFNMINNLPTIFEVVTGVAKKQNKEKGPNSTSKSNKPSSKMTSRPESHSKATKVAAPPKDDDDESGEEYEEEEERDNTLCGSCGTNDGKDEFWICCDSCERWYHGKCVKITPARAEHIKHYKCPDCSNKRARA

SEQ ID NO: 19414 - DNA, 1005 bp, Sorghum bicolor
  misc_feature: Ceres ANNOT ID no. 8732688
  misc_feature: Encodes the peptide sequence at SEQ ID NO 19415
atgagcggcggcggcggcggaggccgagcgccggcggcgcagtcgcaggagctgcagctgccgccggggttccggttccacccgaccgacgaggagctggtgatgcactacctctgccggcgctgcgccgggcttcccatctccgtgcccatcatcgccgagatcgatctctacaagttcgacccctggcagctcccaaggatggcgctgtacggcgagaaggagtggtacttcttctcgccgcgggaccgcaagtacccgaacgggtcgcggccgaaccgcgccgccggcgccgggtactggaaggccaccggtgcagacaagccggtgggcacgccgaagccgttggccatcaagaaggcgctcgtcttctacgccggcaaggcgcccaagggcgacaagaccaactggatcatgcatgagtaccgcctcgccgacgtcgaccgcaccgcccgcaacaagaacaacagcctcaggttggatgattgggtactgtgccgaatctacaacaagaaaggcgtgccggagaggccggccggagccggcggggccgaggcgagcagccagcaaggcgcgcaggggtcgatgggctcgccgccggagcagaagccgtccgtgccgccgcatcccacggccggggcggggttatacgcgccgccgccgttctcggacctggcggcgtactgcgaggtccggccgtcggactccatgccccgggcgcacggcgcggactcgagctgctcgggccagggccacgcgctggccgccacgtcgtcgtcgtgcggcggcggcgagcggcctgaggtgcagagccagcccaagatcgccgagtgggagcgcacgttcgccggcgccggtgccggtccggggatcaacccggccggctcgatgctggggcttggcgggcatcatcagctcggcccggcggcggtgggggtggggcagctgcccgccggcgacccgctgctgcaggacatcctcacgtactggggcaaaccgtactga

SEQ ID NO: 19415 - protein, 334 aa, Sorghum bicolor
  misc_feature: The sequence is a functional homolog of SEQ ID NO 890 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 102 in the 10/374,780 US patent application
  misc_feature: The sequence is a functional homolog of SEQ ID NO 886 in the 10/225,066 US patent application
  misc_feature: The sequence is a functional homolog of SEQ ID NO 2012 in the 10/374,780 US patent application
  misc_feature: The sequence is a functional homolog of SEQ ID NO 312 in the 10/412,699 US patent application
  misc_feature: The sequence is a functional homolog of SEQ ID NO 731 in the 11/479,226 US patent application
  misc_feature: The sequence is a functional homolog of SEQ ID NO 853 in the 10/374,780 US patent application
  misc_feature: Useful for making plants with altered terpenoid content
  misc_feature: Functional homolog of the protein sequence given in SEQ ID NO 13966
  misc_feature: The sequence is a functional homolog of SEQ ID NO 891 in the 10/374,780 US patent application
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: The sequence is a functional homolog of SEQ ID NO 1036 in the 10/225,066 US patent application
  misc_feature: The sequence is a functional homolog of SEQ ID NO 216 in the 10/666,642 US patent application
  misc_feature: The sequence is a functional homolog of SEQ ID NO 2608 in the 10/374,780 US patent application
  misc_feature: The sequence is a functional homolog of SEQ ID NO 658 in the 11/435,388 US patent application
  misc_feature: The sequence is a functional homolog of SEQ ID NO 880 in the 10/412,699 US patent application
  misc_feature: Useful for making plants with modulated water use efficiency
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 808 in the 10/225,066 US patent application
  misc_feature: The sequence is a functional homolog of SEQ ID NO 926 in the 11/435,388 US patent application
  misc_feature: The sequence is a functional homolog of SEQ ID NO 98 in the 10/374,780 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 476 in the 10/666,642 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: Useful for making plants with altered carbohydrate content
  misc_feature: Functional homolog of the protein sequence given in SEQ ID NO 13622
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 344 in the 10/666,642 US patent application
  misc_feature: Ceres ANNOT ID no. 8732688
  misc_feature (20)..(145): Pfam ID: NAM Pfam Description: No apical meristem (NAM) protein
MSGGGGGGRAPAAQSQELQLPPGFRFHPTDEELVMHYLCRRCAGLPISVPIIAEIDLYKFDPWQLPRMALYGEKEWYFFSPRDRKYPNGSRPNRAAGAGYWKATGADKPVGTPKPLAIKKALVFYAGKAPKGDKTNWIMHEYRLADVDRTARNKNNSLRLDDWVLCRIYNKKGVPERPAGAGGAEASSQQGAQGSMGSPPEQKPSVPPHPTAGAGLYAPPPFSDLAAYCEVRPSDSMPRAHGADSSCSGQGHALAATSSSCGGGERPEVQSQPKIAEWERTFAGAGAGPGINPAGSMLGLGGHHQLGPAAVGVGQLPAGDPLLQDILTYWGKPY

SEQ ID NO: 19416 - DNA, 657 bp, Sorghum bicolor
  misc_feature: Ceres ANNOT ID no. 8732679
  misc_feature: Encodes the peptide sequence at SEQ ID NO 19417
atgagccgcgcggcgagcggcggcggagccgggaccgggagaggaggaggaggaggagcggagcgagcgcaccggtgccggtacaggggcgtgcggcggcgggcgtggggcaagtgggtgtcggagatccgcgtgcccggcacgcgggagcgcctgtggctgggctcctacgccgcgcccgaggccgccgccgtcgcgcacgacgccgccgcgtgcctcctccgcggcggcggcggccgagcggcggggcaggcccacctcaacttccccgaccgcgccgcctgctacatcgtctacggcggcagccacgggcacgggccgccgctgtcgccgcgctccgtgcagcgcgtcgcgtccgacgccggcatggccgccgacgcgcagatcgtcgacgcgcgggcggcggcggcggctctcgccgcgccgacgacgcgcgtccagcccgccgcgttcgctggcattggcgccgcgcaaggtggggcacaaggcgcggcgtgcgcgccgccgccgtatagcgacggcgctagcagcagcagcagcagtacgtattggtcgacgccgagcgcgagcgccagcagaacctcctccagcactggcagtgagcagccgcttgtttttggggatattagcgtagacgacatagagatcttggtctga

SEQ ID NO: 19417 - protein, 218 aa, Sorghum bicolor
  misc_feature: The sequence is a functional homolog of SEQ ID NO 505 in the 10/374,780 US patent application
  misc_feature: The sequence is a functional homolog of SEQ ID NO 703 in the 10/666,642 US patent application
  misc_feature: Ceres ANNOT ID no. 8732679
  misc_feature (26)..(77): Pfam ID: AP2 Pfam Description: AP2 domain
MSRAASGGGAGTGRGGGGGAERAHRCRYRGVRRRAWGKWVSEIRVPGTRERLWLGSYAAPEAAAVAHDAAACLLRGGGGRAAGQAHLNFPDRAACYIVYGGSHGHGPPLSPRSVQRVASDAGMAADAQIVDARAAAAALAAPTTRVQPAAFAGIGAAQGGAQGAACAPPPYSDGASSSSSSTYWSTPSASASRTSSSTGSEQPLVFGDISVDDIEILV

SEQ ID NO: 19418 - DNA, 1692 bp, Sorghum bicolor
  misc_feature: Ceres ANNOT ID no. 8732710
  misc_feature: Encodes the peptide sequence at SEQ ID NO 19419
atgtctttcgttaggcaagcagacccatcaacatcctgtgcggagaccacttacatccacaaatttgtgccaccaggatcagttttcccagcacaaagatttgtctctggcaccgacttggttcactacggacctcaaccatataatgctgagggctacaaacagtctgctttcaatgggacagtacctcatgaatttcagaacttttacagtactgatagctatgctgaatctcactttaatgaagcaacatattctccagcaatctccaatatatctcagcagaactctcaatctttatcagacaatcagacctctgatcttgaagtagagtttgatgaggatgagatgagactgaagcttcaggagcttgagcatgctttactcgatgatggcgatgagatcttttctgacttctcagggagcattatcgatgagtggaatgatagcattaagaaaaacaatgaatggagcaataccatgaaggatattgtgagtccagactctccaaaagagtcatcacctgagtcaagcctctgctgtcttgacagcaatattggagaagcgcggcacccaaaacagttgctttttgactgtgcagaagcaatatctgaatgtagcatcgatgaagcacaatcaatcataacagaactacgacagaaggtagcaattcaaggagacccttctcagagaattgcagcctatcttgtggagggccttgctgccgcaatacagtcttcaggaaaggggatctatagggccctgaggtgcaaggaggcccctactctgtaccagctttcagctatgcagatcctctttgaaatctgcccatgcttcaggctaggcttcatggctgctaactatgctattctcgaagcctgcaaaggcgaagaggttgtgcacatcattgactttgacatcaaccagggtagccagtatataactcttatccagtccctaagaaataacagtaacaagccacgccttttgaggataactggtgttgatgatccagagtcagtgcacagagctgttggagggctgaaggttgttgggcagcgactagagaagcttgcagaggactgtgaggtaccatttgagttcagggcagtggctgctaacactgaggatgtgacacctggaatgctagattgccgtcctggagaggccctcattgttaactttgcattcctgctgcaccaccttcctgatgaaagcgtctcaattgtgaaccaaagggatcagcttctccgtatggtgaagggtcttcaaccaaaactagtgacgttggtggagcaggatgcaaatactaacaccaccccattccttgccaggttccgggaggtctatgactactattcggcactttttgattcactggatgcaacccttccgagggaaagcccggatagaatgaatgtggagcgccagtgcctcgcacgagaaatcgtcaacatcttagcttgtgaaggtcctgaccgtgtggaaaggtatgaagtggctgggaaatggagagctaggatggcaatggctggctttgcgccgtgcccatttagcagcaacgtgatcaatggcataagatctctactgaaatcgtcgtactgcgataagtacaggttcgagaaggtccacgatggcctccattttggctggggcgacaagacgctcgtcttctcgtcggcgtggcaatag

SEQ ID NO: 19419 - protein, 563 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 12889
  misc_feature: The sequence is a functional homolog of SEQ ID NO 1018 in the 10/225,066 US patent application
  misc_feature: The sequence is a functional homolog of SEQ ID NO 2712 in the 10/374,780 US patent application
  misc_feature: The sequence is a functional homolog of SEQ ID NO 220 in the 10/412,699 US patent application
  misc_feature: The sequence is a functional homolog of SEQ ID NO 443 in the 11/479,226 US patent application
  misc_feature: Ceres ANNOT ID no. 8732710
  misc_feature (167)..(472): Pfam ID: GRAS Pfam Description: GRAS family transcription factor
MSFVRQADPSTSCAETTYIHKFVPPGSVFPAQRFVSGTDLVHYGPQPYNAEGYKQSAFNGTVPHEFQNFYSTDSYAESHFNEATYSPAISNISQQNSQSLSDNQTSDLEVEFDEDEMRLKLQELEHALLDDGDEIFSDFSGSIIDEWNDSIKKNNEWSNTMKDIVSPDSPKESSPESSLCCLDSNIGEARHPKQLLFDCAEAISECSIDEAQSIITELRQKVAIQGDPSQRIAAYLVEGLAAAIQSSGKGIYRALRCKEAPTLYQLSAMQILFEICPCFRLGFMAANYAILEACKGEEVVHIIDFDINQGSQYITLIQSLRNNSNKPRLLRITGVDDPESVHRAVGGLKVVGQRLEKLAEDCEVPFEFRAVAANTEDVTPGMLDCRPGEALIVNFAFLLHHLPDESVSIVNQRDQLLRMVKGLQPKLVTLVEQDANTNTTPFLARFREVYDYYSALFDSLDATLPRESPDRMNVERQCLAREIVNILACEGPDRVERYEVAGKWRARMAMAGFAPCPFSSNVINGIRSLLKSSYCDKYRFEKVHDGLHFGWGDKTLVFSSAWQ

SEQ ID NO: 19420 - DNA, 963 bp, Sorghum bicolor
  misc_feature: Ceres ANNOT ID no. 8732734
  misc_feature: Encodes the peptide sequence at SEQ ID NO 19421
atggccgcttcctcctgcttctcgtctccggcctcggcgttagcggcggtctgcgtgctcttgctcgccctagctggagccgcggtcggtcaccgtcccagcggcggctcggcgctgagctccgcgttctacgacgcgtcgtgccccagcgcctacgacgtcgtccggcgcgtcatccaggacgctcgcgtctccgacgctcgcatcccggccagcctcatccgcctccatttccacgactgcttcgttaacggttgcgacggctcgctcctgctggacgacgacctccaggcgatccagaccgagaagcgtgtgcccgccaacaacaactcggcgcgtggctttccggtggtcgacgacatcaagagcgcgctggaggaagcgtgccccggcatcgtctcctgcgccgacatcctcgccctggcagccgagatctccgtcgaactcgctggaggaccacggtggagggtgcttcttggccggcgagacgccacgacgaccaacgtccagagcgccaggaacctacccaacttcttcgaccccctaagcgtcctccaggagaagtttagaaaccttaacctcgacgacactgacctcgtcgccctccaaggagcgcacacatttggcaaagtacagtgccagttcacgcagcagaattgcactgctggccagtcccgcggcgcactggagaacttggaccaggtcacacccaaggtgttcgacaacaaatattacagcaaccttttacaaggccgcgctcagctcccgtccgaccaggttatgctatcggacccttctgcagcgacaaccactgctcccattgttcatcggttcgcaagcaaccaacaggacttcttcagaaacttcgcggcatccatgattaagatgggaaacattagcccgctgacaggaaaggatggggagatcaggaacaattgccggagggttaacaaacactactga

SEQ ID NO: 19421 - protein, 320 aa, Sorghum bicolor
  misc_feature: Useful for making plants with altered carbohydrate content
  misc_feature: Functional homolog of the protein sequence given in SEQ ID NO 14159
  misc_feature: Useful for making plants with modulated nitrogen use efficiency
  misc_feature: Functional homolog of the protein sequence given in SEQ ID NO 13820
  misc_feature: Useful for making plants with altered cell wall content and/or composition
  misc_feature: Functional homolog of the protein sequence given in SEQ ID NO 14158
  misc_feature: Useful for making plants with modulated light quality response
  misc_feature: Functional homolog of the protein sequence given in SEQ ID NO 13816
  misc_feature: Ceres ANNOT ID no. 8732734
  misc_feature (34)..(213): SWISSPROT Homolog: EC 1.11.1.7 Peroxidase
  misc_feature (55)..(281): Pfam ID: peroxidase Pfam Description: Peroxidase
MAASSCFSSPASALAAVCVLLLALAGAAVGHRPSGGSALSSAFYDASCPSAYDVVRRVIQDARVSDARIPASLIRLHFHDCFVNGCDGSLLLDDDLQAIQTEKRVPANNNSARGFPVVDDIKSALEEACPGIVSCADILALAAEISVELAGGPRWRVLLGRRDATTTNVQSARNLPNFFDPLSVLQEKFRNLNLDDTDLVALQGAHTFGKVQCQFTQQNCTAGQSRGALENLDQVTPKVFDNKYYSNLLQGRAQLPSDQVMLSDPSAATTTAPIVHRFASNQQDFFRNFAASMIKMGNISPLTGKDGEIRNNCRRVNKHY

SEQ ID NO: 19422 - DNA, 963 bp, Sorghum bicolor; identical to SEQ ID NO: 19420
  misc_feature: Ceres ANNOT ID no. 8732731
  misc_feature: Encodes the peptide sequence at SEQ ID NO 19423

SEQ ID NO: 19423 - protein, 320 aa, Sorghum bicolor; identical to SEQ ID NO: 19421
  misc_feature: Useful for making plants with altered carbohydrate content
  misc_feature: Functional homolog of the protein sequence given in SEQ ID NO 14159
  misc_feature: Useful for making plants with modulated nitrogen use efficiency
  misc_feature: Functional homolog of the protein sequence given in SEQ ID NO 13820
  misc_feature: Useful for making plants with altered cell wall content and/or composition
  misc_feature: Functional homolog of the protein sequence given in SEQ ID NO 14158
  misc_feature: Useful for making plants with modulated light quality response
  misc_feature: Functional homolog of the protein sequence given in SEQ ID NO 13816
  misc_feature: Ceres ANNOT ID no. 8732731
  misc_feature (34)..(213): SWISSPROT Homolog: EC 1.11.1.7 Peroxidase
  misc_feature (55)..(281): Pfam ID: peroxidase Pfam Description: Peroxidase

SEQ ID NO: 19424 - DNA, 969 bp, Sorghum bicolor
  misc_feature: Ceres ANNOT ID no. 8732730
  misc_feature: Encodes the peptide sequence at SEQ ID NO 19425
atggccgcttcctcctgcttctcgtcccccgccacggcgtttgcggcgtgctgcatgctcttgctcgccctatctggagccgcgctcggtcaccgtcccagcggcggcggcggctcggcgctgagctccacgttctacgacgcgacctgccccagcgcctacgacgtcgtccggcgcgtcatccaggacgcgcgcgtctccgacgctcgcatcccggccagcctcatccgcctccatttccacgactgtttcgtcaccggttgcgacggctcgctcctgctggacgacgacctcccggcgatccagaccgagaagcgtgtgcccgccaacaacaactcggcgcgtggctttccggtggtcgacgacatcaagagcgcgctggaggaagcgtgccccggcatcgtctcctgcgccgacatcctcgcccttgcagctgagatctccgtcgaactcgctggaggaccacggtggagcgtgcttcttggccggcgagacggcacgacgaccaacgtccagagcgccaggaacctgcccaacttcttcgaccccctgagcgtcctccaggagaagtttagaaacgtcaacctcgacgacactgacctcgtcgccctccaaggagcgcacacattcggcaaagtgcagtgccaattcacgcagcagaattgcacggccgggcagtctagaggcgcattggagaacttggaccaggtcacacccaaggtgttcgacaacaagtattacagcaacctcttacagggccacgctcagctcccgtccgaccaggttatgctgtcggacccttctgcggctgcgaccacggctcccattgttcatcggttcgcaggcaaccaacaggagtttttcagaaacttcgcagcatccatgattaagatgggaaacattagcccactgacagggaaggatggggagatcaggaacaactgccggagggttaacaaacgctactga

SEQ ID NO: 19425 - protein, 322 aa, Sorghum bicolor
  misc_feature: Useful for making plants with altered carbohydrate content
  misc_feature: Functional homolog of the protein sequence given in SEQ ID NO 14159
  misc_feature: Useful for making plants with modulated nitrogen use efficiency
  misc_feature: Functional homolog of the protein sequence given in SEQ ID NO 13820
  misc_feature: Useful for making plants with altered cell wall content and/or composition
  misc_feature: Functional homolog of the protein sequence given in SEQ ID NO 14158
  misc_feature: Useful for making plants with modulated oxidative stress sensitivity
  misc_feature: Functional homolog of the protein sequence given in SEQ ID NO 13607
  misc_feature: Useful for making plants with modulated light quality response
  misc_feature: Functional homolog of the protein sequence given in SEQ ID NO 13816
  misc_feature: Ceres ANNOT ID no. 8732730
  misc_feature (35)..(215): SWISSPROT Homolog: EC 1.11.1.7 Peroxidase
  misc_feature (57)..(283): Pfam ID: peroxidase Pfam Description: Peroxidase
MAASSCFSSPATAFAACCMLLLALSGAALGHRPSGGGGSALSSTFYDATCPSAYDVVRRVIQDARVSDARIPASLIRLHFHDCFVTGCDGSLLLDDDLPAIQTEKRVPANNNSARGFPVVDDIKSALEEACPGIVSCADILALAAEISVELAGGPRWSVLLGRRDGTTTNVQSARNLPNFFDPLSVLQEKFRNVNLDDTDLVALQGAHTFGKVQCQFTQQNCTAGQSRGALENLDQVTPKVFDNKYYSNLLQGHAQLPSDQVMLSDPSAAATTAPIVHRFAGNQQEFFRNFAASMIKMGNISPLTGKDGEIRNNCRRVNKRY

SEQ ID NO: 19426 - DNA, 969 bp, Sorghum bicolor; identical to SEQ ID NO: 19424
  misc_feature: Ceres ANNOT ID no. 8732733
  misc_feature: Encodes the peptide sequence at SEQ ID NO 19427

SEQ ID NO: 19427 - protein, 322 aa, Sorghum bicolor; identical to SEQ ID NO: 19425
  misc_feature: Useful for making plants with altered carbohydrate content
  misc_feature: Functional homolog of the protein sequence given in SEQ ID NO 14159
  misc_feature: Useful for making plants with modulated nitrogen use efficiency
  misc_feature: Functional homolog of the protein sequence given in SEQ ID NO 13820
  misc_feature: Useful for making plants with altered cell wall content and/or composition
  misc_feature: Functional homolog of the protein sequence given in SEQ ID NO 14158
  misc_feature: Useful for making plants with modulated oxidative stress sensitivity
  misc_feature: Functional homolog of the protein sequence given in SEQ ID NO 13607
  misc_feature: Useful for making plants with modulated light quality response
  misc_feature: Functional homolog of the protein sequence given in SEQ ID NO 13816
  misc_feature: Ceres ANNOT ID no. 8732733
  misc_feature (35)..(215): SWISSPROT Homolog: EC 1.11.1.7 Peroxidase
  misc_feature (57)..(283): Pfam ID: peroxidase Pfam Description: Peroxidase

SEQ ID NO: 19428 - DNA, 960 bp, Sorghum bicolor
  misc_feature: Ceres ANNOT ID no. 8732745
  misc_feature: Encodes the peptide sequence at SEQ ID NO 19429
atggcggcttcctctcgcatctcgtctcctgcgtggctgttagccgcgcactggcactgcgctctcctgctcgctctggctggagtcgcccgtggccacgccggcgcggcgctgagctccgcgttctacgacctgtcgtgccccggcgcctacaacgtcgtccgtcgcgtcatccagagcgcgcgcgtctccgacccgcgcatcccggccagtctcatccgcctccacttccatgactgcttcgtcaacggttgcgacggctcccttcttctggacgacgatctcccggcgatccggaccgagaagaacgtgccagccaacaacaactcggcgcgcggcttcccggtggtcgacggcatcaagcgcgcgctggaggaagcgtgcccgggcatcgtctcctgcgctgatatccttgccctcgcagcagagatctcagttgaactcgctggaggaccacgctggagggtgcttcttggccgccgagacggcacgacgaccaacgtccagagtgccaagaaccttcccagccttttcgactcccttgccaagctccaggagaagttcagaaacgtcaacctggacgacactgatctcgttgccctccaaggagcgcacacattcggcaaagtccagtgccagttcacgcgtcacaactgctcggcggggcaaccacagggcgcactagaggacctagaccaagttacacccaccgtgtttgacaacaagtattatggcaacctcttgcacggccaagcgcagttgccgtccgaccaggttatgctatccgaccctacggcaccgagaaccactgcacctgttgttcaccggttcgcgagcaaccaaaaggattttttcacgaactttgtgacatccatgattaagatggggaacatcagcccgctgacagggaaggatggagagatcagaaagaactgccggagggtcaatactcatcaatag

SEQ ID NO: 19429 - protein, 319 aa, Sorghum bicolor
  misc_feature: Useful for making plants with altered carbohydrate content
  misc_feature: Functional homolog of the protein sequence given in SEQ ID NO 14159
  misc_feature: Useful for making plants with modulated nitrogen use efficiency
  misc_feature: Functional homolog of the protein sequence given in SEQ ID NO 13820
  misc_feature: Useful for making plants with altered cell wall content and/or composition
  misc_feature: Functional homolog of the protein sequence given in SEQ ID NO 14158
  misc_feature: Useful for making plants with modulated light quality response
  misc_feature: Functional homolog of the protein sequence given in SEQ ID NO 13816
  misc_feature: Ceres ANNOT ID no. 8732745
  misc_feature (39)..(212): SWISSPROT Homolog: EC 1.11.1.7 Peroxidase
  misc_feature (54)..(280): Pfam ID: peroxidase Pfam Description: Peroxidase
MAASSRISSPAWLLAAHWHCALLLALAGVARGHAGAALSSAFYDLSCPGAYNVVRRVIQSARVSDPRIPASLIRLHFHDCFVNGCDGSLLLDDDLPAIRTEKNVPANNNSARGFPVVDGIKRALEEACPGIVSCADILALAAEISVELAGGPRWRVLLGRRDGTTTNVQSAKNLPSLFDSLAKLQEKFRNVNLDDTDLVALQGAHTFGKVQCQFTRHNCSAGQPQGALEDLDQVTPTVFDNKYYGNLLHGQAQLPSDQVMLSDPTAPRTTAPVVHRFASNQKDFFTNFVTSMIKMGNISPLTGKDGEIRKNCRRVNTHQ

SEQ ID NO: 19430 - DNA, 981 bp, Sorghum bicolor
  misc_feature: Ceres ANNOT ID no. 8732737
  misc_feature: Encodes the peptide sequence at SEQ ID NO 19431
atggcggccgcttcctctcgcgtctcgtctctcgggttgctgctagccgcgcactgcgcactcttgctcgctttggctggagctgctcacgctcacagttacgctcctagcggcggcggcggcggcgtggcgctgagctccgcgttctacgacgagtcgtgccccagcgcctacgacgtcgtccggcgcgtcatccaggacgcgcgcgtctcggacccgcgcctcccggcaagcctcatccgcctccacttccacgactgcttcgtcaatggttgcgacggctcactcctgctggacgacgatctcccggcgatccagtccgagaaacacgcgcccggcaacgacaaatccgcgcgtggcttcgaggttgtcgatgacatcaagagcgcgctggagaaagcgtgccctggcgtcgtctcctgcgccgacatcctcgccctggcagccgagatctccgtcgaactcgctggtgggccgcgatggagggtgttgctcggccggcgagacggcacgacgactaacattgagggcgccaacaacctaccgagccctttcgaccccctgaacaagctccaggagaagttcagaaacttcaacctcgacgacactgacctcgtcgccctccaaggagcgcacacatttggtaaagtacagtgccagttcacgcagcagaattgcacggccggccagtccggcggctcactggagaacctggaccaggtcacgcccaaggtgttcgacaataagtattacagcaacctcttagagggccgcgctcaactccggtccgaccaagttatgctatcggacccttccgcggtggtgaccactgctcccattgttcatcggttcgcaggcaaccaacaggattttttcagaaacttcgcagcatcaatgatcaagatgggaaacattagcccactaacaggaaaggatggggagataaggaacaactgccgaagggttaacaaacgctactaa

SEQ ID NO: 19431 - protein, 326 aa, Sorghum bicolor
  misc_feature: Useful for making plants with altered carbohydrate content
  misc_feature: Functional homolog of the protein sequence given in SEQ ID NO 14159
  misc_feature: Useful for making plants with modulated nitrogen use efficiency
  misc_feature: Functional homolog of the protein sequence given in SEQ ID NO 13820
  misc_feature: Useful for making plants with altered cell wall content and/or composition
  misc_feature: Functional homolog of the protein sequence given in SEQ ID NO 14158
  misc_feature: Useful for making plants with modulated oxidative stress sensitivity
  misc_feature: Functional homolog of the protein sequence given in SEQ ID NO 13607
  misc_feature: Useful for making plants with modulated light quality response
  misc_feature: Functional homolog of the protein sequence given in SEQ ID NO 13816
  misc_feature: Ceres ANNOT ID no. 8732737
  misc_feature (49)..(219): SWISSPROT Homolog: EC 1.11.1.7 Peroxidase
  misc_feature (61)..(287): Pfam ID: peroxidase Pfam Description: Peroxidase
MAAASSRVSSLGLLLAAHCALLLALAGAAHAHSYAPSGGGGGVALSSAFYDESCPSAYDVVRRVIQDARVSDPRLPASLIRLHFHDCFVNGCDGSLLLDDDLPAIQSEKHAPGNDKSARGFEVVDDIKSALEKACPGVVSCADILALAAEISVELAGGPRWRVLLGRRDGTTTNIEGANNLPSPFDPLNKLQEKFRNFNLDDTDLVALQGAHTFGKVQCQFTQQNCTAGQSGGSLENLDQVTPKVFDNKYYSNLLEGRAQLRSDQVMLSDPSAVVTTAPIVHRFAGNQQDFFRNFAASMIKMGNISPLTGKDGEIRNNCRRVNKRY

SEQ ID NO: 19432 - DNA, 981 bp, Sorghum bicolor
  misc_feature: Ceres ANNOT ID no. 8732735
  misc_feature: Encodes the peptide sequence at SEQ ID NO 19433
atggcggcagcttcctcgcgcatctcgtctctggggttgctgatagccgcgcactgcgcgctcttgctcgctttggctggagctgctgctcacggtcgcggtcacgctcccagcggcggcggcgtggcgctgagctccgcgttctacgacgagtcgtgccccagcgcccacgacgtcgcccggcgcgtcatccaggacgcgcgcgtctccgacccgcgcctcccggccagcctcgtccgcctccacttccacgactgcttcgccaacggttgcgatggctcccttctgctggacgacgataacccggcgatccagtccgagaaacacgtgcccggcaacgacaaatccgcgcgtggcttcgaggttgtcgatgacatcaagagcgcgctggagaaagcgtgccctggcatcgtctcctgcgccgacatcctcgccctggcagccgagatctccgtcgaactcgctggagggccacgatggaaggtgctgctcggccggcgagacggcacgacgactaacatcgagagcgccagtaacctaccgagccctttcgacaccctggacaagctccaggagaagttcagaaacttcaacctcgacgacactgacctcgtcgccctccaaggagcgcacacattcggtaaagtccattgccagttcacgcaacagaattgcacggccggccagtcccgtggccgcggcgcactggagaacctggatcaggtcacacccaaggtgtttgacaacaagtactacaataacctcttaaagggccgtgctcagctccggtccgaccaggttatgctatcggaaccttctgctgcggcgactactgctcccattgttcatcggttcgcaaggaaccaacgggattttttcagaaactttgcggcatccatgattaagatgggaaacattagcccgctgacaggaaaggatggggagatcaggaacaactgccggagggtcaacaaacgctag

SEQ ID NO: 19433 - protein, 326 aa, Sorghum bicolor
  misc_feature: Useful for making plants with altered carbohydrate content
  misc_feature: Functional homolog of the protein sequence given in SEQ ID NO 14159
  misc_feature: Useful for making plants with altered cell wall content and/or composition
  misc_feature: Functional homolog of the protein sequence given in SEQ ID NO 14158
  misc_feature: Useful for making plants with modulated nitrogen use efficiency
  misc_feature: Functional homolog of the protein sequence given in SEQ ID NO 13820
  misc_feature: Useful for making plants with modulated oxidative stress sensitivity
  misc_feature: Functional homolog of the protein sequence given in SEQ ID NO 13607
  misc_feature: Useful for making plants with modulated light quality response
  misc_feature: Functional homolog of the protein sequence given in SEQ ID NO 13816
  misc_feature: Ceres ANNOT ID no. 8732735
  misc_feature (44)..(218): SWISSPROT Homolog: EC 1.11.1.7 Peroxidase
  misc_feature (60)..(288): Pfam ID: peroxidase Pfam Description: Peroxidase
MAAASSRISSLGLLIAAHCALLLALAGAAAHGRGHAPSGGGVALSSAFYDESCPSAHDVARRVIQDARVSDPRLPASLVRLHFHDCFANGCDGSLLLDDDNPAIQSEKHVPGNDKSARGFEVVDDIKSALEKACPGIVSCADILALAAEISVELAGGPRWKVLLGRRDGTTTNIESASNLPSPFDTLDKLQEKFRNFNLDDTDLVALQGAHTFGKVHCQFTQQNCTAGQSRGRGALENLDQVTPKVFDNKYYNNLLKGRAQLRSDQVMLSEPSAAATTAPIVHRFARNQRDFFRNFAASMIKMGNISPLTGKDGEIRNNCRRVNKR

SEQ ID NO: 19434 - DNA, 972 bp, Sorghum bicolor
  misc_feature: Ceres ANNOT ID no. 8732746
  misc_feature: Encodes the peptide sequence at SEQ ID NO 19435
atggcggcttcctctcgcatctcgtcccctccggcgtggctgttggccgcgcactgcgctctcatgctcggcgccctggctggagccgcccgtggccactctccgaccgccggcgcggcgcttagctccgcgttctacgaccagtcgtgccccggcgcctacggcatcgtccgtcgcgtcatccaggccgcgcgcgtctccgacccgcgcatcccggccagtctcatccgcctccacttccatgactgcttcgtcaacggttgcgacggctcccttcttctggacgacgatctcccggcgatccagaccgagaagaacgtgccagccaacaacaactcggcgcgcggcttcccggtggtcgacggcatcaagcgggcgctggaggaagcgtgcccgggcatcgtctcctgcgctgatatccttgccctcgcagccgagatctccgttgaactcgctggaggaccacggtggagggtgcttcttggccgccgagacggcacgacgaccaacgtccagagtgctaacaaccttcccagccctttcgacacccttgccaagctccaggagaagttcagaaatgtcaacctcgacgacactgacctcgtcgccctccaaggagcgcacacatttggcaaagtccagtgccagttcacgcgtcacaactgctcggcggggcaaccacagggtgcactagagaacctggatcaggttacacccactgtgtttgacaacaagtattatggcaacctcttgcacggccaagcgcagctatcgtccgaccaggtcatgctatccgaccctgcggcaccgacaaccactgcacctgttgttcaccggttcgcgagtaaccaaaaggatttctttgcgaacttcgtgacatccatgattaagatgggcaacatcagcccgctgacaggaaaggatggagagatcagaaagaactgccggagggtcaatagcaaaggccattga

SEQ ID NO: 19435 - protein, 323 aa, Sorghum bicolor
  misc_feature: Useful for making plants with altered carbohydrate content
  misc_feature: Functional homolog of the protein sequence given in SEQ ID NO 14159
  misc_feature: Useful for making plants with modulated nitrogen use efficiency
  misc_feature: Functional homolog of the protein sequence given in SEQ ID NO 13820
  misc_feature: Useful for making plants with altered cell wall content and/or composition
  misc_feature: Functional homolog of the protein sequence given in SEQ ID NO 14158
  misc_feature: Useful for making plants with modulated light quality response
  misc_feature: Functional homolog of the protein sequence given in SEQ ID NO 13816
  misc_feature: Ceres ANNOT ID no. 8732746
  misc_feature (36)..(215): SWISSPROT Homolog: EC 1.11.1.7 Peroxidase
  misc_feature (57)..(283): Pfam ID: peroxidase Pfam Description: Peroxidase
MAASSRISSPPAWLLAAHCALMLGALAGAARGHSPTAGAALSSAFYDQSCPGAYGIVRRVIQAARVSDPRIPASLIRLHFHDCFVNGCDGSLLLDDDLPAIQTEKNVPANNNSARGFPVVDGIKRALEEACPGIVSCADILALAAEISVELAGGPRWRVLLGRRDGTTTNVQSANNLPSPFDTLAKLQEKFRNVNLDDTDLVALQGAHTFGKVQCQFTRHNCSAGQPQGALENLDQVTPTVFDNKYYGNLLHGQAQLSSDQVMLSDPAAPTTTAPVVHRFASNQKDFFANFVTSMIKMGNISPLTGKDGEIRKNCRRVNSKGH

SEQ ID NO: 19436 - DNA, 963 bp, Sorghum bicolor
  misc_feature: Ceres ANNOT ID no. 8732749
  misc_feature: Encodes the peptide sequence at SEQ ID NO 19437
atggcggcttcctctcgcgtctcgtctcctgggtggctgttagccgcgcactgcgctctcctgctcgccctcctgctggctggagccgcccgtggccacgccggcgcggcgctgagctccgcgttctatgaccagtcgtgccccggcgcctacaacgtcgtccgtcgcgtcatccagagcgcgcgcgtctccgacccgcgcatcccggccagtctcatccgcctccacttccatgactgcttcgtcaacggctgcgatggctctcttcttctggatgacgatctcccggcgatccagaccgagaagaacgtgccagccaacaacaactcggcgcgcggtttcccggtagtcgacggcatcaagcgcgcgctggaggaagcgtgcccgggcatcgtctcctgcgctgatatccttgccctcgcagcagagatctcagttgaactcgctggaggaccacggtggagggtgcttcttggccggcgagacggcaccacgaccaacgtccagagcgccaagaaccttcccagccctttcgactcccttgccaagctccaggagaagttcagaaacgtcaacctggacgacactgatctcgttgccctccaaggagcgcacacattcggcaaagtccagtgccagttcacgcgtcacaactgctcggcggggcaaccacagggcgcactagaggacctagaccaagttacacccaccgtgtttgacaacaagtattatggcaacctcttgcacggccaagcgcagttgccgtccgaccaggttatgctatccgaccctacggcaccgagaaccactgcacctgttgttcaccggttcgcgagcaaccaaaaggattttttcacgaactttgtgacatccatgattaagatggggaacatcagcccgctgacagggaaggatggagagatcagaaagaactgccggagggtcaatagaaaaggcaattga

SEQ ID NO: 19437 - protein, 320 aa, Sorghum bicolor
  misc_feature: Useful for making plants with altered carbohydrate content
  misc_feature: Functional homolog of the protein sequence given in SEQ ID NO 14159
  misc_feature: Useful for making plants with modulated nitrogen use efficiency
  misc_feature: Functional homolog of the protein sequence given in SEQ ID NO 13820
  misc_feature: Useful for making plants with altered cell wall content and/or composition
  misc_feature: Functional homolog of the protein sequence given in SEQ ID NO 14158
  misc_feature: Useful for making plants with modulated light quality response
  misc_feature: Functional homolog of the protein sequence given in SEQ ID NO 13816
  misc_feature: Ceres ANNOT ID no. 8732749
  misc_feature (42)..(212): SWISSPROT Homolog: EC 1.11.1.7 Peroxidase
  misc_feature (54)..(280): Pfam ID: peroxidase Pfam Description: Peroxidase
MAASSRVSSPGWLLAAHCALLLALLLAGAARGHAGAALSSAFYDQSCPGAYNVVRRVIQSARVSDPRIPASLIRLHFHDCFVNGCDGSLLLDDDLPAIQTEKNVPANNNSARGFPVVDGIKRALEEACPGIVSCADILALAAEISVELAGGPRWRVLLGRRDGTTTNVQSAKNLPSPFDSLAKLQEKFRNVNLDDTDLVALQGAHTFGKVQCQFTRHNCSAGQPQGALEDLDQVTPTVFDNKYYGNLLHGQAQLPSDQVMLSDPTAPRTTAPVVHRFASNQKDFFTNFVTSMIKMGNISPLTGKDGEIRKNCRRVNRKGN

SEQ ID NO: 19438 - DNA, 1158 bp, Sorghum bicolor
  misc_feature: Ceres ANNOT ID no. 8732755
  misc_feature: Encodes the peptide sequence at SEQ ID NO 19439
atgtcggggaagggcgtcgtcgtgctgtgcgccgcgagcttcttcgttgggctgctgctcagcggccgggtgacgctgctcacaccgccgtcgtcgaactcgccttcaggctcgcgcggctccaggatccctctgttctctgatggctgcgaccagaagagtaggcgtaagctggacgagagcagccccaaggacatcatgaaggaggtgtcaagaactcacctagcaatccagtccctggacaagtcggtgtcgtcgctggagatggagctggccgtggaacgagccaagcagaacgggggcctcggcgtgagcgtgccgtccaggggcggcggcctcccgaaggcgttcgtggtgatcggcatcaacacggccttcagcagcaagaagcggcgggactcgctgcgggacacctgggtgccccgaggggacaagctgcggcggctggagaaggagaagggcgtcgtggtccgcttcgtgatcgggcacagcgcgacgcccggcggcgcgctggaccgcgccatcgacgtggaggcctcggcgacggcggacttcctgcggctggaccacgtggagggctaccacgagctgtcggccaagacgcggacctacttcgccaccgccgtcgccacctgggacgccgacttctacgtcaaggtcgacgacgacgtgcacgtcaacctgggcatgctcaccagcaggctcaacaagtacagggccaggcctagggtctacatcggctgcatgaagtccggccccgttctgtcgcagaagggcgtcaagtactacgagcaggagtactggaagttcggcgacgagggcaacaagtacttccgccacgccacgggccagatctacgccgtctccagggacctcgcctcatacatctccataaaccagccgatcctgcaccggttcgccaacgaggacgtgtccctcggcgcgtggctcctcgggctggaggtcgagcacgtcgacgatcggagcctctgctgcgccacgccaccagactgcgagtggaagaagcaggccgggaacgtgtgcgcggcgtcgttcgactggtcgtgcagcggcatctgcaagtccgtcgacaggatgagggccatccacaacgcctgcggcgagggcgacggcgccatctggagcgccgccatctga

SEQ ID NO: 19439 - protein, 385 aa, Sorghum bicolor
  misc_feature: Useful for making plants with altered carbohydrate content
  misc_feature: Functional homolog of the protein sequence given in SEQ ID NO 13658
  misc_feature: Ceres ANNOT ID no. 8732755
  misc_feature (99)..(346): SWISSPROT Homolog: EC 2.4.1.134 Galactosylxylosylprotein 3-beta-galactosyltransferase
  misc_feature (130)..(328): Pfam ID: Galactosyl_T Pfam Description: Galactosyltransferase
MSGKGVVVLCAASFFVGLLLSGRVTLLTPPSSNSPSGSRGSRIPLFSDGCDQKSRRKLDESSPKDIMKEVSRTHLAIQSLDKSVSSLEMELAVERAKQNGGLGVSVPSRGGGLPKAFVVIGINTAFSSKKRRDSLRDTWVPRGDKLRRLEKEKGVVVRFVIGHSATPGGALDRAIDVEASATADFLRLDHVEGYHELSAKTRTYFATAVATWDADFYVKVDDDVHVNLGMLTSRLNKYRARPRVYIGCMKSGPVLSQKGVKYYEQEYWKFGDEGNKYFRHATGQIYAVSRDLASYISINQPILHRFANEDVSLGAWLLGLEVEHVDDRSLCCATPPDCEWKKQAGNVCAASFDWSCSGICKSVDRMRAIHNACGEGDGAIWSAAI

SEQ ID NO: 19440 - DNA, 2295 bp, Sorghum bicolor
  misc_feature: Ceres ANNOT ID no. 8732762
  misc_feature: Encodes the peptide sequence at SEQ ID NO 19441
atgccaataaacattgccgccacagcgttgctcgctgtgttggcagccttgttgtgcatgccaccggccacggtggtggcagcgatccggtgggtggaggaggaagatggggcgccaagacaggtgtcgctggatgctagggccttggtagtcgatggcaccaggaggctgctgttcgccggtgagatgcactacaccagaagcacccctgagatgtggccaaaactcattgctaaagcaaaggaaggtggccttgatatgatacagacctatgtattctggaatgttcatgagcctgtgcagggccagtacaacttcgagggaagatatgatcttgtcaggttcatcaaggaaattcaagctcaaggcctctacgtaagcctcaggattggtcccttcatagagtccgaatggaaatatggaggatttccgttttggctacatgatgtcccaaacattaccttccggagtgacaatgaaccctttaagcaacatatgcaaagatttgttacagatatagtaaacatgatgaaacatgaagggctttactacccacaaggaggccccattataacttctcagattgagaacgaataccaaatggttgagcatgcatttggctcaagtgggcagcgttatgtcagttgggcagctgcaatggctgtagaccgacaaacaggtgttccctggacgatgtgcaagcaaaatgatgctccagatccagttatcaatacatgcaacgggctcatttgtggagaaacatttgttggaccaaactcagctaacaagcctgcattatggacagaaaattggacctcacgctatcttatatacggtaatgatacaaaattgaggtctccagaagatatcgcctttgcagttgtgtactttatagcaaggaagaatggaagctatgtgagctactacatgtatcatggaggaacaaacttcgggaggtttgcttcttcatatgtaacaacaagctactatgatgcagctcctcttgatgaatatgaatcacaatgtgtggctttcctagtcaactttgaccggcatcatatatcagaagtagtatttcgtaatatatcactggaactggcccccaaatcgatcagcattctctcggactgtaagagagtagtttttgaaacagctaaggtaactgctcagcatggatcaagaacagctgaagaagtgcagtctttcagtgacattaatacttggacggcattcaaggaaccaattccacaagatgtgagtaaagctatgtacagtggaaaccggctctttgaacatctatcaaccactaaagatgataccgattatctatggtacattgttggctatgaatatacaccgagtgatgatgaccagcctgtgctgattaatgttgagtcacgagcacatatattgcatgcctttgtcaacaatgcatatgtgggtagaatacatgggagccatggtggacctgccaatatcattctcaacacgaatatttctctaaaggaagggccaaacaccatatcattgctaagtgctatggttggatcaccgaaagtgagcatacaacagggacaagagccagaaaatctgctaaacaacgagctatgggggtaccaagttggcttatttggggaaaggaatagcatctacacacaagaaggatcaaaaagtgttgaatggacaactatctacaatttggcatatagcccacttacttggtacaagactacattttccacacccgcgggaaatgacgcagtgacactgaaccttactggtatgggtaagggcgaagtatgggtcaacggagagagcatcggacgatactgggtctctttcaaggctcctagcggcaatccttcacaatctctgtatcacataccacgacaatttctaaaccctcaagacaatatcctggtcctttttgaggaaatgggaggcaacccacagcagataacagtgaacacagtgtcggtcacaagagtatgtgtcaatgtgaatgagctctctgctccatcgcttcaatacaagaataaggaaccagcagtagatctcaggtgtcaggaaggcaaacagatctcggcaattgagtttgcaagctacggaaatcctataggtgactgcaaaaaaattcgtttcggaagctgccatgcaggatcatcagaatctgttgtaaaacaggcttgcttgggtaaaagtgggtgctctattcccataacacctatcaaattcggaggcgatccatgccctggaatcaaaaaatcccttctagttgtggcgaattgcagatga

SEQ ID NO: 19441 - protein, 764 aa, Sorghum bicolor
  misc_feature: Useful for making plants with altered carbohydrate content
  misc_feature: Functional homolog of the protein sequence given in SEQ ID NO 13588
  misc_feature: Useful for making plants with altered cell wall content and/or composition
  misc_feature: Functional homolog of the protein sequence given in SEQ ID NO 14707
  misc_feature: Ceres ANNOT ID no. 8732762
  misc_feature (25)..(518): SWISSPROT Homolog: EC 3.2.1.23 Beta-galactosidase
  misc_feature (48)..(357): Pfam ID: Glyco_hydro_35 Pfam Description: Glycosyl hydrolases family 35
  misc_feature (686)..(763): Pfam ID: Gal_Lectin Pfam Description: Galactose binding lectin domain
MPINIAATALLAVLAALLCMPPATVVAAIRWVEEEDGAPRQVSLDARALVVDGTRRLLFAGEMHYTRSTPEMWPKLIAKAKEGGLDMIQTYVFWNVHEPVQGQYNFEGRYDLVRFIKEIQAQGLYVSLRIGPFIESEWKYGGFPFWLHDVPNITFRSDNEPFKQHMQRFVTDIVNMMKHEGLYYPQGGPIITSQIENEYQMVEHAFGSSGQRYVSWAAAMAVDRQTGVPWTMCKQNDAPDPVINTCNGLICGETFVGPNSANKPALWTENWTSRYLIYGNDTKLRSPEDIAFAVVYFIARKNGSYVSYYMYHGGTNFGRFASSYVTTSYYDAAPLDEYESQCVAFLVNFDRHHISEVVFRNISLELAPKSISILSDCKRVVFETAKVTAQHGSRTAEEVQSFSDINTWTAFKEPIPQDVSKAMYSGNRLFEHLSTTKDDTDYLWYIVGYEYTPSDDDQPVLINVESRAHILHAFVNNAYVGRIHGSHGGPANIILNTNISLKEGPNTISLLSAMVGSPKVSIQQGQEPENLLNNELWGYQVGLFGERNSIYTQEGSKSVEWTTIYNLAYSPLTWYKTTFSTPAGNDAVTLNLTGMGKGEVWVNGESIGRYWVSFKAPSGNPSQSLYHIPRQFLNPQDNILVLFEEMGGNPQQITVNTVSVTRVCVNVNELSAPSLQYKNKEPAVDLRCQEGKQISAIEFASYGNPIGDCKKIRFGSCHAGSSESVVKQACLGKSGCSIPITPIKFGGDPCPGIKKSLLVVANCR

SEQ ID NO: 19442 - DNA, 480 bp, Sorghum bicolor
  misc_feature: Ceres ANNOT ID no. 8732770
  misc_feature: Encodes the peptide sequence at SEQ ID NO 19443
atgaagagctcgagcagcgccggcggcagctctggcacgggcacgggctcgagatccggctctgggtccttcaacctccggaacctgtccaaggtcatcctcccgccgctcggcgggccgtccggccaaagccagtcccatggcgggtcggacaagtgggtcatctcgccgctcgactccagatacagatggtgggatacgttgatggtggtcctggtggcgtactcggcgtgggtgtacccgttcgaggtggccttcatgaacgcgtcccccaagggcgggctggaggtggcggacatcgtcgtcgacctcttcttcgccgtcgacatcgtgctcaccttctttgtcgcctacatcgaccataggacccagctcctcgtccgtgacaggaggaagataaccctcaggtacacaccatgcctttaccttgctccatctctctgcgttgcaattgcaacgtcatactgtagtaggaaatag

SEQ ID NO: 19443 - protein, 159 aa, Sorghum bicolor
  misc_feature: The sequence is a functional homolog of SEQ ID NO 3 in US patent 7235713
  misc_feature: Ceres ANNOT ID no. 8732770
MKSSSSAGGSSGTGTGSRSGSGSFNLRNLSKVILPPLGGPSGQSQSHGGSDKWVISPLDSRYRWWDTLMVVLVAYSAWVYPFEVAFMNASPKGGLEVADIVVDLFFAVDIVLTFFVAYIDHRTQLLVRDRRKITLRYTPCLYLAPSLCVAIATSYCSRK

SEQ ID NO: 19444 - DNA, 1461 bp, Sorghum bicolor
  misc_feature: Ceres ANNOT ID no. 8732807
  misc_feature: Encodes the peptide sequence at SEQ ID NO 19445
atggcggcgccgagcttgatccggctccggccgccgcgtgcatccctcctcatcctgctgctcctcgccctcaacatctccctctccttcgccgccaacttcgagggcttcgactccgacgaccttccctccgcggccggtggactcgatgctgacgatgacgaggaggggctggacggcgtcgacctcccgccccctccgcccatctccctctccacctccgcgccttcacctcccgtcacgacgacatccgcgccgaaccctaacaaccccgctacgcctgcgcctcgggaccccaccccggcgctcgacctctgggacgaggacgagttcgagggcatccccgtgcccgaagcgatctcctccgacgactccgccgcgccggccgaggccgacccgtcagatccctccgcggaggcaccggccgaggcggcgcctgcggcgaagaggaccccggctgagctcctccgcgcgttctccgtcgagatcgcgtgcgtcagcttcctgatctgcttcgtgctcaactacttcactgggaagcggcaaaacgagaacatcgcgctggcctgggccaccaagttcgccaccagggactccatcttcgacaagaacttcagccttctaggcactggcgatggcaaggacacgccactcctgctcaaggaggggcaggacgtgttcaagttctatgccagcgggagacgcttctgccagggcatgctcgccaccatggagatgcgggcgcggcacgacctgctgtcaaagttcgtcgagctggtcttccctaggaaggacaccatcacgtttgaagtggtaatgaacgaagaggccatggaccatgtgattctggctgtggccaggaagaaggcggccaagactatgcagaaagaggagagggatctgcaaaggtttgccaacgttctcacttcggcccctgctggaaggaagtgggtgtcggatgagcttgctgtggtagccgagtctaaggaggttgctggggatatcatcactgaggctgtgcttgatcaggttcttggtgagaaggcatttgagaaatttggaaagtggttcatctcgcttcatatttcagaccagttggcaggatcctacaagaaggtccttacattcaagtttgtattgccagatgcaagcaaaatgtcagagatgacaagattggttgctcttgtgccatacttcattgatttggttgggcgttataagcttagctctcatgctcgctcaaaaactgatggagctagaacaaaggccgctcaagaggctttcagggaactgcagagtgccaggcaggaggccctgcaaaggaaaaaggctgaaaagaagaaactcatggaggaggcagatgccaaattaagtgctgaggcactcaggaagaaagaggaaaaggaaagggctcggcaaatgaagaagtctgggcccaaagtgaagatgctccgctcttaa

SEQ ID NO: 19445 - protein, 486 aa, Sorghum bicolor
  misc_feature: Useful for making plants with modulated biomass
  misc_feature: Functional homolog of the protein sequence given in SEQ ID NO 14708
  misc_feature: Ceres ANNOT ID no. 8732807
MAAPSLIRLRPPRASLLILLLLALNISLSFAANFEGFDSDDLPSAAGGLDADDDEEGLDGVDLPPPPPISLSTSAPSPPVTTTSAPNPNNPATPAPRDPTPALDLWDEDEFEGIPVPEAISSDDSAAPAEADPSDPSAEAPAEAAPAAKRTPAELLRAFSVEIACVSFLICFVLNYFTGKRQNENIALAWATKFATRDSIFDKNFSLLGTGDGKDTPLLLKEGQDVFKFYASGRRFCQGMLATMEMRARHDLLSKFVELVFPRKDTITFEVVMNEEAMDHVILAVARKKAAKTMQKEERDLQRFANVLTSAPAGRKWVSDELAVVAESKEVAGDIITEAVLDQVLGEKAFEKFGKWFISLHISDQLAGSYKKVLTFKFVLPDASKMSEMTRLVALVPYFIDLVGRYKLSSHARSKTDGARTKAAQEAFRELQSARQEALQRKKAEKKKLMEEADAKLSAEALRKKEEKERARQMKKSGPKVKMLRS

SEQ ID NO: 19446 - DNA, 288 bp, Sorghum bicolor
  misc_feature: Ceres ANNOT ID no. 8732803
  misc_feature: Encodes the peptide sequence at SEQ ID NO 19447
atggccagcacatcagccagcgggcggctgctcttctcgctctcgctcgtcgtccttgtgctcctcgtggagaccactgctccccatggacaggctgaggccatcgactgcggcgcgagctgcgcgtaccggtgcagcaagtcggggcggcccaagatgtgccttcgggcgtgcggcacctgctgccagcgctgcggctgcgtcccgccgggcacctccggcaacgagaacgtctgcccctgctacgccaacatgacaacccacaacggcaagcacaagtgcccgtga

SEQ ID NO: 19447 - protein, 95 aa, Sorghum bicolor
  misc_feature: Useful for making plants with altered terpenoid content
  misc_feature: Functional homolog of the protein sequence given in SEQ ID NO 14097
  misc_feature: Useful for making plants with modulated oxidative stress sensitivity
  misc_feature: Functional homolog of the protein sequence given in SEQ ID NO 13910
  misc_feature: Ceres ANNOT ID no. 8732803
  misc_feature (7)..(95): Pfam ID: GASA Pfam Description: Gibberellin regulated protein
MASTSASGRLLFSLSLVVLVLLVETTAPHGQAEAIDCGASCAYRCSKSGRPKMCLRACGTCCQRCGCVPPGTSGNENVCPCYANMTTHNGKHKCP

SEQ ID NO: 19448 - DNA, 1080 bp, Sorghum bicolor
  misc_feature: Ceres ANNOT ID no. 8732813
  misc_feature: Encodes the peptide sequence at SEQ ID NO 19449
atggacaagtacgagcctgttcgggacatcgggtcgggcaacttcggggtggcgcggttgatgcgcaaccgcgagacccgagggctcgtcgccgtcaagctcatcgagcgcggccaccggattgacgagaatgtgtaccgcgagatcgtcaaccaccggtcgctgcggcacccgaacatcatccagttcatagaggtgatcctaacaccgacgcatcttgcaattgtgatggagtatgcggctggtggtgaactatttgatcgaattgtcgatcgtgggcgatttagcgaggatgaggccaggtatttcttccagcagttgatctgtggagtgagctattgccatcacatgcaaatatgccatagagatttgaagctggagaatgttctcttggatggcagcccagctccacggcttaagatatgtgattttggctactccaagtcatcagtactacattcaaggccaaaatctgcagtggggacgccagcatatattgcaccagaggtgctttctcggcgggagtatgatgggaagcttgcagatgtatggtcctgtggagtcactctttttgtcatgcttgtgggagcctatccgtttgaagatcaggatgatcctaaaaatattagaaagacgattcagcggatagcagcaattcaatatactatcccagacaacattcacatatctgatgattgcagacaactcatttcacgtatctttgttagcaatccattaaggagaatcaccatgagggaaataaaaaaccatccatggtttctaaagaacttgccgagggagctcacagaagcggtgcagttatcctacttcaggagggacaacagtgtctctgctttttcagagcaaacaaccgaagaaatcatgaggattgtcaaggaggcgagaaccttgccaaaatcattgagatcaggctatggctacagtgaagaatgctcagatgtggaggaaaatgaagaggagagcgaacccaaagaggtggaagaagaagatgagtgtgataagagggttagggaggtccgcgaaagcggggagctggatatgacctcactgcacatctaa

SEQ ID NO: 19449 - protein, 359 aa, Sorghum bicolor
  misc_feature: Useful for biocontainment applications
  misc_feature: Useful for making plants with modulated biomass
  misc_feature: Useful for making plants with modulated time to senescence
  misc_feature: Functional homolog of the protein sequence given in SEQ ID NO 14093
  misc_feature: Useful for making plants with modulated water use efficiency
  misc_feature: Functional homolog of the protein sequence given in SEQ ID NO 14094
  misc_feature: Ceres ANNOT ID no. 8732813
  misc_feature (1)..(312): SWISSPROT Homolog: EC 2.7.11.1 Non-specific serine/threonine protein kinase
  misc_feature (4)..(260): Pfam ID: Pkinase Pfam Description: Protein kinase domain
MDKYEPVRDIGSGNFGVARLMRNRETRGLVAVKLIERGHRIDENVYREIVNHRSLRHPNIIQFIEVILTPTHLAIVMEYAAGGELFDRIVDRGRFSEDEARYFFQQLICGVSYCHHMQICHRDLKLENVLLDGSPAPRLKICDFGYSKSSVLHSRPKSAVGTPAYIAPEVLSRREYDGKLADVWSCGVTLFVMLVGAYPFEDQDDPKNIRKTIQRIAAIQYTIPDNIHISDDCRQLISRIFVSNPLRRITMREIKNHPWFLKNLPRELTEAVQLSYFRRDNSVSAFSEQTTEEIMRIVKEARTLPKSLRSGYGYSEECSDVEENEEESEPKEVEEEDECDKRVREVRESGELDMTSLHI

SEQ ID NO: 19450 - DNA, 1353 bp, Sorghum bicolor
  misc_feature: Ceres ANNOT ID no. 8732861
  misc_feature: Encodes the peptide sequence at SEQ ID NO 19451
atgtcgttccgcagcatcgttcgtgacgttcgggacagttttggtagcctgtcaaggcgcagctttgaggtgactatcgctggcctttctggactcaccgtgcatcatagggggaaatctcagagcacggtgcatgaggtctgtgatacggatctcataatccaggagagccgttgggctaatctccctcctgagctcctccgcgatgtgatccggaggctggaggccagtgagagcacctggccaaatcgcaagcatgttgtgtcctgcgctgctgtttgtcgagcatggagggagatgtgccgggagattgtgctgagcccggagttttgtgggaagcttacattcccagtttctctaaagcagcccgggcctcgagatggaatgattcaatgtttcataaagcgagataaatcaaagtccacatatcatctctacttgtgcctcagcactgctgtacttatggagaatggcaagttcctcttatcagctaaaaggaaccgcaaaacaacctgcacggagtatgttatctcaatggatgctgagaacatatcgagatctagcagcacatatattggaaagctaaggtcaaacttcctcggcaccaaatttatgatctctgacacgcagcccccttataatggggctgtagtccctcatgctggccggacaagccgaagattcaactccaagaaggtctcccctaaggtgccaactggtagctacaacatagctcaggtgacatatgagctaaatgttcttggcacgagaggccctaggcggatgcactgcgtcatgcactctatacccgcctccgcagttgagcctggtggcatagtccctggacagcctgagcagattctgccccgggcattagaggagtccttccgcagcaccacctccttctccaagtcatccatcatggaccggtccatggatttcagcagctcccgtgacttcagcagtgcccgcttttctgacattgccggaggcgccgccatagctggcgatgaagagggacagaacaaggagaggccgcttgtgctccgcaacaaggccccaagatggcacgagcagctgcagtgctggtgcctcaacttccgtggccgtgtaaccattgcctcggtgaagaatttccagctgatcgctgcgccaagcccggcccctgcccctgctgccagggctccaaccccatcgtcacaacctgttccgcaggaccaagataagatcattctccagtttggtaaggtggccaaggatatgttcactatggactaccgctacccactctcagccttccaggctttcgccatctgtttgagtagcttcgacactaaactggcctgtgagtaa

SEQ ID NO: 19451 - protein, 450 aa, Sorghum bicolor
  misc_feature: The sequence is a functional homolog of SEQ ID NO 130 in the 10/225,068 US patent application
  misc_feature: The sequence is a functional homolog of SEQ ID NO 2896 in the 10/374,780 US patent application
  misc_feature: The sequence is a functional homolog of SEQ ID NO 458 in the 10/666,642 US patent application
  misc_feature: Ceres ANNOT ID no. 8732861
  misc_feature (123)..(444): Pfam ID: Tub Pfam Description: Tub family
  misc_feature (57)..(112): Pfam ID: F-box Pfam Description: F-box domain
MSFRSIVRDVRDSFGSLSRRSFEVTIAGLSGLTVHHRGKSQSTVHEVCDTDLIIQESRWANLPPELLRDVIRRLEASESTWPNRKHVVSCAAVCRAWREMCREIVLSPEFCGKLTFPVSLKQPGPRDGMIQCFIKRDKSKSTYHLYLCLSTAVLMENGKFLLSAKRNRKTTCTEYVISMDAENISRSSSTYIGKLRSNFLGTKFMISDTQPPYNGAVVPHAGRTSRRFNSKKVSPKVPTGSYNIAQVTYELNVLGTRGPRRMHCVMHSIPASAVEPGGIVPGQPEQILPRALEESFRSTTSFSKSSIMDRSMDFSSSRDFSSARFSDIAGGAAIAGDEEGQNKERPLVLRNKAPRWHEQLQCWCLNFRGRVTIASVKNFQLIAAPSPAPAPAARAPTPSSQPVPQDQDKIILQFGKVAKDMFTMDYRYPLSAFQAFAICLSSFDTKLACE

SEQ ID NO: 19452 - DNA, 681 bp, Sorghum bicolor
  misc_feature: Ceres ANNOT ID no. 8732867
  misc_feature: Encodes the peptide sequence at SEQ ID NO 19453
atgagccacccggagaacggaggagccagcaacgggcacgccgccgaggagcatcaggacgtgatgatggaggtggagccgaagcagcgccgggcgccgcggctcaacgagcggatcctctcgtcgctgtcgcggaggtccgtcgccgcgcacccctggcacgacctcgagatcggtcctgaagctccggccgtcttcaacgtcgtcgtggagatcaccaaggggagcaaggtgaagtacgagctggacaagaagacggggctcatcaaggtggaccgcgtcctctactcctccgtcgtctaccctcacaactacggcttcatcccccggacgctctgcgaggacaacgaccccatggacgtcctcgtcctcatgcaggaaccagtccttcccggcgccttcctccgcgccagggccatcggcctcatgcctatgatagatcagggggagaaggacgacaagatcatcgccgtctgcgccgacgatcccgagtaccgccactacaacgacatcagcgagctctctccgcaccgcctccaggagatccgccgcttcttcgaagactacaagaagaacgagaacaaggaggtggccgtcaacgacttcctgcccgccgcagctgcccgtgaagccatccaggacctgtacggtcagtacattatgcagaccctgcggcggtag

SEQ ID NO: 19453 - protein, 226 aa, Sorghum bicolor
  misc_feature: Useful for making plants with modulated nitrogen use efficiency
  misc_feature: Functional homolog of the protein sequence given in SEQ ID NO 13344
  misc_feature: Ceres ANNOT ID no. 8732867
  misc_feature (15)..(226): SWISSPROT Homolog: EC 3.6.1.1 Inorganic diphosphatase
  misc_feature (67)..(221): Pfam ID: Pyrophosphatase Pfam Description: Inorganic pyrophosphatase
MSHPENGGASNGHAAEEHQDVMMEVEPKQRRAPRLNERILSSLSRRSVAAHPWHDLEIGPEAPAVFNVVVEITKGSKVKYELDKKTGLIKVDRVLYSSVVYPHNYGFIPRTLCEDNDPMDVLVLMQEPVLPGAFLRARAIGLMPMIDQGEKDDKIIAVCADDPEYRHYNDISELSPHRLQEIRRFFEDYKKNENKEVAVNDFLPAAAAREAIQDLYGQYIMQTLRR

SEQ ID NO: 19454 - DNA, 711 bp, Sorghum bicolor
  misc_feature: Ceres ANNOT ID no. 8732903
  misc_feature: Encodes the peptide sequence at SEQ ID NO 19455
atggccgagttagcccccgggttccgcttctacccaacggaggaggagctcatctgcttctacctccggaacaagctcagcggcacccgctgcggcgacatcgagcgcgtcatccccgtcgccgacgtctgcgcccttgacccatgggagctctcaggcacgtcgatcgtcgtccctatcctatcggcagagatggagtggacggcggcgcaccgtgccgcgtactccggcaacgaggagccgtggttctacttctgcccgcggcaggagcgcgaggcgcggggcgggcgcccgagccggaccacgccgtcgggctactggaaggcggcgggtacccctgggttggtatacgccgccgacggccgccccatcgggaccaagaagaccatggtgttctaccgcggccgcgcgccggcgggggccaagaccaagtggaagctaaacgagtacaaggctttcgagtacgagtacgacgacgacgacgccaccgccgtcgctgctcatccggcgccgccgagccatgctctccagaaggaatgtacaccatatatatttatttcccgtccatttcatataggctggcaagcaatcatgctgacgagcatcaactgttataaattcgttgccagattacatcattgccatttgatatcatcattatcatcatcatcaggacaaatggattcggagttctatctagtatatatatag

SEQ ID NO: 19455 - protein, 236 aa, Sorghum bicolor
  misc_feature: The sequence is a functional homolog of SEQ ID NO 1170 in the 10/666,642 US patent application
  misc_feature: The sequence is a functional homolog of SEQ ID NO 1171 in the 10/666,642 US patent application
  misc_feature: The sequence is a functional homolog of SEQ ID NO 1400 in the 10/666,642 US patent application
  misc_feature: The sequence is a functional homolog of SEQ ID NO 320 in the 10/412,699 US patent application
  misc_feature: The sequence is a functional homolog of SEQ ID NO 752 in the 11/479,226 US patent application
  misc_feature: The sequence is a functional homolog of SEQ ID NO 432 in the 10/666,642 US patent application
  misc_feature: Ceres ANNOT ID no. 8732903
  misc_feature (4)..(153): Pfam ID: NAM Pfam Description: No apical meristem (NAM) protein
MAELAPGFRFYPTEEELICFYLRNKLSGTRCGDIERVIPVADVCALDPWELSGTSIVVPILSAEMEWTAAHRAAYSGNEEPWFYFCPRQEREARGGRPSRTTPSGYWKAAGTPGLVYAADGRPIGTKKTMVFYRGRAPAGAKTKWKLNEYKAFEYEYDDDDATAVAAHPAPPSHALQKECTPYIFISRPFHIGWQAIMLTSINCYKFVARLHHCHLISSLSSSSGQMDSEFYLVYI

SEQ ID NO: 19456 - DNA, 1170 bp, Sorghum bicolor
  misc_feature: Ceres ANNOT ID no. 8732910
  misc_feature: Encodes the peptide sequence at SEQ ID NO 19457
atggcgcgggcggacgaccaccgcaccgtgaccatgcgctcctccccgcttccgcctccgcgctccatcaatgttgcgtcggcggcgacagcggcggcgccactcaagttcggcatcaactacgggcagatcgcgaacaacctcccgcacccggcgcaggtgtcgggcctgctgcagtcgctgaacgtgaaccgcgtgaagctctacgacgccgacccggccgtgctcacggcgttcgccggcacgggcgtggagttcatcgtcggcaacgaggacctcttcaacctgacggacgcgcgcaaggcccgggcctgggtggcgcagcacgtgcagccgttccttcccggcacgcgcatcacctgcatcaccgtcgggaacgaggtgctctccggcaaggacacggccgccatgcagagcctgctcccggcgatgcaggccgtgtaccaggcggtggtggcgctgggcctcgccgggcaggtgaacgtctcgacggcgcactcggtgaacatcctcgccagcagctacccgccgtcgtcgggcgcgttccgggaggagctcgcggagtacatccagccgatcctcaacttccacgccgaggtcggctcgccgttcctcatcaacgcgtacccgttcttcgcctacaaggcgagccccgggaccgtgtcgctgccgtacgtgctgttcgagcccaacgccggcgtggtggaccccaacaccaacctcacctacgacaacatgctctacgcccagatcgacgccgtgtacgcggccatgaaggccatgggccacacggacctcaccgtcaggatctccgagaccgggtggccgtccaagggggacgacgacgaggtgggcgccaccgtggccaacgccgcggcctacaacgggaacctcatgaagaggatcgccatgggccagggcacgccgctcaagccacgcgtccccgtcgacgtgttcgtcttcgcgctcttcaacgaggacatgaagcccggcccgacgtcggagaggaactacggcttgttttaccccaacggcacccaggtgtacaacctcgggttcgacggagcggcattcagcccatcatcgccgacgtactcctcttcttccaagctgccggcgattacatttcagatggcggtggttgtcctactcgctggcttcttcctatga

SEQ ID NO: 19457 - protein, 389 aa, Sorghum bicolor
  misc_feature: Useful for making plants with altered carbohydrate content
  misc_feature: Functional homolog of the protein sequence given in SEQ ID NO 14709
  misc_feature: Useful for making plants with altered cell wall content and/or composition
  misc_feature: Functional homolog of the protein sequence given in SEQ ID NO 14472
  misc_feature: Useful for making plants with altered lignin content
  misc_feature: Functional homolog of the protein sequence given in SEQ ID NO 14156
  misc_feature: Ceres ANNOT ID no. 8732910
  misc_feature (35)..(357): SWISSPROT Homolog: EC 3.2.1.39 Glucan endo-1,3-beta-D-glucosidase
  misc_feature (37)..(353): Pfam ID: Glyco_hydro_17 Pfam Description: Glycosyl hydrolases family 17
MARADDHRTVTMRSSPLPPPRSINVASAATAAAPLKFGINYGQIANNLPHPAQVSGLLQSLNVNRVKLYDADPAVLTAFAGTGVEFIVGNEDLFNLTDARKARAWVAQHVQPFLPGTRITCITVGNEVLSGKDTAAMQSLLPAMQAVYQAVVALGLAGQVNVSTAHSVNILASSYPPSSGAFREELAEYIQPILNFHAEVGSPFLINAYPFFAYKASPGTVSLPYVLFEPNAGVVDPNTNLTYDNMLYAQIDAVYAAMKAMGHTDLTVRISETGWPSKGDDDEVGATVANAAAYNGNLMKRIAMGQGTPLKPRVPVDVFVFALFNEDMKPGPTSERNYGLFYPNGTQVYNLGFDGAAFSPSSPTYSSSSKLPAITFQMAVVVLLAGFFL

SEQ ID NO: 19458 - DNA, 558 bp, Sorghum bicolor
  misc_feature: Ceres ANNOT ID no. 8732899
  misc_feature: Encodes the peptide sequence at SEQ ID NO 19459
atggccttctactacggtgtgagcggaggacagtcgtcgtcgtgggcggcgccgccgccggcgggcagcaggccgtggaccaaggcggaggacaaggccttcgagggcgcgctggtgatgttcccggagcacttgccgaaccggtgggcgctggtggcgtcgcggctgcacgaccgcacgccgcaggaggcatgggaccactaccaggcgctggtcaccgacgtcgacctcatcgagcgcggcatggtcgacgcccctgactcctgggacgacgacgcggccgccggagggggacgcgccggccgcggccgcgggggcggcagcggagaggagcgccgccgcggggtgccgtggactgaggacgagcacaggctgtttctggaggggctggagaagtacgggcgcggcgactggcggaacatctcgcggtggtcggtgaagacgcggacgccgacgcaggtggcgagccacgcgcagaagtacttcatccggcaggccagcgccgccagccgcggcgacaccaagcgcaagagcatccacgacatcaccgccccgtga

SEQ ID NO: 19459 - protein, 185 aa, Sorghum bicolor
  misc_feature: The sequence is a functional homolog of SEQ ID NO 1893 in the 11/479,226 US patent application
  misc_feature: The sequence is a functional homolog of SEQ ID NO 2678 in the 10/374,780 US patent application
  misc_feature: The sequence is a functional homolog of SEQ ID NO 340 in the 10/225,066 US patent application
  misc_feature: Ceres ANNOT ID no. 8732899
  misc_feature (115)..(162): Pfam ID: Myb_DNA-binding Pfam Description: Myb-like DNA-binding domain
MAFYYGVSGGQSSSWAAPPPAGSRPWTKAEDKAFEGALVMFPEHLPNRWALVASRLHDRTPQEAWDHYQALVTDVDLIERGMVDAPDSWDDDAAAGGGRAGRGRGGGSGEERRRGVPWTEDEHRLFLEGLEKYGRGDWRNISRWSVKTRTPTQVASHAQKYFIRQASAASRGDTKRKSIHDITAP

SEQ ID NO: 19460 - DNA, 1170 bp, Sorghum bicolor; identical to SEQ ID NO: 19456
  misc_feature: Ceres ANNOT ID no. 8732907
  misc_feature: Encodes the peptide sequence at SEQ ID NO 19461

SEQ ID NO: 19461 - protein, 389 aa, Sorghum bicolor; identical to SEQ ID NO: 19457
  misc_feature: Useful for making plants with altered carbohydrate content
  misc_feature: Functional homolog of the protein sequence given in SEQ ID NO 14709
  misc_feature: Useful for making plants with altered cell wall content and/or composition
  misc_feature: Functional homolog of the protein sequence given in SEQ ID NO 14472
  misc_feature: Useful for making plants with altered lignin content
  misc_feature: Functional homolog of the protein sequence given in SEQ ID NO 14156
  misc_feature: Ceres ANNOT ID no. 8732907
  misc_feature (35)..(357): SWISSPROT Homolog: EC 3.2.1.39 Glucan endo-1,3-beta-D-glucosidase
  misc_feature (37)..(353): Pfam ID: Glyco_hydro_17 Pfam Description: Glycosyl hydrolases family 17

SEQ ID NO: 19462 - DNA, 1212 bp, Sorghum bicolor
  misc_feature: Ceres ANNOT ID no. 8732916
  misc_feature: Encodes the peptide sequence at SEQ ID NO 19463
atggtgttgagggcttgcgcagtaatggaggcgggtactttcagcgtgccgttttacgagtggctcaagccacgatcgtcatcgtcatcgccgccgccgtcgccgtcctcctcctcgtcgacgacgtcctcgacgacgctctcaacgccatcgatcgaccaattagccgccgttgatgagcgccacgccatgacgtgcttgccgcttcttggtaggcttgaagggagggcagcgactcctgatcatggccataataatcctatcaaagaagagctgctgagcaataatatcgctaccaccggcggcgccacgcggagagaggaggccgccgccgctggtgttgacctgaacatcggcttgccggcggcggcggcgacgactggggggcgcggctatagttctgaagaggtgcccatggacgaggaagacgacgatgaggaggaggatttcgaggaggaagaggacgagaaacatgagaagtgcaaggtggaagaagcagggggagagcaacagcacggtgagatggtggtggagcccgtcgagcagagatccgattacctgcgtgtgggtggggaggagggcatcaagggcttcgtcggaagccgtggccggcggtactggatcccgactccggcgcagatactcgtcggaccggtgcagttcatctgccatgtctgcagcaagacattcaacagatacaacaacatgcagatgcacatgtggggccacgggcgcgagtaccgcaagggcccggagtcgctcaagggcacgcaggcggcgacgctggcgctgctgaagctgccgtgctactgctgcgcggccgggtgccgcaacaacgtggcgcacccgcgcgcgcgcccgctcaaggacttccgcaccctgcagacgcactacaagcgcaagcacggcgacaagcacttcggctgccgccgctgcggcaagccgttcgccgtcaagggcgactggcgcacgcacgagaagaactgcggcaagcgctggttctgcgcctgcggctccgacttcaagcacaagcgatccctcaacgaccacgtccggtccttcggcggcggacacttctccgtcacgcccgaccaggccgcggccgtcgtgccgcggccgtcgctgctgatgaagcccagcaaggagcggatcatccgcttcgatcagcagggagcggcggcgccatggaatggagcacacgcccatgcatga

SEQ ID NO: 19463 - protein, 403 aa, Sorghum bicolor
  misc_feature: The sequence is a functional homolog of SEQ ID NO 1079 in the 10/666,642 US patent application
  misc_feature: The sequence is a functional homolog of SEQ ID NO 306 in the 10/666,642 US patent application
  misc_feature: The sequence is a functional homolog of SEQ ID NO 630 in the 10/666,642 US patent application
  misc_feature: Ceres ANNOT ID no. 8732916
MVLRACAVMEAGTFSVPFYEWLKPRSSSSSPPPSPSSSSSTTSSTTLSTPSIDQLAAVDERHAMTCLPLLGRLEGRAATPDHGHNNPIKEELLSNNIATTGGATRREEAAAAGVDLNIGLPAAAATTGGRGYSSEEVPMDEEDDDEEEDFEEEEDEKHEKCKVEEAGGEQQHGEMVVEPVEQRSDYLRVGGEEGIKGFVGSRGRRYWIPTPAQILVGPVQFICHVCSKTFNRYNNMQMHMWGHGREYRKGPESLKGTQAATLALLKLPCYCCAAGCRNNVAHPRARPLKDFRTLQTHYKRKHGDKHFGCRRCGKPFAVKGDWRTHEKNCGKRWFCACGSDFKHKRSLNDHVRSFGGGHFSVTPDQAAAVVPRPSLLMKPSKERIIRFDQQGAAAPWNGAHAHA

SEQ ID NO: 19464 - DNA, 1242 bp, Sorghum bicolor
  misc_feature: Ceres ANNOT ID no. 8733012
  misc_feature: Encodes the peptide sequence at SEQ ID NO 19465
atggcggccgcggcggcagcagcagacggggagcggaggatcggggtggccatggactactcggagagcgccaagaaggcgctggactgggccatcgacaacctgctccaccacggggacaccctcgtcgtcctccacgtcctgcaccacagcggggaggagaccaagcacgcgctctgggccaagtccggatccccgctgatcccgctctccgagttccgggagcccgaggtgatgcagggctacggcgtgcgcaccgacgccgaggtgctcgacatgatcgacacggcggcgcgccagaagcagctcaaggtggtggcgaagctgtactggggcgacgctagggagaagctctgcgacgccgtcggggacctcaagatcgattccctcgtcatgggtagtcgcggcctcggcccgatccagaggattctcctgggaagtgtgacaaactacgttctgtcaaacgcatcatgtccggtgacagtggtcaaggggaatcggcgacatctctcctctgcgactcccattcgcgctgccaaggtcgagctcgactgcccgccgtacggagaggaagaagaatcgtgcctctgctcagggagcgcggaaactccagtggctggcgcaggcctctacaagggcgcgcacgggagcaccagtggctggcggcctcttcctccgacgcgtagtggcaggcgcgggcctttgctcgagcgcgcgggagctttggcggccggcgcgagcctcttcctccgatgcgcaatgagccccaaaacaccagcagcctcgttgtttgagcttgctgtgactgtttcagttattcactatagtaaatcacagttatttgcagcagccgtagctacagacagcaggcccgaggatgtttacaagcttttcaacttgatgctaattcttcctgtacttccctgctcaggaatacccaagtgccatcgcaggttctggaggaggatgtatgggaggcgtgcgtcgcagctgctaaaggagatcgactcctctgaggctggccagcttgcgccattcaacactgacatgttcgatcaggtgattagagagtgcagtgagcacaattcacaattccaatcactgatcaggtacaaccgagcagaagttattcagagttttagatggaaagttggccctgtgcttcctcatgacatacaagaaaagctccatttctcagagaaagagtacttcaagaaccactctgcagccattaaatcatga

SEQ ID NO: 19465 - protein, 413 aa, Sorghum bicolor
  misc_feature: Useful for making plants with altered lignin content
  misc_feature: Useful for making plants with modulated biomass
  misc_feature: Functional homolog of the protein sequence given in SEQ ID NO 14710
  misc_feature: Useful for making plants with altered alkaloid content
  misc_feature: Functional homolog of the protein sequence given in SEQ ID NO 14711
  misc_feature: Ceres ANNOT ID no. 8733012
  misc_feature (10)..(164): Pfam ID: Usp Pfam Description: Universal stress protein family
MAAAAAAADGERRIGVAMDYSESAKKALDWAIDNLLHHGDTLVVLHVLHHSGEETKHALWAKSGSPLIPLSEFREPEVMQGYGVRTDAEVLDMIDTAARQKQLKVVAKLYWGDAREKLCDAVGDLKIDSLVMGSRGLGPIQRILLGSVTNYVLSNASCPVTVVKGNRRHLSSATPIRAAKVELDCPPYGEEEESCLCSGSAETPVAGAGLYKGAHGSTSGWRPLPPTRSGRRGPLLERAGALAAGASLFLRCAMSPKTPAASLFELAVTVSVIHYSKSQLFAAAVATDSRPEDVYKLFNLMLILPVLPCSGIPKCHRRFWRRMYGRRASQLLKEIDSSEAGQLAPFNTDMFDQVIRECSEHNSQFQSLIRYNRAEVIQSFRWKVGPVLPHDIQEKLHFSEKEYFKNHSAAIKS

SEQ ID NO: 19466 - DNA, 1758 bp, Sorghum bicolor
  misc_feature: Ceres ANNOT ID no. 8733050
  misc_feature: Encodes the peptide sequence at SEQ ID NO 19467
atggctggcggtcgtcgtcgactctcccctgcgtgcctctttctcaccgtcgccctcgtggtcctcgtcgccttgccggagctcgccgctgctcgcacccgccgctacacgttcaatgtgacgatggcaacggtgacgcggctgtgcgtgacgaagagcatccccacggtgaacggccggttcccggggccgaggatcgtcgtgcgcgagggcgaccgcctcgtggtgcaggtccacaataacatcaacaacaacgtcacgttccactggcacggcgtccggcagctgcgcagcgggtggtcggacggtccgtcgttcatcacgcagtgcccgatccgtcccgggcagagctacgcctacgacttccgcatcgtggggcagcgcggcacgctgtggtggcacgcgcacttctcctggctccgcgccacgctctacggcccgctcgtcatcctcccgccgcgcggcgtcccctacccgttccccaagccccacgccgaagtgcccctcatgctcggcgagtggttcaacgccgacccggaggccgtcatcaagcaggcgctgcagaccggcggtgggccgaacgtctccgacgcctacaccttcaacggcctgcctggcccgacctacaactgctccggcggcggcgccggcgacacgttcaagctgagggtcaagcccggcaagacgtacctgctgcggctcgtgaacgcggcgctcaacgacgagctcttcttcgcggtcgccaaccacacgctgacggtggtgcaggcggacgccagctacgtgaagccgttcacggccgacacgctggtcatctcgccggggcagaccatggacgtgctcctcaccgcggccgccgcgaccgccccttcctcgaccgccgcctacgccatcgccgtcgcgccctacaccaacacggtcggcacgttcgacaacaccacggccatcgccgtcctcgagtactacggcgcgccgccgcagagcgccgcggcgctccggaacctcccgctccccgcgctgccgctgtacaacgacacaggcgcggtggccaacttctcggcgaagttccggagcctcgcgagcgcgcagtacccggcgctggtgccgcggacggtggaccggaggttcttcttcgccgtcgggctcggcgccgacccgtgccagagcagggtgaacgggacgtgccaggggcccaacggcaccaggttcgcggcgaccatgaacaacgtgtcgttcaccatgcccaagacgtcgctcctccaggcgcactaccagcggcggtacagcggcgtgctcacggccaacttccccggggtgccgccgacgccgttcaactacacggggacgccgcccaacaacacgttcgtcacgcacggcaccagggtggtgccgctcagcttcaacaccaccgtcgaggtggtgctgcaggacaccagcattttgggcgccgagagccacccgctgcacctgcacggctacgacttcttcgtcgtcggccaggggttcggcaactacgacgccggcaacgacacggccaagtacaacctcgtcgacccggtgcagcggaacaccatcagcgtgcccaccgccggctgggtcgccatccgcttcgttgccgacaaccccggcgtgtggatcatgcattgccacctggacgtgcacctcagctggggtctggcaatggcgtggctcgtcaacgacgggccgctgcccaaccagaagctgccgcctccgccgtccgatatccccaggtgttga

SEQ ID NO: 19467 - protein, 585 aa, Sorghum bicolor
  misc_feature: Useful for making plants with altered carbohydrate content
  misc_feature: Functional homolog of the protein sequence given in SEQ ID NO 14205
  misc_feature: Useful for making plants with altered cell wall content and/or composition
  misc_feature: Functional homolog of the protein sequence given in SEQ ID NO 14217
  misc_feature: Ceres ANNOT ID no. 8733050
  misc_feature (33)..(585): SWISSPROT Homolog: EC 1.10.3.2 Laccase
  misc_feature (39)..(155): Pfam ID: Cu-oxidase_3 Pfam Description: Multicopper oxidase
  misc_feature (165)..(324): Pfam ID: Cu-oxidase Pfam Description: Multicopper oxidase
  misc_feature (435)..(569): Pfam ID: Cu-oxidase_2 Pfam Description: Multicopper oxidase
MAGGRRRLSPACLFLTVALVVLVALPELAAARTRRYTFNVTMATVTRLCVTKSIPTVNGRFPGPRIVVREGDRLVVQVHNNINNNVTFHWHGVRQLRSGWSDGPSFITQCPIRPGQSYAYDFRIVGQRGTLWWHAHFSWLRATLYGPLVILPPRGVPYPFPKPHAEVPLMLGEWFNADPEAVIKQALQTGGGPNVSDAYTFNGLPGPTYNCSGGGAGDTFKLRVKPGKTYLLRLVNAALNDELFFAVANHTLTVVQADASYVKPFTADTLVISPGQTMDVLLTAAAATAPSSTAAYAIAVAPYTNTVGTFDNTTAIAVLEYYGAPPQSAAALRNLPLPALPLYNDTGAVANFSAKFRSLASAQYPALVPRTVDRRFFFAVGLGADPCQSRVNGTCQGPNGTRFAATMNNVSFTMPKTSLLQAHYQRRYSGVLTANFPGVPPTPFNYTGTPPNNTFVTHGTRVVPLSFNTTVEVVLQDTSILGAESHPLHLHGYDFFVVGQGFGNYDAGNDTAKYNLVDPVQRNTISVPTAGWVAIRFVADNPGVWIMHCHLDVHLSWGLAMAWLVNDGPLPNQKLPPPPSDIPRC

SEQ ID NO: 19468 - DNA, 1263 bp, Sorghum bicolor
  misc_feature: Ceres ANNOT ID no. 8733056
  misc_feature: Encodes the peptide sequence at SEQ ID NO 19469
atgaggtcgatcttcgccatcgccattcttgccgccaccactgcagtagtgctcttccatgggtccgacgcgcaggagttgatgcagagccaccatacagagaggatctcaggcagtggcggtgacgttttagaagacgaccctgtgggcaagctcaaggtgttcgtgtacgacctcccggcgaaatacaacacgaagccggtggagaaggacccgcgttgcctgacgcacatgttcgcgacggagatcttcgtgcaccggtccctcctctccagcgccgtccgaaccctggaccccgaggaagcggactggttctacacccccgtgtacaccacctgcgacctgaccgcctccggccacccgatgcccttcgactccccgcggatgatgcgcagcgccatccggctgatcgccgaccgctggccgtactggaacaggtccgagggcgccgaccacttcttcgtcacgccgcacgacttcggtgcctgcttccatttccaggaggagaaggccatggcgcgcgggatcctgcccgtgctccggcgcgccacgctggtgcagacgttcgggcagcggaaccacgtgtgcctcaaggacggcggcggctccatcaccatcccgccgtacgcgccgccgtggaagatggaggcgcagctcctgccgccggccaccccgcggtccatcttcgtctacttccgcggcctcttctacgacgccggcaacgaccccgagggcggctactacgccaggggcgcccgcgcgtccgtgtgggagaacttcaagagcaacccgctgttcgacatctccacggcgcacccgacgacctactaccaggacatgcagcgcgccgtgttctgcctgtgcccgctggggtgggcgccctggagcccccgcctggtggaggccgtcgtcttcggctgcatccccgtggtcatcgccgacgacatcgtgctgcccttcgcggacgccatcccgtgggcggacatcggcgtgttcgtcgccgaggacgacgtcccgaggctggacaccatcctgacgtccatccccgtggaggtggtgctgaggaagcagcggctcctcgcgagtccggcgatgaagcgcgccgtgctgttcccgcagcccgcgcagcccggcgacgcgttccaccagatactcaacgggctcgcacgcaagctcccgcacggcgatgatgccttcttgaggaacggacagacggtcctcaactggacggctggaccgccgagagacctcaagccatggtag

SEQ ID NO: 19469 - protein, 420 aa, Sorghum bicolor
  misc_feature: Useful for making plants with altered carbohydrate content
  misc_feature: Functional homolog of the protein sequence given in SEQ ID NO 14712
  misc_feature: Useful for making plants with altered cell wall content and/or composition
  misc_feature: Functional homolog of the protein sequence given in SEQ ID NO 13864
  misc_feature: Ceres ANNOT ID no. 8733056
  misc_feature: Up-regulated in root tissues in response to salicylic acid treatment
  misc_feature: Up-regulated in shoot tissues in response to salicylic acid treatment
  misc_feature (54)..(360): Pfam ID: Exostosin Pfam Description: Exostosin family
MRSIFAIAILAATTAVVLFHGSDAQELMQSHHTERISGSGGDVLEDDPVGKLKVFVYDLPAKYNTKPVEKDPRCLTHMFATEIFVHRSLLSSAVRTLDPEEADWFYTPVYTTCDLTASGHPMPFDSPRMMRSAIRLIADRWPYWNRSEGADHFFVTPHDFGACFHFQEEKAMARGILPVLRRATLVQTFGQRNHVCLKDGGGSITIPPYAPPWKMEAQLLPPATPRSIFVYFRGLFYDAGNDPEGGYYARGARASVWENFKSNPLFDISTAHPTTYYQDMQRAVFCLCPLGWAPWSPRLVEAVVFGCIPVVIADDIVLPFADAIPWADIGVFVAEDDVPRLDTILTSIPVEVVLRKQRLLASPAMKRAVLFPQPAQPGDAFHQILNGLARKLPHGDDAFLRNGQTVLNWTAGPPRDLKPW

SEQ ID NO: 19470 - DNA, 2202 bp, Sorghum bicolor
  misc_feature: Ceres ANNOT ID no. 8733067
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 19471
atgcggagacagatccctcccgtctcctgcctcgtactcctcgcggcggctctcgccgcggcgtctgcagcgtcgccgacgccggcggccgtcgcggtcaacgtcacgggcgtgctgtcggcgttcccggacctcagcgacttcacgcgcctgctggcgtccagccccgtgctggcggagctcgcggggcggtcgtcgctgacgctgctggccgtgccgaacggcaacctcccgcagtcgccgtcggcgttcgcggccgcgtcgggcgccgacctcgccgacgtcctccgctaccacgtcctcctcgagtacctcgcccccgccgacctccgccgccttcccgcctccgggaagctcgtgaccacgctgttccagaccacgggccgcgcccccgcggacctgggcgccatcaacgtcaccgccgcgggcgcctccctcgccgtcgtccgctcgccagcaccgtctcccgtttcgaacgccaccgtcctcggcgccatcaccgcggtgccgtacaacctgagcgtgctggcggtgagcggcctcatcgtccccaccgggttcgacctcgcggcgtccgagtcccgcccgcccgcggccgtcaacatcacccgcgtactcgccgacgcgcgcgccttcaacgtggcggcgtcgatgctggaggcctcgggggtggcggccgagttcgaggacgacgagcgcggcgccgggatcacggtattcgccccgaccgacgacgccttcgcgggcctccccgcgggcgaccgcctgcagtcgctccccgccgaccgctatggcgtggtgctccgcttccacgtgctccactcctactacccgctggggtcgctggagtcgatcgtgaacccggtccagcccacgctggccaccgagttcagcaacgccggccgcttcaccctcaacatcacccgcgccaacggctcggtcgccatcgacacgggcgtcgtgcaggccaccatcacgcggaccgtcttcgaccagaaccccgtcgccgtcttcgccgtctccaaggtcctcctccccaaggagatgttcacccgcacagcaagcggcggcggaggcggcgacgactcctccatcgttgccgccaccgccgccgcgtcgtcgcccccgccagccgcgacagccccggaggcctccgagagcgcgcggacgccgccgacaaagctctcctccccgcccgcgctccgcggcggcggcgggcaagactacgacacggcgtcggcgcgagggatcggaatcgggtggtggtggtgtatagcattggtgtatctacttccacatctgaatgtgtacactgggagggagatgaactgcttcagctccatttttgctctgatgaattggaagcgtggagagctggtgggtgtgggaggaggtagcagcaccaggaggaggaagagctgcagtgcatccaatgctcaccggacggaattccggctccagtgcagtgcgtgcaatgcaggagcgccggagaagagggggaaggagccgaaaatcttcccccatctttttgcgctccatcatgagccgcctgacgcatcattgtggtctgatatgaaggctggtgatggcgatggattttccctgacatgtttcatggcgatggcgaggacgaggaaaggaactgctgcgtccgtttgggacccggctggaacgccggaagggaacggcatgcactgtaaagtctggcgttccaaaacggccggggacgagcggtccaccgagccatcagccgttggagctgcaggactagctagtgtcctgttactctacttattattactactgtctgttgttattattatggacggagtgcgtgagtgtgatttcatgacgaggaacgagcttgtgtgtgtgattgcgggaatcattcaccgcgaagccaacatacaagcatggctctcagtcccagctggacctctctactgcattggcatctggaattctggatccctccctcccttccctaccctccccggcggggacatcatccactcatccatccacaaccacaacaggacctccgccacatgggcgggccctggcctcgcctcgcctcgcctcgcctactacgacaagtcagagcgccccccctctcgatctttggcgcctgcaagaaagaactcgattgggagtggagttcagtgtggccgccgatccatcatccagaccatgagttgctaa

SEQ ID NO: 19471 - protein, 733 aa, Sorghum bicolor
  misc_feature: Useful for making plants with altered carbohydrate content
  misc_feature: Functional homolog of the protein sequence given in SEQ ID NO 13744
  misc_feature: Useful for making plants with altered cell wall content and/or composition
  misc_feature: Useful for making plants with modulated salt sensitivity
  misc_feature: Functional homolog of the protein sequence given in SEQ ID NO 13745
  misc_feature: Ceres ANNOT ID no. 8733067
  misc_feature (211)..(346): Pfam ID: Fasciclin Pfam Description: Fasciclin domain
MRRQIPPVSCLVLLAAALAAASAASPTPAAVAVNVTGVLSAFPDLSDFTRLLASSPVLAELAGRSSLTLLAVPNGNLPQSPSAFAAASGADLADVLRYHVLLEYLAPADLRRLPASGKLVTTLFQTTGRAPADLGAINVTAAGASLAVVRSPAPSPVSNATVLGAITAVPYNLSVLAVSGLIVPTGFDLAASESRPPAAVNITRVLADARAFNVAASMLEASGVAAEFEDDERGAGITVFAPTDDAFAGLPAGDRLQSLPADRYGVVLRFHVLHSYYPLGSLESIVNPVQPTLATEFSNAGRFTLNITRANGSVAIDTGVVQATITRTVFDQNPVAVFAVSKVLLPKEMFTRTASGGGGGDDSSIVAATAAASSPPPAATAPEASESARTPPTKLSSPPALRGGGGQDYDTASARGIGIGWWWCIALVYLLPHLNVYTGREMNCFSSIFALMNWKRGELVGVGGGSSTRRRKSCSASNAHRTEFRLQCSACNAGAPEKRGKEPKIFPHLFALHHEPPDASLWSDMKAGDGDGFSLTCFMAMARTRKGTAASVWDPAGTPEGNGMHCKVWRSKTAGDERSTEPSAVGAAGLASVLLLYLLLLLSVVIIMDGVRECDFMTRNELVCVIAGIIHREANIQAWLSVPAGPLYCIGIWNSGSLPPFPTLPGGDIIHSSIHNHNRTSATWAGPGLASPRLAYYDKSERPPSRSLAPARKNSIGSGVQCGRRSIIQTMSC

SEQ ID NO: 19472 - DNA, 1950 bp, Sorghum bicolor
  misc_feature: Ceres ANNOT ID no. 8733069
  misc_feature: Encodes the peptide sequence at SEQ ID NO 19473
atggcgaagggagaggggccggcgatcgggatcgacctgggcacgacgtactcgtgcgtcggcgtgtggcagcacgaccgcgtcgagatcatcgccaacgaccaggggaaccgcaccacgccgtcgtacgtcgccttcaccgacaccgagcggctcatcggcgatgccgccaagaaccaggtcgccatgaaccccaccaacaccgtcttcgacgcgaagcggttgattggtaggaggttctccgacccgtctgtgcaaagtgacatgaagctatggccattcaaggtcgtggctggcccagctgacaagccgatgatagtggtcaactacaagggcgaggagaagcagttctccgccgaggagatctcctccatggtgctgaccaagatgaaggagatcgccgaggcctacctcggctccaccatcaagaacgccgtggtcacggtgcctgcctatttcaacgactcccagaggcaggccaccaaggacgccggcgtcatctccgggctcaacgtgatgcgtatcatcaacgagcccaccgcagctgccattgcctacgggctcgacaagaaggccaccagcagtggcgagaagaacgtgctcatcttcgacctcggtggcggcaccttcgatgtgtcgctcctgaccatcgaggagggcatcttcgaggtgaaggcgaccgccggtgacacccatctgggcggggaggacttcgacaaccgcatggtcaaccacttcgtgcaggagttcaagcgcaagcacaagaaggacatcagcggcaacccgcgtgcgctgcggcgcctgcggacggcctgcgagcgtgccaagcgcacgctgtcgtccacggcgcagaccaccatcgagatcgactcgctgtacgagggcatcgacttctacaccaccatcacccgcgcccggttcgaggagctcaacatggacctcttccgcaagtgcatggagcccgtggagaagtgcctccgcgacgccaagatggacaagagcagcgtgcacgacgtcgtgctcgtgggcggctccacccgcatccccaaggtgcagcagctgctccaggacttcttcaacggcaaggagctctgcaagagcatcaaccccgacgaggccgtggcgtacggcgcggctgtacaggccgccatcctgagcggcgagggcaacgagaaggtgcaggacctgctcctgctcgacgtcaccccgctgtccctgggcctggagacggccggcggcgtgatgaccgtgctgatccctcgcaacaccaccataccgacgaagaaggagcaggtgttctccacctactccgacaaccagcccggggtgctgatccaggtgtacgagggagagcgcgccaggaccaaggacaacaacctcctcggcaagttcgagctgtccggcatcccgccggcgccccgcggcgtgccccagatcacggtgtgcttcgacatcgacgccaacggcatcctgaacgtgtcggcggaggacaagacgacggggcagaagaacaagatcaccatcaccaacgacaaggggcggctgagcaaggaggagatcgagaagatggtgcaggaggcggagaagtacaaggcggaggacgaggagcacaagaagaaggtggacgccaagaactcgctggagaactacgcctacaacatgcgcaacaccatcaaggacgacaagatcgcctccaagctgggcgcggacgacaagaagcgcatcgaggacgccatcgacggcgccatcagctggctcgacagcaaccagctcgcggaggcagacgaattcgaggataagatgaaggagctggagagcatctgcaaccccatcatcgccaagatgtaccagggcgccggcgcggacatgggcggcgccgcgggcatggacgaggacgcaccggccggcggcagcagcggtgctggccccaagatcgaggaggtcgattaa

SEQ ID NO: 19473 - protein, 649 aa, Sorghum bicolor
  misc_feature: Useful for making plants with modulated drought sensitivity
  misc_feature: Useful for making plants with modulated heat sensitivity
  misc_feature: Functional homolog of the protein sequence given in SEQ ID NO 14080
  misc_feature: Ceres ANNOT ID no. 8733069
  misc_feature: Down-regulated in shoot tissues in response to aminocyclopropane carboxylic treatment
  misc_feature: Up-regulated in root tissues in response to salicylic acid treatment
  misc_feature (8)..(617): Pfam ID: HSP70 Pfam Description: Hsp70 protein
MAKGEGPAIGIDLGTTYSCVGVWQHDRVEIIANDQGNRTTPSYVAFTDTERLIGDAAKNQVAMNPTNTVFDAKRLIGRRFSDPSVQSDMKLWPFKVVAGPADKPMIVVNYKGEEKQFSAEEISSMVLTKMKEIAEAYLGSTIKNAVVTVPAYFNDSQRQATKDAGVISGLNVMRIINEPTAAAIAYGLDKKATSSGEKNVLIFDLGGGTFDVSLLTIEEGIFEVKATAGDTHLGGEDFDNRMVNHFVQEFKRKHKKDISGNPRALRRLRTACERAKRTLSSTAQTTIEIDSLYEGIDFYTTITRARFEELNMDLFRKCMEPVEKCLRDAKMDKSSVHDVVLVGGSTRIPKVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVYEGERARTKDNNLLGKFELSGIPPAPRGVPQITVCFDIDANGILNVSAEDKTTGQKNKITITNDKGRLSKEEIEKMVQEAEKYKAEDEEHKKKVDAKNSLENYAYNMRNTIKDDKIASKLGADDKKRIEDAIDGAISWLDSNQLAEADEFEDKMKELESICNPIIAKMYQGAGADMGGAAGMDEDAPAGGSSGAGPKIEEVD

SEQ ID NO: 19474 - DNA, 3654 bp, Sorghum bicolor
  misc_feature: Ceres ANNOT ID no. 8733101
  misc_feature: Down-regulated in shoot tissues in response to aminocyclopropane carboxylic treatment
  misc_feature: Up-regulated in root tissues in response to salicylic acid treatment
  misc_feature: Encodes the peptide sequence at SEQ ID NO 19475
atggcgagccacggcgccggggcggccgctggatctgacgccccgcacgctgaggtcatcagtatgggacagacaaatccatctccttatcctcctctatcttccagtcatcattcatggtcctctgcggctgggtcagcaacggtttcatggaacaatacagtggaaaaacttagccaagatacggtttactatgatccacaaagggatgtatcggtctcaggagggaatcaaaatgtaggaagtagtgcgcctcatgttgcccagtcgagtatggggataacagatgcagctcattctcatgtgccctactctagttcagcccaacatgtctataaccctgtagaatatgccaactattattatagctacccacaagcgacaaatgattcttctgtccagcaaggagcaaaccaacatccaggtgcagcttatcagcctcttacttcatttcaaaattcagggtcttacattgatcctacaagtaacacatattacaatgctgggggtcatcagactgtgccaggatatggaagcagcagctactattatcagaacaacacatggaatgatggaagctcagggaataattttgctcaatcataccagaactactcatcatctgatacaagtgcacagcaaagttctacttcagtgcctgccaattctttaccgtatcagcagcagtataaccagtggccatactattacaatcaatctgtgccaagtgcttctagcaatctagttgctgggaacagtactgcagataacttagctgttaacaccccttctggctattcctatcctagtagccagccacctccaccaggaacaacatcatggaaaagtaattcagttgcttctgctgcacctcctatgcaggttccaggacatcaaaatcaatatgccaaccaggcagaaggccattataaccagggaccaggtgtccaatggtctcaaaaccattatgcctatcagacacagccataccctcagaagactaattccaatcatccacaactaggcaaccctgaagatcaacagaagactgtagattctaacggtccaagcacaaatctttcatcgaaccatgtttctgaaaattttaaaccaaacttgcagggttccgtgacaatggacaattccagcgaaagcaaaatacaggttcctataaatcctcgaattgccccaggtttctctatggtgatgccaaagaatgagaagaaaaattctggacttgatttatcaaagaaacctgcctatgttagtgtctccatgccgacgaatgatgctaaagcaactcaagatggtcctgatgctagatcgataccattttcactccgtaactatgctacgaggaacctcaatcgttgcaagaatgatgcccagagggcagcctgccgaagcataatggaggagttccatctccttgacgaaaaggacaccagtggtacctttgtttttagtcgtggatgccctagtcctctgacatcttttgactttaaaccaaattcgtcaatattagcttccaacatcagtgactatggatgctaccattccaagataacaaaaaaggcttttgctgagggaacccttcttactaagaactgggacactgaacctttatttcctttgcctgaaagtgttgtgggcatgactggaacaagcattgtaaacaatttaagtcccttctcgtcagtatctacaccaaggaaacgtgttaaaagtagatgggagcctgttgtggatgaaaatgttaccaataaggtggaacaaatagcaaaaggattgattagcagtaatgtccacagtactttggaccctaaaaatagaatgggtagcagttgggatcatggaaagtttctccagtctcgtgaagcaccttcttcaagtaaagtgaatcagaggcctgccaagaagcaaaaaatgggtagtaatttgagtcaaatacagaatggaagtgcttcaagtgacagcgagaaggaacatgatctaaccaaatattatgccagtgcaactgcactagcaaactcgcctgaggaaaagaagcgtagggaacatagatccaagcgttttgaaaagagtaaagattcgtcattaaaatcaagaaatgcttctgcaaatagtgatgctatggctaatttgcgtttaagaagggcaatttcatctcttcgtactagaacctatgaagaaggcactttggctgttgaggatatggattgggatgcactgacaatcaaaggaacatgtcaagaaattgagaaacaatatctacgacttacaggagcgcctgagcctgccaaaataaggccagaagatgtcctggagaaggcccttgcaatggttgaaacatcacaaaagaattatctttacaagtgtgatcagctaaaatctatccgccaagatcttacagttcagagaatccagaatgaactgactgtaaaggtttatgaaacccatgcccgattagctatgcaagctggcgatttacctgaatttaaccagtgccagtcacaactgaagaggctatatgcacaaggaatcaagggttgctattttgaattttctgcttacaatttgctgtgtgtcatgctacactctaataataaacgagacttgctgtcgtcaatggcaagcttatcaaaagaagccagacaagatgcagcagttaagcatgcccttgcagttcattcttctgttttatctggcaattatgttctatttttcaagctatacaagaaggcgcccaatttgaactcatgcctcatggatctatatgtggagcggatgcgctttgaagctatgaaatgcatgtctaggtcatatcgcccaactgtacctgtgggatatattgcacagattttggggttcttgagaacagacactgaaggctgtgcaaccaatgaggatgatggattagaagaatgcgaaaaatggttgaaagcgcatgggacagttctttcagaagataacagtggggaattgcagatagatatgaaggcttcgtcttctacactttacatgccagagccagaggacgcggttgcacatggtgatgcatcacttgctgttgatgactttttggcacggactgacggacatgctaaaagagtgccgaataggtcaatgtcagataataggtgtgaagtcttatccaggttcagcgagatcagattgcatttccagcagaaacaagtagttactttcatattcactttcgtttgtatttggcaaatattgttcgattatgtgctcaaaagattcgtcttgcgatttacagggcttgaagaagacactactgctgcaaccatgagcaccatgaagttttgccgtgagtgcaacaacatcctgtaccccaaggaggagagagacaggcgcaccctattcttcgcatgtcgcaactgtgagcaccaggaggtctctgacaataactgcgtctatcggaacgaggtgcaccacactgctggggagcgaacgcaggtcttgcaggatgtagcttctgaccccactcttcccagaaccaagactgttcgctgtagtgcttgtgggcatggagaggctgttttcttccaggccacagcaagaggggaggaggggatgaccctgttctttgtgtgctgcagcccagattgtggtaatcggtggagggaatga

SEQ ID NO: 19475 - protein, 1217 aa, Sorghum bicolor
  misc_feature: Useful for making plants with altered lignin content
  misc_feature: Functional homolog of the protein sequence given in SEQ ID NO 12917
  misc_feature: Ceres ANNOT ID no. 8733101
  misc_feature (1107)..(1216): SWISSPROT Homolog: EC 2.7.7.6 DNA-directed RNA polymerase
  misc_feature (762)..(957): Pfam ID: SAC3_GANP Pfam Description: SAC3/GANP/Nin1/mts3/eIF-3 p25 family
  misc_feature (1107)..(1161): Pfam ID: RNA_POL_M_15KD Pfam Description: RNA polymerases M/15 Kd subunit
MASHGAGAAAGSDAPHAEVISMGQTNPSPYPPLSSSHHSWSSAAGSATVSWNNTVEKLSQDTVYYDPQRDVSVSGGNQNVGSSAPHVAQSSMGITDAAHSHVPYSSSAQHVYNPVEYANYYYSYPQATNDSSVQQGANQHPGAAYQPLTSFQNSGSYIDPTSNTYYNAGGHQTVPGYGSSSYYYQNNTWNDGSSGNNFAQSYQNYSSSDTSAQQSSTSVPANSLPYQQQYNQWPYYYNQSVPSASSNLVAGNSTADNLAVNTPSGYSYPSSQPPPPGTTSWKSNSVASAAPPMQVPGHQNQYANQAEGHYNQGPGVQWSQNHYAYQTQPYPQKTNSNHPQLGNPEDQQKTVDSNGPSTNLSSNHVSENFKPNLQGSVTMDNSSESKIQVPINPRIAPGFSMVMPKNEKKNSGLDLSKKPAYVSVSMPTNDAKATQDGPDARSIPFSLRNYATRNLNRCKNDAQRAACRSIMEEFHLLDEKDTSGTFVFSRGCPSPLTSFDFKPNSSILASNISDYGCYHSKITKKAFAEGTLLTKNWDTEPLFPLPESVVGMTGTSIVNNLSPFSSVSTPRKRVKSRWEPVVDENVTNKVEQIAKGLISSNVHSTLDPKNRMGSSWDHGKFLQSREAPSSSKVNQRPAKKQKMGSNLSQIQNGSASSDSEKEHDLTKYYASATALANSPEEKKRREHRSKRFEKSKDSSLKSRNASANSDAMANLRLRRAISSLRTRTYEEGTLAVEDMDWDALTIKGTCQEIEKQYLRLTGAPEPAKIRPEDVLEKALAMVETSQKNYLYKCDQLKSIRQDLTVQRIQNELTVKVYETHARLAMQAGDLPEFNQCQSQLKRLYAQGIKGCYFEFSAYNLLCVMLHSNNKRDLLSSMASLSKEARQDAAVKHALAVHSSVLSGNYVLFFKLYKKAPNLNSCLMDLYVERMRFEAMKCMSRSYRPTVPVGYIAQILGFLRTDTEGCATNEDDGLEECEKWLKAHGTVLSEDNSGELQIDMKASSSTLYMPEPEDAVAHGDASLAVDDFLARTDGHAKRVPNRSMSDNRCEVLSRFSEIRLHFQQKQVVTFIFTFVCIWQILFDYVLKRFVLRFTGLEEDTTAATMSTMKFCRECNNILYPKEERDRRTLFFACRNCEHQEVSDNNCVYRNEVHHTAGERTQVLQDVASDPTLPRTKTVRCSACGHGEAVFFQATARGEEGMTLFFVCCSPDCGNRWRE

SEQ ID NO: 19476 - DNA, 444 bp, Sorghum bicolor
  misc_feature: Ceres ANNOT ID no. 8733073
  misc_feature: Encodes the peptide sequence at SEQ ID NO 19477
atggcacccaaggcggagaagaagccggccgagaagaagcccgcggcggaggagaaggcacccaaggcggcggagaagaagccacccaaggccgagaagcggctaccgtcgtccaaggacggcggcggcggcggcggcaagaagggcaagaagaaggcgaagaagagcgtcgagacctacaagatctacatcttcaaggtgctgaagcaggtgcacccggacatcggcatctccgccaaggccatgtccatcatgaactccttcatcaacgacatcttcgagaagctcgcgcaggaggcggcgcgcctcgccaggtacaacaagaagcccaccatcacgtcgcgcgagatccagacctcggtccgcctcgtcctccccggcgagctcgccaagcacgctgtctccgagggcaccaaggccgtcaccaagttcacctccgcctag

SEQ ID NO: 19477 - protein, 147 aa, Sorghum bicolor
  misc_feature: Useful for biocontainment applications
  misc_feature: Useful for making plants with modulated flowering time
  misc_feature: Functional homolog of the protein sequence given in SEQ ID NO 13102
  misc_feature: Ceres ANNOT ID no. 8733073
  misc_feature (54)..(124): Pfam ID: Histone Pfam Description: Core histone H2A/H2B/H3/H4
MAPKAEKKPAEKKPAAEEKAPKAAEKKPPKAEKRLPSSKDGGGGGGKKGKKKAKKSVETYKIYIFKVLKQVHPDIGISAKAMSIMNSFINDIFEKLAQEAARLARYNKKPTITSREIQTSVRLVLPGELAKHAVSEGTKAVTKFTSA

SEQ ID NO: 19478 - DNA, 1632 bp, Sorghum bicolor
  misc_feature: Ceres ANNOT ID no. 8733143
  misc_feature: Encodes the peptide sequence at SEQ ID NO 19479
atgggaaactgctgccgctcgccggccgccgcggcgcgggaagacgtcaagtcgtcgcacttcccggcctccgcaggcggcgggaagaagaagccccaccaggcgcggaacggcgccggaggcgggggcggcgccggggagaagaagcggctgtcggtgctcggggaggaagggtgcgacgtgggcgccgggatcgaggagaagtacgcgctggacagggagctcgggcgcggcgagttcggggtgacgtacctgtgcatggaccggggcacgcgggagctgctggcctgcaagtccatctccaagcggaagctgcggacgcccgtggacgtggaggacgtgcggcgggaggtggccatcatgcggcacctgcccaagagcgccagcatcgtgtccctgcgggaggcgtgcgaggacgacggcgccgtgcacctcgtcatggagctctgcgagggaggggagctgttcgaccgcatcgtcgccaggggccactacacggagcgcgcggcggccgcggtcacccgcaccatcgtcgaggtcgtgcagctctgccaccgccacggcgtgatccaccgggacctcaagcccgagaacttcctcttcgccaacaagaaggagaactcgccgctcaaggccatcgacttcggcctctccatcttcttcaagcccggtgaaaagttttcggaaattgtgggaagtccatactacatggctcctgaagtcttgaagaggaactatggacctgaaatagacatatggagcgctggtgttatcttgtatattttgttatgtggtgttcctccattttgggcagagactgaacaaggagttgcacaagctattcttcggggaaatatagattttaagcgagaaccctggcccaatgtttcagataatgctaaagatcttgtccggcagatgcttcaacctgatccaaagctcaggctaacagcaaagcaagttcttgagcatccctggcttcaaaatgctaagaaagctccaaatgttcctcttggagacattgtaaagtcaaggctgaaacagttttcaaggatgaacagattcaaaagaagagctctaagggttattgctgaccacttgtcagctgaagaggttgaggacataaaggagatgttcaaggtgatggatactgataatgatggtatagtttcttatgaagagttaaagagtgggattgcaaaatttggttctcatcttgcagaatcagaagtgcaaatgcttattgaagctgtggatacaaatggtagaggagcactagattatggtgaatttttggctgtctcacttcatttacaaaggatggcaaatgatgagcaccttcggcgggccttcctatttttcgacaaggatggcaatggtttcattgagcctgaggagcttcaggaagccctgaaggaggatgggggagccgataccatggacgtggtcaatgacatattgcaagaagttgacacagataaggatggtaaaattagctatgaagaatttgtagcgatgatgaaaactggcacagattggagaaaagcatcgcggcattattcaagagggcgcttcaatagccttagcataaagcttataaaagatgggtctgtaaaactgggtagcgagtga

SEQ ID NO: 19479 - protein, 543 aa, Sorghum bicolor
  misc_feature: The sequence is a functional homolog of SEQ ID NO 2 in US patent 7084323
  misc_feature: Ceres ANNOT ID no. 8733143
  misc_feature (65)..(540): SWISSPROT Homolog: EC 2.7.11.1 Non-specific serine/threonine protein kinase
  misc_feature (69)..(327): Pfam ID: Pkinase Pfam Description: Protein kinase domain
  misc_feature (482)..(510): Pfam ID: efhand Pfam Description: EF hand
  misc_feature (374)..(402): Pfam ID: efhand Pfam Description: EF hand
  misc_feature (446)..(474): Pfam ID: efhand Pfam Description: EF hand
MGNCCRSPAAAAREDVKSSHFPASAGGGKKKPHQARNGAGGGGGAGEKKRLSVLGEEGCDVGAGIEEKYALDRELGRGEFGVTYLCMDRGTRELLACKSISKRKLRTPVDVEDVRREVAIMRHLPKSASIVSLREACEDDGAVHLVMELCEGGELFDRIVARGHYTERAAAAVTRTIVEVVQLCHRHGVIHRDLKPENFLFANKKENSPLKAIDFGLSIFFKPGEKFSEIVGSPYYMAPEVLKRNYGPEIDIWSAGVILYILLCGVPPFWAETEQGVAQAILRGNIDFKREPWPNVSDNAKDLVRQMLQPDPKLRLTAKQVLEHPWLQNAKKAPNVPLGDIVKSRLKQFSRMNRFKRRALRVIADHLSAEEVEDIKEMFKVMDTDNDGIVSYEELKSGIAKFGSHLAESEVQMLIEAVDTNGRGALDYGEFLAVSLHLQRMANDEHLRRAFLFFDKDGNGFIEPEELQEALKEDGGADTMDVVNDILQEVDTDKDGKISYEEFVAMMKTGTDWRKASRHYSRGRFNSLSIKLIKDGSVKLGSE

SEQ ID NO: 19480 - DNA, 138 bp, Sorghum bicolor
  misc_feature: Ceres ANNOT ID no. 8733168
  misc_feature: Encodes the peptide sequence at SEQ ID NO 19481
atggttggttttgtgcatcacatgaatgtcaagtcaatattcctcagtgacgagctgaaagaggaggtgtacgtcctgctgaaacgatctagatttttccaaaaagggaaaaatccacagattcgaattataatgtga

SEQ ID NO: 19481 - protein, 45 aa, Sorghum bicolor
  misc_feature: The sequence is a functional homolog of SEQ ID NO 1038 in the 10/374,780 US patent application
  misc_feature: The sequence is a functional homolog of SEQ ID NO 848 in the 10/666,642 US patent application
  misc_feature: The sequence is a functional homolog of SEQ ID NO 1035 in the 10/374,780 US patent application
  misc_feature: The sequence is a functional homolog of SEQ ID NO 1040 in the 10/374,780 US patent application
  misc_feature: The sequence is a functional homolog of SEQ ID NO 845 in the 10/666,642 US patent application
  misc_feature: The sequence is a functional homolog of SEQ ID NO 850 in the 10/666,642 US patent application
  misc_feature: Ceres ANNOT ID no. 8733168
MVGFVHHMNVKSIFLSDELKEEVYVLLKRSRFFQKGKNPQIRIIM

SEQ ID NO: 19482 - DNA, 1068 bp, Sorghum bicolor
  misc_feature: Ceres ANNOT ID no. 8733177
  misc_feature: Encodes the peptide sequence at SEQ ID NO 19483
atggatccctcggggccagccgccgggccgtcgtcctcggcggcgaggggcggtggcgacgacgacgcgcacgcgccgccgccgcctcagcagcagcaccatcaggtccagccgctggctcaggcgcagccgcagcaggccgccgccgcccagccccaccaggcgccgccgccgccgcagcagcagctcagcaggtacgagtcgcagaagcgtcgggactggaacacgttcctgcagtacctgcggaaccaccggccgccgctgacgctggcgcgctgcagcggcgcgcacgtcatcgagttcctcaagtacctggaccagttcggcaagaccaaggtgcacgccgccgggtgcgcctacttcggccagcctaacccgccggcgccgtgcccgtgcccgctgcgccaggcctggggatccctcgacgcgctcatcggccgcctccgcgccgcgtacgaggagagcggacacgcgccggagtccaaccctttcgcggcacgcgccgtgcggatctacctccgcgacgtccgcgacgcgcaggccaaggcaaggggcataccctacgagaagaagagccgcaagcgcaagcagccggcggcgggctcaggggaggcgtcgtcgtcttcggccgcagcagcagcacgggaggctgcgcggcggcgacgaaagctgcaccgaccaccggccagggaagcggcaccactgctgctgctgctgctgcaccgaccagcacatcccgagtatagtagaatcacttttgcaaaccatgtctatttgcttctgtacgtctctcgctatacctcgagctttaatttgcaacatttgagctatatatttcttctgccatttggtttcaccatcgttcttgctctttacaaaccgcatctgggcctgggctcatgcttttttttctcccttttgtttaatttgctggatttcttgctgcatgctctctactcgagccattttcactatgctgaattagacggctactatggtcagtcagtaataataatacatgtcaattggcaaaagtttgtagtatctatccaggatcggaggaagtga

SEQ ID NO: 19483 - protein, 355 aa, Sorghum bicolor
  misc_feature: Useful for making plants with modulated low light sensitivity
  misc_feature: Useful for making plants with modulated nitrogen use efficiency
  misc_feature: Functional homolog of the protein sequence given in SEQ ID NO 13437
  misc_feature: Useful for making plants with modulated flowering time
  misc_feature: Functional homolog of the protein sequence given in SEQ ID NO 13982
  misc_feature: Useful for making plants with modulated biomass
  misc_feature: Functional homolog of the protein sequence given in SEQ ID NO 13338
  misc_feature: Useful for biocontainment applications
  misc_feature: Functional homolog of the protein sequence given in SEQ ID NO 13983
  misc_feature: Ceres ANNOT ID no. 8733177
MDPSGPAAGPSSSAARGGGDDDAHAPPPPQQQHHQVQPLAQAQPQQAAAAQPHQAPPPPQQQLSRYESQKRRDWNTFLQYLRNHRPPLTLARCSGAHVIEFLKYLDQFGKTKVHAAGCAYFGQPNPPAPCPCPLRQAWGSLDALIGRLRAAYEESGHAPESNPFAARAVRIYLRDVRDAQAKARGIPYEKKSRKRKQPAAGSGEASSSSAAAAAREAARRRRKLHRPPAREAAPLLLLLLHRPAHPEYSRITFANHVYLLLYVSRYTSSFNLQHLSYIFLLPFGFTIVLALYKPHLGLGSCFFFSLLFNLLDFLLHALYSSHFHYAELDGYYGQSVIIIHVNWQKFVVSIQDRRK

SEQ ID NO: 19484 - DNA, 1782 bp, Sorghum bicolor
  misc_feature: Ceres ANNOT ID no. 8733198
  misc_feature: Encodes the peptide sequence at SEQ ID NO 19485
atgacctcgacgccggggagcttcggcggaacgctggcggctaactctgggccggtcgcgctctcgttcccgaccacctccttcgccaacttcctaggcggcggtggctcctcagcttctagcagcggagcggcggacaacgggggagtcgggctgtccaagttcaaggccatgaccccgccttccctcccgctgtcgtcgtcgcacccgccggcgtcgccggcgtcgtacctccacgccttctccggcatcctcgactcgccgatcctcctcactcccagcctattcccgtcgccgacgacgggcgcgatcccgtcagagcccttcaactggatggggacgtcggagagcctaagcggcagcgtaaagaccgagcagcagcagtacaccgacttcacgttccagacggcggcgtccgcaccgccggcgacgtcgacgtcgacgatgaccggtgcctcgcactcggcgtcctatctgcagtcatcagtgctgatggcgccgttgggacgagtaggagactcgtacaacggcggcgagttgcagcagcagcagcagcagccgccatgggcctaccaggaaccgtgtacgcaattcgaggcgccggcggcggcgcagcctgacaacagcatgctcgggaacggcggctacggcggggctcccgggccggcggtatccggctgcttccgcgagcagagccagagcaaccggccgtcgtcggacgacgggtacaactggcgcaagtacgggcagaagaatatgaaggggagcgagaacccgcgcagctactacaagtgcagcttcccgggctgccccaccaagaagaaggtggagcggtcgccggacgggcaggtcacggagatcgtgtacaagggcgcgcacaaccacccgaagccgcagagcacccgccggagcgcaagctcggcgccggcgccggcgtcgcacgtgctgcagagcgtcggcgacgccgtgcccgagcattccttcggcgcgctgtccggcacacccgtggcgacgcccgagaactcgtcggggtcattcggcggcgacgacgagatcaacggcgtcagctcgcggctggccggtaacttcgccggcgccgacgatctcgacgacgatgaacccgactccaagagatggaggaaagatggtggcgacggcgacggaggggtctcgttgtccggcaacaaccggacggtgcgggagccgagggtcgtcgtgcaaacgatgagcgacatcgacgtcctcgacgacggctaccggtggcgcaagtacgggcagaaggtcgtcaagggcaacccgaacccgaggagctactacaagtgcacgactgcagggtgcccagtgcggaagcacgtggagcgtgcgtgccacgacacgcgcgcggtggtcaccacgtacgagggcaagcacaaccacgacgtgccgccggcgcgcggcagcagcgcctcgctctaccaccgcgccgcgctggcggcgcatcagatgccgcagcaggccggcggcgggagctgctaccagcagcagcagcagcatggcggcctcgtccggaccgccgatgggttcggcttcggggccagcggcggcctgcacggcggcgcgccgatgatgcaggccgcggagagcggcttcgccttgtccgggttcggccacccggcgggcacggcggcgtactcttacacgagccaccagcagcagcagacgacgacgacgaacgaggcgatgtactacgccaaggacgagccacgagacgacatgttttttgagcagccgctcctgttctga

SEQ ID NO: 19485 - protein, 593 aa, Sorghum bicolor
  misc_feature: The sequence is a functional homolog of SEQ ID NO 202 in the 10/714,887 US patent application
  misc_feature: The sequence is a functional homolog of SEQ ID NO 202 in the 11/435,388 US patent application
  misc_feature: The sequence is a functional homolog of SEQ ID NO 86 in the 10/412,699 US patent application
  misc_feature: Ceres ANNOT ID no. 8733198
  misc_feature (415)..(474): Pfam ID: WRKY Pfam Description: WRKY DNA -binding domain
  misc_feature (239)..(297): Pfam ID: WRKY Pfam Description: WRKY DNA -binding domain
MTSTPGSFGGTLAANSGPVALSFPTTSFANFLGGGGSSASSSGAADNGGVGLSKFKAMTPPSLPLSSSHPPASPASYLHAFSGILDSPILLTPSLFPSPTTGAIPSEPFNWMGTSESLSGSVKTEQQQYTDFTFQTAASAPPATSTSTMTGASHSASYLQSSVLMAPLGRVGDSYNGGELQQQQQQPPWAYQEPCTQFEAPAAAQPDNSMLGNGGYGGAPGPAVSGCFREQSQSNRPSSDDGYNWRKYGQKNMKGSENPRSYYKCSFPGCPTKKKVERSPDGQVTEIVYKGAHNHPKPQSTRRSASSAPAPASHVLQSVGDAVPEHSFGALSGTPVATPENSSGSFGGDDEINGVSSRLAGNFAGADDLDDDEPDSKRWRKDGGDGDGGVSLSGNNRTVREPRVVVQTMSDIDVLDDGYRWRKYGQKVVKGNPNPRSYYKCTTAGCPVRKHVERACHDTRAVVTTYEGKHNHDVPPARGSSASLYHRAALAAHQMPQQAGGGSCYQQQQQHGGLVRTADGFGFGASGGLHGGAPMMQAAESGFALSGFGHPAGTAAYSYTSHQQQQTTTTNEAMYYAKDEPRDDMFFEQPLLF

SEQ ID NO: 19486 - DNA, 3285 bp, Sorghum bicolor
  misc_feature: Ceres ANNOT ID no. 8733189
  misc_feature: Encodes the peptide sequence at SEQ ID NO 19487
atgggagtgggactgaagaggcaggaaatgtggcgggcggcggcggcggcggcggcggcggctccggctccgacggcgagcgcagcaggaaggcagcaagccgtcgccagcaacagtgccaccgccaagccgttggccgaaaggtttcggccggcacagcgagggatgggtggcccagacaacgcgtgccacaacttccgcggtgtccggcagcgccggtggggcaagtgggtggccgagatccgcgagcccaaccgcggcaagcgccactggctgggcaccttcgacaaccccttcgacgcggccgtcgcctacgaccgggcggccgtgtccatccacggcgcccactacgcgcacctcaacttccccgcggaccacgccgccgcggcgccggcccaatgccatccatcgtcctgctctgccgccgccaccaccgccgacgtgttccaggagcacgaggcaaagccaagggttgccgctgcgctgggcggcggcgcagtgaccgtcagccagcagcagccgcagcagcagggcactccatggatttcgcctgatgctccgttcggcgacgactctcatgacattgccatgtacctcgatttcgatgcggtatccgacatggtgcccttctatcctggcatcaagagagaggattgccagcatcagcgtgtttcaaatctacttatactcaaagaacacggtcacaatgctccaatcctaccctcaatgggttatgggttacccaatccaattttagatttactattcctgaactcacgacgcacccatatttatcgcaaaacccatctttatcgcaaagtccataagaccacgggcaccgggcggaacatcttccagggcggcagcccactgcaggagtcgctgccgctgctcggcgtgcagctcgtcctcatcgtcgccatcacccgcgtcctctacttccttctcaagccgttcaagcagccccgcgtcgtgtccgagatcatgggcggcatcatactcggcccgtccatgctgtcacgcagtccggcgttcaaggagatggtgttcccggcgaggggcgacgcggtgctgcacaccgtcgcgacgttcgggctcatgtacgccatcttcctcatcggcgtgcggatggacccgaagctcgtcgtccgctccggcaagaagggcgtgatcatcggcctttccggcttcatcctcccgctggccatgaccaccgcgggcttatccggcgccgccatggtctcggagcccgacgtgacgaggcgttccacgttcctgttcgcgctggccacgtcgctctcggtcacgtccttcgcggtgctgtcgccgatcctgtcggagctcagcctcctcaactccgacctcggccgcaccgccatgtcggcctcgatgaccaccgacggcatcgcgtggctcatcatggtggggtacatcctcgccgaggcgttcctcgtgtcggcggtgacgtcgctctgggcgttcctctcggtggccgcgctcggcgcgctcatactgttcgccgtgcgcccggtcgcgctcaaggtgatcgagcgcacgccgccgggcaagcccgtggacgagaactacgtcttgttcttcctcctcatcgtgctcctcgtcgggttctacagcgacatcatcggcaccaactcgttccacggcgcgctgatgctggggctggcaatccccgatggaccgccgctcggcaccgcgctgggggagaagattgacgccatggtgtccggcctgattctgcctctctactacgccatgaccgggctcagcaccgatgtgtggtccctgcattggggcaggctgcagctagtcgtgctcctcggatggtttggcaagctggtcggcgtcatggtgccgtcgctgtgccttgagatccccctccgggacgccgtgtccctcagcttgttcatgagctccaagggcatcgttgaggtcatcaccttcaccttcttcctcaccaacaagttgatcggcaagaactccttcagcggcctgatatgctcgtcggtggcgatcacggcggtgtcggtgccggtggcgggattgctgtacgacccggcgcggcgctacgccgtctacaagcggcgcaccctgcaacacctcaagccggacgccgagctgcgcatcctggcgtgcctccacgacgagtcccacgtcccggggacgctcgcgttgctcgaagcgtcgcacgccacgccccagacgcccatcggcctctacctcctgcagctcgtcgagatcgccggccgctccgcgccggtgttcatcccgcacaacccgcgccgcaacgcgtctcggatcggcgcgcccaacgcgccgtccaccgacttcgaccgcatcatcaacgccttcttccggcacgagctccggcgaccggagggcgcggtctcggtgcacccgttcaccaccatctccccgtattcctccatgcacgacgaggtgtgccgcctcgccgtcgagaagcgcacgtcgctgatcctcctccactaccataagcaccacttgctcgccggcggcgtgcgcgcctcagtcgggctccgcgtcgtcaaccgcaaggtgctggaggtcgcgccgtgctcggtcgcggtgttcgtcgaccgcaacgccgggaacgtggggctgtccaatttcattccggccccgctacaggactactcaggctcttccacgggcagcagtggcctctcgatgatgagcgggccacagttccacgccgcggtggcggcgctcttcttcggcggcggcgacgaccgcgaggccatgtcctacgcggcgcgcatggcgcgccacccgggcgtgacggttgcgatcgtgcggttcctgccagcccgaggcatcaaggacgacccggcggatcggcgggtggacaaccgcgccatcgaggaggtgaaggcgctcgcggcgaggagcaggaacatgcaagtccgggaggagctcgtcggcgacatggagaagatcgtcggggtgctgaggggtctcgacaaggccggctacgacctagtcatcgttggcatgaggcacaggtggtacccggtgatgccggcgaacgggctgtcggactggagcgagtgccccgagcttggcgtcatcggcgacctcctcgcgtcctccgacttcgacacgccctactcggtgctcatcatgaagcagcaggaccaggctggcctgaacgccgctgtgccgggagcccaggacgagtggcacggtgcactgccgccgggtcggcagcgaaccatgtcgacggcgggatctagcatgtccaagcgatag

SEQ ID NO: 19487 - protein, 1094 aa, Sorghum bicolor
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: Useful for making plants with altered lignin content
  misc_feature: Functional homolog of the protein sequence given in SEQ ID NO 13219
  misc_feature: Ceres ANNOT ID no. 8733189
  misc_feature (302)..(686): Pfam ID: Na_H_Exchanger Pfam Description: Sodium/hydrogen exchanger family
  misc_feature (64)..(115): Pfam ID: AP2 Pfam Description: AP2 domain
MGVGLKRQEMWRAAAAAAAAAPAPTASAAGRQQAVASNSATAKPLAERFRPAQRGMGGPDNACHNFRGVRQRRWGKWVAEIREPNRGKRHWLGTFDNPFDAAVAYDRAAVSIHGAHYAHLNFPADHAAAAPAQCHPSSCSAAATTADVFQEHEAKPRVAAALGGGAVTVSQQQPQQQGTPWISPDAPFGDDSHDIAMYLDFDAVSDMVPFYPGIKREDCQHQRVSNLLILKEHGHNAPILPSMGYGLPNPILDLLFLNSRRTHIYRKTHLYRKVHKTTGTGRNIFQGGSPLQESLPLLGVQLVLIVAITRVLYFLLKPFKQPRVVSEIMGGIILGPSMLSRSPAFKEMVFPARGDAVLHTVATFGLMYAIFLIGVRMDPKLVVRSGKKGVIIGLSGFILPLAMTTAGLSGAAMVSEPDVTRRSTFLFALATSLSVTSFAVLSPILSELSLLNSDLGRTAMSASMTTDGIAWLIMVGYILAEAFLVSAVTSLWAFLSVAALGALILFAVRPVALKVIERTPPGKPVDENYVLFFLLIVLLVGFYSDIIGTNSFHGALMLGLAIPDGPPLGTALGEKIDAMVSGLILPLYYAMTGLSTDVWSLHWGRLQLVVLLGWFGKLVGVMVPSLCLEIPLRDAVSLSLFMSSKGIVEVITFTFFLTNKLIGKNSFSGLICSSVAITAVSVPVAGLLYDPARRYAVYKRRTLQHLKPDAELRILACLHDESHVPGTLALLEASHATPQTPIGLYLLQLVEIAGRSAPVFIPHNPRRNASRIGAPNAPSTDFDRIINAFFRHELRRPEGAVSVHPFTTISPYSSMHDEVCRLAVEKRTSLILLHYHKHHLLAGGVRASVGLRVVNRKVLEVAPCSVAVFVDRNAGNVGLSNFIPAPLQDYSGSSTGSSGLSMMSGPQFHAAVAALFFGGGDDREAMSYAARMARHPGVTVAIVRFLPARGIKDDPADRRVDNRAIEEVKALAARSRNMQVREELVGDMEKIVGVLRGLDKAGYDLVIVGMRHRWYPVMPANGLSDWSECPELGVIGDLLASSDFDTPYSVLIMKQQDQAGLNAAVPGAQDEWHGALPPGRQRTMSTAGSSMSKR

SEQ ID NO: 19488 - DNA, 408 bp, Sorghum bicolor
  misc_feature: Ceres ANNOT ID no. 8733222
  misc_feature: Encodes the peptide sequence at SEQ ID NO 19489
atgaccttcaagcgccgcaacggcggccgcaacaagcatggccgcggtcacgtcaagtacatccgctgctctaactgcgccaagtgctgccccaaggacaaggcgatcaagaggtttcaggtgaggaacatcgtggagcaggcggctatcagggatgtccaggaagcgtgcgtccatgatgggtacgtcctcccgaagctgtacgccaaggtgcaccactgtgtctcgtgcgcgatccacgctcacatcgtccgcgtccgatcccgtgagaagcgcagggaccgcaagccgccggaacgcttcaggcgcagggaggataggccggctggtggacaaggaggcccccgccctggtcctggtcctgctggtgctgctccagctccagcaccagttgctgctcgcccatag

SEQ ID NO: 19489 - protein, 135 aa, Sorghum bicolor
  misc_feature: Useful for making plants with modulated nitrogen use efficiency
  misc_feature: Functional homolog of the protein sequence given in SEQ ID NO 14081
  misc_feature: Ceres ANNOT ID no. 8733222
  misc_feature (1)..(117): Pfam ID: Ribosomal_S26e Pfam Description: Ribosomal protein S26e
MTFKRRNGGRNKHGRGHVKYIRCSNCAKCCPKDKAIKRFQVRNIVEQAAIRDVQEACVHDGYVLPKLYAKVHHCVSCAIHAHIVRVRSREKRRDRKPPERFRRREDRPAGGQGGPRPGPGPAGAAPAPAPVAARP

SEQ ID NO: 19490 - DNA, 1521 bp, Sorghum bicolor
  misc_feature: Ceres ANNOT ID no. 8733214
  misc_feature: Encodes the peptide sequence at SEQ ID NO 19491
atgggttgccacggccgagctgaatcggcctcttcttctcccccctcttccattcgtcggcgactcctccagccagcagttctgcagagtcttcatgagatcttggggctcaagtcatatttgactgtggtgtttacaatagtttacataatggaagacagaagtgttttaatgaaacggtatgaaattgggagactcttagggcaagggacctttgcaaaggtatattatgcccgtaatcttgctactggtcagaccgttgccataaaaatgatcgataaggacaagattttgaagactggtctcatggaccagataaagagggagatatcgataatgaggatggtaaggcatccgaacgttctgcagcttttcgaggtaatggctaccaagaacaagatttacttcgttctggagtacgccaaaggcggtgagcttttcaacaagataacgaaggggaagcttaccgaggaggctgcaaggaagtattttcaacagttgatcagtgccgttgactattgccatagccgaggtgtttatcatcgtgacttgaagcctgagaacctgctgctggatgagaatgaaaccctcaaggtctctgattttggtttaagtgccttagctgagtcaaagagacaagatggtctactccacactgcatgtggtactccagcttatgttgctcctgaagtgctcagcaggaaaggctacagtggtgcaaaggcagatgtatggtcttccggagtaattttgtttgtgcttgtggccaattatcttcctttccatgataaaaatctcatagagatgtataagaaaatttcaaaagccgagtacagatgtcctcgttatttttctgtggctttgaaggagctcctttatggaatgcttgatccagatcccaatatcaggatgtccacctcaaggataaagaaaagtccttggtacagaaagcccattgggatggcagcactgaaaaatgtaacttctgacaagaactttggcttgacgggtgatattgattccgataaaaatcaaggatcattgagcttgacgaacttgaatgcattcgacatcatttccttctctacaggatttgatctatccgccttatttgatgagaaatatggccaaagggaggcaagatttacttccaaggagtcagcagcagctgtctttgcgacgctgaacgaactggccagacgtttgaagcttaaatttacaaagaaagacaatggtgtgttgaatttggccacaaccaaggaaggaagaaagggcatgcttgagcttgatgctgagatatttgagattgctccttctttcctgttagttgagttaaagaagaccaatggtgacacaatggagtaccagaagttgataaaagatgacattaggccatcacttaaggatattgtttgggcatggcaaggtgatcagcaacagacacgtatacttagacaagcagaacaagagcagctgtcgccacttccaccaatttcaccaattccaccacagcagtcatag

SEQ ID NO: 19491 - protein, 506 aa, Sorghum bicolor
  misc_feature: Useful for making plants with modulated biomass
  misc_feature: Functional homolog of the protein sequence given in SEQ ID NO 14256
  misc_feature: Ceres ANNOT ID no. 8733214
  misc_feature (51)..(474): SWISSPROT Homolog: EC 2.7.11.1 Non-specific serine/threonine protein kinase
  misc_feature (61)..(315): Pfam ID: Pkinase Pfam Description: Protein kinase domain
  misc_feature (349)..(408): Pfam ID: NAF Pfam Description: NAF domain
MGCHGRAESASSSPPSSIRRRLLQPAVLQSLHEILGLKSYLTVVFTIVYIMEDRSVLMKRYEIGRLLGQGTFAKVYYARNLATGQTVAIKMIDKDKILKTGLMDQIKREISIMRMVRHPNVLQLFEVMATKNKIYFVLEYAKGGELFNKITKGKLTEEAARKYFQQLISAVDYCHSRGVYHRDLKPENLLLDENETLKVSDFGLSALAESKRQDGLLHTACGTPAYVAPEVLSRKGYSGAKADVWSSGVILFVLVANYLPFHDKNLIEMYKKISKAEYRCPRYFSVALKELLYGMLDPDPNIRMSTSRIKKSPWYRKPIGMAALKNVTSDKNFGLTGDIDSDKNQGSLSLTNLNAFDIISFSTGFDLSALFDEKYGQREARFTSKESAAAVFATLNELARRLKLKFTKKDNGVLNLATTKEGRKGMLELDAEIFEIAPSFLLVELKKTNGDTMEYQKLIKDDIRPSLKDIVWAWQGDQQQTRILRQAEQEQLSPLPPISPIPPQQS

SEQ ID NO: 19492 - DNA, 747 bp, Sorghum bicolor
  misc_feature: Ceres ANNOT ID no. 8733225
  misc_feature: Encodes the peptide sequence at SEQ ID NO 19493
atggccattgccggtgctcttttcctcctgctcggtctcctcgccggggaagccgcggcgggcggctacggcgggtggcagagcgcgcacgccacgttctacggcggcggcgacgcgtccggcacaatgggcggcgcgtgcgggtacggcaacctgtacagcaccgggtacggcacgaacacggcggcgctgagcacggcgctgttcaacgacggcgcggcgtgcgggtcctgctacgagctgcggtgcgacaacgccgggcggtcgtgcctgccgggcaccatcaccgtgacggccaccaacttctgccctcccaactacggcctccccagcgacgacggcggctggtgcaacccgccgcggccgcacttcgacatggccgagcccgccttcctccacatcgcgcagtaccgcgccggcatcgtgcccgtcgccttcaggagagtgccgtgcgtgaagaagggcggcatccggttcaccatcaacgggcactcctacttcaacctggtgctggtgaccaacgtggcgggcgcgggggacgtgcggtccgtctccatccggggctcgcggacggggtggcagcccatgtcgcggaactggggccagaactggcagagcaacgcggacctggacgggcaggcgctgtcgttccaggtcaccgccagcgacggccgcaccgtcaccagcaacaacgccgcccccgccggatggcagttcggccagaccttcgagggcgcccagttctga

SEQ ID NO: 19493 - protein, 248 aa, Sorghum bicolor
  misc_feature: Useful for making plants with altered carbohydrate content
  misc_feature: Functional homolog of the protein sequence given in SEQ ID NO 14464
  misc_feature: Useful for making plants with altered cell wall content and/or composition
  misc_feature: Functional homolog of the protein sequence given in SEQ ID NO 14001
  misc_feature: Useful for making plants with altered lignin content
  misc_feature: Functional homolog of the protein sequence given in SEQ ID NO 12888
  misc_feature: Ceres ANNOT ID no. 8733225
  misc_feature (157)..(234): Pfam ID: Pollen_allerg_1 Pfam Description: Pollen allergen
  misc_feature (61)..(146): Pfam ID: DPBB_1 Pfam Description: Rare lipoprotein A (RlpA)-like double-psi beta-barrel
MAIAGALFLLLGLLAGEAAAGGYGGWQSAHATFYGGGDASGTMGGACGYGNLYSTGYGTNTAALSTALFNDGAACGSCYELRCDNAGRSCLPGTITVTATNFCPPNYGLPSDDGGWCNPPRPHFDMAEPAFLHIAQYRAGIVPVAFRRVPCVKKGGIRFTINGHSYFNLVLVTNVAGAGDVRSVSIRGSRTGWQPMSRNWGQNWQSNADLDGQALSFQVTASDGRTVTSNNAAPAGWQFGQTFEGAQF

SEQ ID NO: 19494 - DNA, 1497 bp, Sorghum bicolor
  misc_feature: Ceres ANNOT ID no. 8733272
  misc_feature: Encodes the peptide sequence at SEQ ID NO 19495
atggtgtcactgacgacggcggcggatcatgggcagcggccgcacgccgtgtgcatgccgtacccggcgcagggccacgtgacgcccatgctgaagctcgccaagctcctccacgcgcgtggcttcgaggtcaccttcgtcaacaccgagttcaaccaccggcgcctgcaccgctcccgcggcgcgctggaccgcgtgcccgggttccgcttcgacgccatcccggacggcctcccgccgtccgacgccgacgccacgcaggacatccccgcgctcagctactccaccatgaccacctgcctcccgcacctcctcgcgctgctcgccagggtcgacgccgacgccgcgtccccgcgagtcacctgcctcgtcacggacgccgtcatgtcgttcggcttcgacgccgccagggagttcggcgtgcccgtcgccgcgctctggaccgccagcacgtgcgggttcatggggtaccggaactacaggagcctcgtcgactcgggcctcgtgccgttcaagaccgccgcggacctcgaggacggcgtcgagggaggtcacctcgccaccgtggtgaccggcgcgcgcggcatgtgcgacggcgtgcagctgcgcgacttccccagcttcatccgcaccacggaccgcgccgacatcatgctcaacttcctcatgcgcgaggccgagcggctgtcgctccccgacggcgtcatcgtcaacaccttcgaggacctcgagggcgcctcgctggacgccatgcgcgcgatcctcccgacggtgtaccccgtcggcccgctcctcctccgcgagcgcctggagatccccgccggcagcccgctcgcggggctcggctccaacctctggaaggagcaggaggggctcccggagtggctcgccggccgcgcgccgcggtccgtggtgtacgtgaactacggcagcatcacggtgatgaccaactcgcagctgctcgagttcgcctggggcctggccaacagcgggtacccgttcgtgtggaacatccggccggacctcgtgaagggcgactccgccgtgctgccgccggagttcacgtccgccgtcgagggccgcgcgctgctgaccacgtggtgcccgcaggaggcggtgctcccgcacgaggcggtcggggtgttcctgactcactccggctggaactcgacactggagagcctctgcgccggggtgcccatgctcagctggcccttctttgcggagcagcagactaactgccggtacaagcggacggagtggggcgtcgggatggagatcggcggggaggtgcggcgcgacgaggtgtcggccatcttaaaggaggccatggacggggagaaggggcgagagatgcgccggcgcgcggaggagtggaaggagaaggccgtgaaggtgacgctgccgggtgggcctgcgcagaccaaccttgaaagggtcatcgacgaggtgctgctctccaagatgaagggacagaaacagactgccaacgtctga

SEQ ID NO: 19495 - protein, 498 aa, Sorghum bicolor
  misc_feature: Useful for making plants with altered carbohydrate content
  misc_feature: Functional homolog of the protein sequence given in SEQ ID NO 14338
  misc_feature: Ceres ANNOT ID no. 8733272
  misc_feature (14)..(484): SWISSPROT Homolog: EC 2.4.1.121 Indole-3-acetate beta-glucosyltransferase
  misc_feature (16)..(488): Pfam ID: UDPGT Pfam Description: UDP-glucoronosyl and UDP-glucosyl transferase
MVSLTTAADHGQRPHAVCMPYPAQGHVTPMLKLAKLLHARGFEVTFVNTEFNHRRLHRSRGALDRVPGFRFDAIPDGLPPSDADATQDIPALSYSTMTTCLPHLLALLARVDADAASPRVTCLVTDAVMSFGFDAAREFGVPVAALWTASTCGFMGYRNYRSLVDSGLVPFKTAADLEDGVEGGHLATVVTGARGMCDGVQLRDFPSFIRTTDRADIMLNFLMREAERLSLPDGVIVNTFEDLEGASLDAMRAILPTVYPVGPLLLRERLEIPAGSPLAGLGSNLWKEQEGLPEWLAGRAPRSVVYVNYGSITVMTNSQLLEFAWGLANSGYPFVWNIRPDLVKGDSAVLPPEFTSAVEGRALLTTWCPQEAVLPHEAVGVFLTHSGWNSTLESLCAGVPMLSWPFFAEQQTNCRYKRTEWGVGMEIGGEVRRDEVSAILKEAMDGEKGREMRRRAEEWKEKAVKVTLPGGPAQTNLERVIDEVLLSKMKGQKQTANV

SEQ ID NO: 19496 - DNA, 240 bp, Sorghum bicolor
  misc_feature: Ceres ANNOT ID no. 8733290
  misc_feature: Encodes the peptide sequence at SEQ ID NO 19497
atgcacaagccatattctctggtcagagagatcgtgaggaagaataacaccttccttgtcaaacaatttggcaacgacaatggcaagttccagttcagtaaggattccaacaatctatataatgttcactgccttgcaaacaagaagatcatgacattgcagccagccagtggtagggagaatgtagtggtcctctatacaaccaaaacaaagaagcaaaataagactcaacctctgtga

SEQ ID NO: 19497 - protein, 79 aa, Sorghum bicolor
  misc_feature: Useful for making plants with altered oil content
  misc_feature: Useful for making plants with modulated cold sensitivity
  misc_feature: Functional homolog of the protein sequence given in SEQ ID NO 14601
  misc_feature: Ceres ANNOT ID no. 8733290
MHKPYSLVREIVRKNNTFLVKQFGNDNGKFQFSKDSNNLYNVHCLANKKIMTLQPASGRENVVVLYTTKTKKQNKTQPL

SEQ ID NO: 19498 - DNA, 486 bp, Sorghum bicolor
  misc_feature: Ceres ANNOT ID no. 8733292
  misc_feature: Encodes the peptide sequence at SEQ ID NO 19499
atggtgctgaagacggaactttgccgcttcagcggtcagaagatttatcctgggaaaggcatcagatttattcgtgctgattctcaggttttcctttttgccaactcgaaatgcaagcgctacttccacaaccgcctgaagcctgctaagcttacctggacagcaatgtacaggaagcaacacaagaaggacatccatgctgaagcggtcaagaagaggcgccgcaccaccaagaagccatactccaggtcaattgtgggtgcttccttggaagtgatccagaagaagagagctgagaagccagaggttcgcgatgctgctagagaagctgctcttcgcgagatcaaggagcgcatcaagaagaccaaggatgagaagaaagcaaagaaggcggaggtgaccaagtcccagaaggggcaaacgaagggcgcggtccagaagggttccaagggccccaagttgggtggtggcggcgggaagcgctga

SEQ ID NO: 19499 - protein, 161 aa, Sorghum bicolor
  misc_feature: Useful for making plants with modulated nitrogen use efficiency
  misc_feature: Functional homolog of the protein sequence given in SEQ ID NO 14134
  misc_feature: Ceres ANNOT ID no. 8733292
  misc_feature (3)..(73): Pfam ID: Ribosomal_L24e Pfam Description: Ribosomal protein L24e
MVLKTELCRFSGQKIYPGKGIRFIRADSQVFLFANSKCKRYFHNRLKPAKLTWTAMYRKQHKKDIHAEAVKKRRRTTKKPYSRSIVGASLEVIQKKRAEKPEVRDAAREAALREIKERIKKTKDEKKAKKAEVTKSQKGQTKGAVQKGSKGPKLGGGGGKR

SEQ ID NO: 19500 - DNA, 1917 bp, Sorghum bicolor
  misc_feature: Ceres ANNOT ID no. 8733282
  misc_feature: Encodes the peptide sequence at SEQ ID NO 19501
atgaagggcctgggaccggcggccgccaccgccgcgccagctggcaagcgtcggtggcggtgcgtggcggcgacgggggccgcgttggcgctgctcttcttctccgtcgtcgtgcccctcgccgtgctcctcggcctccacacgcgcttcccctcaatgtacttggtcgacgaaagcgcggtgtcggtttatgacggcagcgagggtggtacttggccgcaggttccgtcggaggaaaatgacagctcgcaagttaacaataccgtgaaggagtttgtaccgcctacttcgaaggtcgtgacagacacaaatggcagtccatctgacaaggttattggcagccaaccagagcttggcaaatttaatgaagatatctcaattcatctagctccccctatccaacaagctacaactttggaatgttctatgctgcccaatattactaacattgatttgaaggacaactttgaacaaggtttacctggtgatgagaatggagcattctgccaggttcaatttggaagctattgtcgttggtctgtagaacataaggaggtcatgaaggattctacagtgaagagacttaaagatcagctctttgttgcaagagcttactatccaagcattttgaaacttgacggcatggaaaagctttcacgtgaaatgaaacaaaatatccaagaacttgagcatatgcttagtgaagccatatcagatgatgatcttcctaaatttcatggagtcaatttggccaagatggaccagataattgctgcagcaaaatcatgtgccgtagaatgcactaatgttgagaaaaagctaaaacagttgcttgatatgaccgaagatgaagctctttttcatgcaagacagagtgcttatctttacaggcttggagttcagacattacccaagagcctccactgcctttcaatgagattgacagttgactacttcaagtcctcagctgacatagggcattcaggcgcagagaagcttgagaatcctgcattccggcactacattattttctccaccaaccttcttgcatcagccatgactgtcaactcaactgtgataaattctgaggaatcggtaaatatggttttccatcttgttactgatccacagaacttctatgcatttaagaactggttcatcagaaatgcttacaagggagctactgtcaatgtccttaattttgagcattttcaactgaagaatttggttaatgggaaagttgaacaactatcaatatctgaggagttccgcatcacctcccatagcaatgctccaacgctaaacacccttcggagaactgaatatatttcaatgtttgggcactccttgttcgtgcttcctgaattctttagcagtcttaaaagggtcatcgtcctggaagatgatactatagtccagagagacttgtcgctcctgtggaaccttgacctaaaaggaaaagtgattggtgctgtccagttttgtcgagtaagattcgatcaactcagggcatacttgcatgacttcccctataattccagttcgtgcatatggatgtctggggtgactgttattgatcttgataaatggagggaacatgatgtcactggaattcatcagcggatacaaaagaagatgcaacatgagtcagaagcttcctggagagctgcaacactacctgcaggtctacttgtttttcaagatctgatccatcctattgaaggccagtgggtccaatttggtctgggtcatgactatggactcactcatggtgctataaagaaagctgccatattgcactacaatggcaacatgaaaccctggttggaacttgggatacgccggtacaggaaatactggaagaagtacctgccgagggatgatccgtttatgattgattgcaatgtgaacccatga

SEQ ID NO: 19501 - protein, 638 aa, Sorghum bicolor
  misc_feature: Useful for making plants with altered carbohydrate content
  misc_feature: Functional homolog of the protein sequence given in SEQ ID NO 13776
  misc_feature: Ceres ANNOT ID no. 8733282
  misc_feature (399)..(633): SWISSPROT Homolog: EC 2.4.1.58 Lipopolysaccharide glucosyltransferase I
  misc_feature (309)..(612): Pfam ID: Glyco_transf_8 Pfam Description: Glycosyl transferase family 8
MKGLGPAAATAAPAGKRRWRCVAATGAALALLFFSVVVPLAVLLGLHTRFPSMYLVDESAVSVYDGSEGGTWPQVPSEENDSSQVNNTVKEFVPPTSKVVTDTNGSPSDKVIGSQPELGKFNEDISIHLAPPIQQATTLECSMLPNITNIDLKDNFEQGLPGDENGAFCQVQFGSYCRWSVEHKEVMKDSTVKRLKDQLFVARAYYPSILKLDGMEKLSREMKQNIQELEHMLSEAISDDDLPKFHGVNLAKMDQIIAAAKSCAVECTNVEKKLKQLLDMTEDEALFHARQSAYLYRLGVQTLPKSLHCLSMRLTVDYFKSSADIGHSGAEKLENPAFRHYIIFSTNLLASAMTVNSTVINSEESVNMVFHLVTDPQNFYAFKNWFIRNAYKGATVNVLNFEHFQLKNLVNGKVEQLSISEEFRITSHSNAPTLNTLRRTEYISMFGHSLFVLPEFFSSLKRVIVLEDDTIVQRDLSLLWNLDLKGKVIGAVQFCRVRFDQLRAYLHDFPYNSSSCIWMSGVTVIDLDKWREHDVTGIHQRIQKKMQHESEASWRAATLPAGLLVFQDLIHPIEGQWVQFGLGHDYGLTHGAIKKAAILHYNGNMKPWLELGIRRYRKYWKKYLPRDDPFMIDCNVNP

SEQ ID NO: 19502 - DNA, 297 bp, Sorghum bicolor
  misc_feature: Ceres ANNOT ID no. 8733293
  misc_feature: Encodes the peptide sequence at SEQ ID NO 19503
atgaagcgccacgccgagaagccgctcctcgtgctcctcgtgctgtcctgcctcctcctcctcctcctccccctcgcctccgccgtccccacgccaagaagcctgcgcctggtggggaggagccagctgcagcagcgcccgccggctctgaagctcacttctgctcaggagacggcgatcgcggcggcgatgaacatgggcaagcctatggcgaggatggtcgtggaggtgaacgactaccaaccgtctggccccaacaaccgccatgacccacccaagggtcccggaagagcttga

SEQ ID NO: 19503 - protein, 98 aa, Sorghum bicolor
  misc_feature: Useful for making plants with modulated flowering time
  misc_feature: Functional homolog of the protein sequence given in SEQ ID NO 14463
  misc_feature: Ceres ANNOT ID no. 8733293
MKRHAEKPLLVLLVLSCLLLLLLPLASAVPTPRSLRLVGRSQLQQRPPALKLTSAQETAIAAAMNMGKPMARMVVEVNDYQPSGPNNRHDPPKGPGRA

SEQ ID NO: 19504 - DNA, 561 bp, Sorghum bicolor
  misc_feature: Ceres ANNOT ID no. 8733305
  misc_feature: Encodes the peptide sequence at SEQ ID NO 19505
atggggctcacgttcacgaagctgttcagccggctcttcgccaagaaggagatgaggatcctcatggtcggtctggatgcagctggtaagaccaccatcctctacaagctcaagctcggcgagatcgtcaccaccatccccaccattggatttaacgttgaaactgtcgagtacaagaacattagtttcactgtttgggatgtcggtggtcaggacaagatccggcccctgtggaggcactacttccagaacacccagggcctcatttttgttgtagacagcaacgacagagagcgtgttgttgaggccagagatgagctccaccggatgctgaacgaagacgagctccgtgatgctgtgcttttggtgtttgcaaacaaacaagatctgcctaatgccatgaatgctgctgaaatcaccgataagcttggcctgcactcgctgcgccagcggcactggtacatccagagcacatgtgctacctctggtgagggtttgtacgaggggcttgactggctttcgaacaacattgccaacaagtttgttatcaatgcatactga

SEQ ID NO: 19505 - protein, 186 aa, Sorghum bicolor
  misc_feature: Useful for making plants with altered alkaloid content
  misc_feature: Useful for making plants with altered lignin content
  misc_feature: Functional homolog of the protein sequence given in SEQ ID NO 12945
  misc_feature: Useful for making plants with modulated nitrogen use efficiency
  misc_feature: Functional homolog of the protein sequence given in SEQ ID NO 14003
  misc_feature: Useful for making plants with altered terpenoid content
  misc_feature: Functional homolog of the protein sequence given in SEQ ID NO 13081
  misc_feature: Ceres ANNOT ID no. 8733305
  misc_feature (5)..(177): Pfam ID: Arf Pfam Description: ADP-ribosylation factor family
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKFVINAY

SEQ ID NO: 19506 - DNA, 975 bp, Sorghum bicolor
  misc_feature: Ceres ANNOT ID no. 8733309
  misc_feature: Encodes the peptide sequence at SEQ ID NO 19507
atgtcatcacagactggaggtggcagaggtagtgacgccggctcggtgcaacgtgggcagatgcagagtttggcaagacaagggtctttatacaaccttaccctcgatgaggtgcagagccatttgggggagccattgcttagcatgaattttgatgagctcctgaagagtgtgtttcctgatggtgtagatccagatggtgctgtttcaggcaagcctgatccaacatcgagcctgcagcgacaggggagcatcatgatgcctctgcagctgagcaagaagactgtcgacgaggtgtggaagggcatccagggtggaccagagaccagtgctgcggtggatggtcggcagaggcgagagaggcagccaacacttggggagatgacacttgaggacttcctggtcaaagctggggttgttacagaaggacatatgaaggattcggctgatttgcaaagcaatgtggatacagttggcagcagtgttgttgtggctggtgcttctagtttgaaccctggagcacagtggttgcagcagtaccaacagcaagctttggggtcccagcaaccgagtttggcaggttcatacatggctagtcagttgcaccctcagccattgtctattgctacaggtgctattatggattctatttactctgatggccagattacttcgccatcattcggtgcactttcagaccctcagacacctggccgcaagcgtggtgccttaggggaggtagtcgataaggtggttgaaagaaggcagaagaggatgataaagaatagggaatcagctgcacgatcaagagcgagaaagcaggcttacactaacgaacttgaaaacaaggtatcccgtctagaagaggagaatgagaggctaaagaaacagcaggagttggatgagatactgagctctgctcctccaccagaacccaagtatcaactcaggagaacgggttcagctgccttttga

SEQ ID NO: 19507 - protein, 324 aa, Sorghum bicolor
  misc_feature: The sequence is a functional homolog of SEQ ID NO 1538 in the 10/412,699 US patent application
  misc_feature: The sequence is a functional homolog of SEQ ID NO 1539 in the 10/412,699 US patent application
  misc_feature: The sequence is a functional homolog of SEQ ID NO 1541 in the 10/412,699 US patent application
  misc_feature: Useful for making plants with altered alkaloid content
  misc_feature: Functional homolog of the protein sequence given in SEQ ID NO 14713
  misc_feature: Ceres ANNOT ID no. 8733309
  misc_feature (250)..(305): Pfam ID: bZIP_1 Pfam Description: bZIP transcription factor
MSSQTGGGRGSDAGSVQRGQMQSLARQGSLYNLTLDEVQSHLGEPLLSMNFDELLKSVFPDGVDPDGAVSGKPDPTSSLQRQGSIMMPLQLSKKTVDEVWKGIQGGPETSAAVDGRQRRERQPTLGEMTLEDFLVKAGVVTEGHMKDSADLQSNVDTVGSSVVVAGASSLNPGAQWLQQYQQQALGSQQPSLAGSYMASQLHPQPLSIATGAIMDSIYSDGQITSPSFGALSDPQTPGRKRGALGEVVDKVVERRQKRMIKNRESAARSRARKQAYTNELENKVSRLEEENERLKKQQELDEILSSAPPPEPKYQLRRTGSAAF

SEQ ID NO: 19508 - DNA, 795 bp, Sorghum bicolor
  misc_feature: Ceres ANNOT ID no. 8733332
  misc_feature: Encodes the peptide sequence at SEQ ID NO 19509
atgtaccatgctaagaatttttctgtgccctttgcacagcagagggctcagaataatgaacatgcaagtaatattggaggtattggtggacccaacgtaagcaaccctgctaatcctgtaggaagtgggaaacaacgcttacgatggacatcagatcttcataatcgctttgtggatgccattgcacagcttggtggaccagatagagctacacctaaaggggttctcactgtgatgggtgtaccagggatcacgatttatcatgtgaagagccatttgcagaagtatcgccttgcaaagtatataccggaatctcctgctgaaggttccaaggacgaaaagaaagattcgagtgattccctctcgaacacggattctgcaccaggattgcaaatcaacgaggcactaaagatgcaaatggaggttcaaaagcggctacatgagcaactcgaggttcaaagacaactgcaactaagaattgaagcacaagggagatacctgcagatgataattgaggagcaacaaaagcttggtggatcaattaaagcttctgaggatcagaagctttcagattcacctccaagcttagatgactacccagagagcatgcagccttctcccaagaaaccaaggatagatgcattatcaccggattcagagcgagatagaacacaacccgaatttgaatcccatttgatgggtccgtgggatcaagaaatctgtgcgaaaaacatatgcggcgttgcattcccagtggaggagttcaaagcagaccctggtatgagcaagtcttaa

SEQ ID NO: 19509 - protein, 264 aa, Sorghum bicolor
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: Ceres ANNOT ID no. 8733332
  misc_feature (46)..(97): Pfam ID: Myb_DNA-binding Pfam Description: Myb-like DNA-binding domain
MYHAKNFSVPFAQQRAQNNEHASNIGGIGGPNVSNPANPVGSGKQRLRWTSDLHNRFVDAIAQLGGPDRATPKGVLTVMGVPGITIYHVKSHLQKYRLAKYIPESPAEGSKDEKKDSSDSLSNTDSAPGLQINEALKMQMEVQKRLHEQLEVQRQLQLRIEAQGRYLQMIIEEQQKLGGSIKASEDQKLSDSPPSLDDYPESMQPSPKKPRIDALSPDSERDRTQPEFESHLMGPWDQEICAKNICGVAFPVEEFKADPGMSKS

SEQ ID NO: 19510 - DNA, 1584 bp, Sorghum bicolor
  misc_feature: Ceres ANNOT ID no. 8733336
  misc_feature: Encodes the peptide sequence at SEQ ID NO 19511
atgggaaactgctgctgctcggggtcgtcgtccgcggagcccgcgctgccgccggactcctccgccggctcgtcgtcgcggcccgggggcagcgccaccgtgccgccgccgacgtcggtgtcgtcgtcggcgaccacggcgcccacgcaaaacaagcccccggccgccatcggccccgtgctgggccgcccgatggaggacgtcaagagcacctacaccatgggcaaggagctcgggcgcgggcagttcggcgtcacgtcgctgtgcacgcacaaggccacgggccagaagttcgcgtgcaagaccatcagcaagcggaagctgtccaccaaggaggacatcgaggacgtgcggcgcgaggtgcagatcatgtaccacctctccggccaacccggcgtcgtggagctcaagggcgcctacgaggacaagagctcggtgcacctcgtcatggagctctgcgccggcggggagctcttcgaccggatcatcgccaagggccactacaccgagcgcgccgccgcctcgctcctccgcaccatcgtcgagatcgtccacacctgccactccatgggcgtcatccaccgcgacctcaagcccgagaacttcctcctcctcagcaaggacgagaacgcgccgctcaaggccaccgactttgggctctccgtcttcttcaaagaaggggaggtgttcagggacatcgtcggcagcgcctactacatcgcgccggaggtgctgaagcggagctacgggcccgaggccgacatatggagcgtcggcgtcatcgtctacatcctgctctccggcgttccgccattctgggcagaatcggagcacggcatcttcaatgccatcctgagagggcaggtcgacttcaccagcgacccatggccgcgcatctcgcagagcgccaaggacctcgtcaggaagatgctcattcctgaccccaagcatcggatttctgcatacgacgtcctcaatcacccgtggatcaaagaagacggcgaggcgcctgacacgccgctggacaacgccgttctcggccggctcaagcagttcagagctatgaaccagttcaagaaggctgctctgagggttatcgccggatgcctgtcggaggaggagatcaaggggctcaaggagatgttcaagagcatggactccgacaacagcggcacgataaccgtcgacgagctgcggcgagggctggccaagaagggcaccaagctcagcgaggctgaagtccagcagctcatggaagctgccgacgccgacgggaacgggacgatcgactacgaggagttcatcacggcgacgatgcacatgaacagaatggaccgggacgagcacctctacaccgcgttccagtacttcgacaaggacaacagcgggtacatcacgatggaagagctggagcaagccctgagggagaaggggctgctcgacggccgagacatcaaggacatcgtagcagaagtcgacgccgacaacgacgggcggatcaactacaccgagttcgcggcgatgatgaggaaaggagacccggagccatccaacatcaagaaacggcgcgacgtcgtcctgtag

SEQ ID NO: 19511 - protein, 527 aa, Sorghum bicolor
  misc_feature: The sequence is a functional homolog of SEQ ID NO 2 in US patent 7084323
  misc_feature: Ceres ANNOT ID no. 8733336
  misc_feature (60)..(520): SWISSPROT Homolog: EC 2.7.11.1 Non-specific serine/threonine protein kinase
  misc_feature (72)..(330): Pfam ID: Pkinase Pfam Description: Protein kinase domain
  misc_feature (377)..(405): Pfam ID: efhand Pfam Description: EF hand
  misc_feature (484)..(512): Pfam ID: efhand Pfam Description: EF hand
  misc_feature (413)..(441): Pfam ID: efhand Pfam Description: EF hand
  misc_feature (449)..(477): Pfam ID: efhand Pfam Description: EF hand
MGNCCCSGSSSAEPALPPDSSAGSSSRPGGSATVPPPTSVSSSATTAPTQNKPPAAIGPVLGRPMEDVKSTYTMGKELGRGQFGVTSLCTHKATGQKFACKTISKRKLSTKEDIEDVRREVQIMYHLSGQPGVVELKGAYEDKSSVHLVMELCAGGELFDRIIAKGHYTERAAASLLRTIVEIVHTCHSMGVIHRDLKPENFLLLSKDENAPLKATDFGLSVFFKEGEVFRDIVGSAYYIAPEVLKRSYGPEADIWSVGVIVYILLSGVPPFWAESEHGIFNAILRGQVDFTSDPWPRISQSAKDLVRKMLIPDPKHRISAYDVLNHPWIKEDGEAPDTPLDNAVLGRLKQFRAMNQFKKAALRVIAGCLSEEEIKGLKEMFKSMDSDNSGTITVDELRRGLAKKGTKLSEAEVQQLMEAADADGNGTIDYEEFITATMHMNRMDRDEHLYTAFQYFDKDNSGYITMEELEQALREKGLLDGRDIKDIVAEVDADNDGRINYTEFAAMMRKGDPEPSNIKKRRDVVL

SEQ ID NO: 19512 - DNA, 2058 bp, Sorghum bicolor
  misc_feature: Ceres ANNOT ID no. 8733343
  misc_feature: Encodes the peptide sequence at SEQ ID NO 19513
atgcacggccttctccccatcctcctcctctgctcgtctctcctcgcaaccacacccaccgccggcagtccaaccgcggaatcctgcccgagcgacacgaactacacgcgcggcagcgcgttccaggccaacctcgacgccctcctctcatcactccccgcgaccgccgccgccgcgtccacagggtttgccacgaacagcaccggaacctcgaccgacgaccaggcggcgtacggcctcgcgcagtgccgcgccgacgtcatcggcacgtcgagctgcagcacgtgcctcaatggcacggcgcaggacgtggccgccggcaagtgcgcaggccagaagaaggccgtgctcgtctacgacaactgcctgctgcggctctccgacgagaggttcttcggcgccgtcgacatgtcagtggtgaattacctgttgaacacgcagaacgcgacgcagccggagcagttcgcgacgcagctcggcgcgctgatgaacaacatcacgaggaaggcggcgctcgagtccccgcggatgttcgccgtcggctcagccgcggtgacgcccttcgtgaacatctacgggatggcgcagtgcacccgcgacctcaccgccgacgactgcaaccgctgtctcgtgaacgccgtctcgtcgatcccgagctgctgcagcgggaagaagggtggccagctcatctacaccagctgctccatccggttcgaggtggagccgttctacagcatccaggccgctgaggcggcgatgtcgccggcgccggccccgggaggcgggctcgtcaacggaagcgaccactccggcacaggaagcaacgacgggagtaatcacacggtcaggacagctcttctcgtgtccatccctgtcgctgttgcgctgctcgtgctgctgctagttgttgcctatctctgcaacaggaacagaaaaccacacaagcatgttcagattgcaagcatcagacatgaagatgaagaagaaatgagaagctcagagtctctcctgtatgatttgagcaccctacgagctgccactgacaacttctcagaagaaaacaagctcggcgaaggcgggtttgggccagtatacaaaggcacgctacaaaatggacaggagattgcagtgaagaggttgtctgcaacatcgcagcaaggacaggtggagatgaagaacgaggtctttctgctggcgaagctccagcacaagaacttggtgcgccttctcgggtgctgcatcgaggaacacgagaggctcctcgtctacgagttcctcaccaacaacagcctcgacaagatcctctttgatcctgcacggcaggaggagctaggctggggactgaggcacaagatcatcgaggggatcagccgaggtctcctctacctccatgaggactcgaggcttaccatcatccaccgggatctcaaggccagcaacatcttgctggacgcgaacatgaaccccaagatctccgacttcggcctggccaagctattcagcatcgactccagtgtaggaaacaccagccgcattgctggaacatacgggtacatgtcgccggagtacgccctgcacggcatcttctcggccaaatcggacgtctttagctacggtgtccttatcctcgagatcgtcaccggacgacgcaacacgtacacgcatgcttccggaccctctgaagatcttcttacctatgtttggaagcagtggagccgcgggagcgtgcagccgctggtggaggggtgccccgacgaggggcgccggccgcaggagatgctgaggtgcatccacatcggtttgctctgtgtccaggaggacccgcacctccgccccagcatggcatcagtcgtcgtcatgctcaatagccgatccatcacgctgccggcgcccgccgcgccagccttcgtgatgccaggccatggtctcacggtgaccgcggacggggtgcctgtgacgggaacggatcgccagggtgcgcgggcggtgccagcagcagctcggggacagtccatgtccatcaatggagcctcctttactgacctggagccgcgttga

SEQ ID NO: 19513 - protein, 685 aa, Sorghum bicolor
  misc_feature: Useful for making plants with altered carbohydrate content
  misc_feature: Functional homolog of the protein sequence given in SEQ ID NO 14360
  misc_feature: Useful for making plants with modulated biomass
  misc_feature: Functional homolog of the protein sequence given in SEQ ID NO 14141
  misc_feature: Useful for making plants with altered cell wall content and/or composition
  misc_feature: Functional homolog of the protein sequence given in SEQ ID NO 14140
  misc_feature: Ceres ANNOT ID no. 8733343
  misc_feature (309)..(621): SWISSPROT Homolog: EC 2.7.11.1 Non-specific serine/threonine protein kinase
  misc_feature (350)..(621): Pfam ID: Pkinase Pfam Description: Protein kinase domain
MHGLLPILLLCSSLLATTPTAGSPTAESCPSDTNYTRGSAFQANLDALLSSLPATAAAASTGFATNSTGTSTDDQAAYGLAQCRADVIGTSSCSTCLNGTAQDVAAGKCAGQKKAVLVYDNCLLRLSDERFFGAVDMSVVNYLLNTQNATQPEQFATQLGALMNNITRKAALESPRMFAVGSAAVTPFVNIYGMAQCTRDLTADDCNRCLVNAVSSIPSCCSGKKGGQLIYTSCSIRFEVEPFYSIQAAEAAMSPAPAPGGGLVNGSDHSGTGSNDGSNHTVRTALLVSIPVAVALLVLLLVVAYLCNRNRKPHKHVQIASIRHEDEEEMRSSESLLYDLSTLRAATDNFSEENKLGEGGFGPVYKGTLQNGQEIAVKRLSATSQQGQVEMKNEVFLLAKLQHKNLVRLLGCCIEEHERLLVYEFLTNNSLDKILFDPARQEELGWGLRHKIIEGISRGLLYLHEDSRLTIIHRDLKASNILLDANMNPKISDFGLAKLFSIDSSVGNTSRIAGTYGYMSPEYALHGIFSAKSDVFSYGVLILEIVTGRRNTYTHASGPSEDLLTYVWKQWSRGSVQPLVEGCPDEGRRPQEMLRCIHIGLLCVQEDPHLRPSMASVVVMLNSRSITLPAPAAPAFVMPGHGLTVTADGVPVTGTDRQGARAVPAAARGQSMSINGASFTDLEPR

SEQ ID NO: 19514 - DNA, 2049 bp, Sorghum bicolor
  misc_feature: Ceres ANNOT ID no. 8733344
  misc_feature: Encodes the peptide sequence at SEQ ID NO 19515
atgtggaacctcctccccctcctcttcatcagctcgtccctgctcgtcgccacggccaacgccgacgacccatggtacaccgactgcccgagcaacaccaactacacgcgcggcagcgcgttccaggccaacctcgacgcactcctctcctccctccccgccgccgcggccgcgtcgtccgggttcgccgacaacgtcaccggcggggcgcccggccagcagcaggcgtacggcctcgcgcagtgccgcggcgacgtcaacgcgtcggcgtgcctcgcctgcctcgacggctcggcgcgccacatggccggcacctgccctggccagaaggaacgcatgctcatctacgacgagtgcctgctgcggcactccaacgagagcttcttcggcgtcgccgactcgtcggtgaggctctgggcgtggaacgcgcagaacgcgacgcggccggaggagttcacgtcgcggctcggcgcgctgatgggcaacctcacggcgacggcggcgttcgcgtccccgcggatgttcgcggccggggagaccgccgtcacgccgttcgtgaacatcttcggcatggcgcagtgcacgcgggacctcgccgccgatgactgcaaccgctgcctcgtcaacgccgtcgcgttcatcccgaactgctgcgacggaaagcagggcggccgggtcatcgggcggagctgctccatccggttcgaggtgtacccgttctacaacgtccaggctgcccaggaggccatggccatgtcgccggccgccgccccggttcccggaggtgggccgatcaacggcagcaaccactccgtgcccggaaacaccgggggcaatcacacggtcaggaacaggacagctcttcttgtgtcaattcctgctgctgtcacgctgctggtgctgttgctagtcgctctctatctctgcaagaggaacagaaagccacgcagggatgtgcaggttgcaagcgtcaaatctctcctatataatttgagcaccctacgagctgccaccgacaacttttcagtggaaaacaagcttggggaaggcgggtttggaccagtttacaaaggcacactgcaagacggccaggagattgcagtgaagaggctgtcagcaacttcgcagcagggacaggtggagatgaagaacgaggtggtccttttggcgaagctccagcataggaacttggtgcgcctgctcgggtgctgcatcgaggaacacgagaggctcctcgtctacgagttcctcaccaacaacagcctcgacaaaatcctctttggtgctgcattttcagacaaccatgatcctaactatcctgtacggcaggaggagctaggctggggactgaggcataagatcatcgaggggattagccgaggtctcctttacctccatgaggactcgaggcttaccatcatccaccgcgatctcaaggccagcaacatcttgctggacgcgaacatgaaccccaagatctccgacttcggcctggccaagctattcagcatcgactccagtgtaggaaacaccagccgcattgctggaacatacgggtacatgtcgccggagtacgccctgcatggcatcttctcggccaaatcggacgtattcagctacggtgtccttatcctcgagatcgtcaccggacgacgcaacgcgtacacgcatgcttccggaccctctgaagatcttcttacctattggagccgcgggagcgtgcagccgctgctggaggggtgccccgacgaggggcgccggccgcaggagatgctgaggtgcatccacatcggtttgctctgcgtccaggaggacccgcacctccgccccagcatggcatcagtcgtcgtcatgctcaatagccgatccatcacgctgccggcgcccgccgcgccagccttcgtggtgccaggccatggtctcacggtgaccgcggacggggtgcctgtgacggggacggatctcaacggtgcgagggcggtgccagcagctcggggaccatccatgtctatcaatgaagcctcctatactcacttggagccacgttga

SEQ ID NO: 19515 - protein, 682 aa, Sorghum bicolor
  misc_feature: Useful for making plants with altered carbohydrate content
  misc_feature: Functional homolog of the protein sequence given in SEQ ID NO 14360
  misc_feature: Ceres ANNOT ID no. 8733344
  misc_feature (318)..(619): SWISSPROT Homolog: EC 2.7.11.1 Non-specific serine/threonine protein kinase
  misc_feature (341)..(619): Pfam ID: Pkinase Pfam Description: Protein kinase domain
MWNLLPLLFISSSLLVATANADDPWYTDCPSNTNYTRGSAFQANLDALLSSLPAAAAASSGFADNVTGGAPGQQQAYGLAQCRGDVNASACLACLDGSARHMAGTCPGQKERMLIYDECLLRHSNESFFGVADSSVRLWAWNAQNATRPEEFTSRLGALMGNLTATAAFASPRMFAAGETAVTPFVNIFGMAQCTRDLAADDCNRCLVNAVAFIPNCCDGKQGGRVIGRSCSIRFEVYPFYNVQAAQEAMAMSPAAAPVPGGGPINGSNHSVPGNTGGNHTVRNRTALLVSIPAAVTLLVLLLVALYLCKRNRKPRRDVQVASVKSLLYNLSTLRAATDNFSVENKLGEGGFGPVYKGTLQDGQEIAVKRLSATSQQGQVEMKNEVVLLAKLQHRNLVRLLGCCIEEHERLLVYEFLTNNSLDKILFGAAFSDNHDPNYPVRQEELGWGLRHKIIEGISRGLLYLHEDSRLTIIHRDLKASNILLDANMNPKISDFGLAKLFSIDSSVGNTSRIAGTYGYMSPEYALHGIFSAKSDVFSYGVLILEIVTGRRNAYTHASGPSEDLLTYWSRGSVQPLLEGCPDEGRRPQEMLRCIHIGLLCVQEDPHLRPSMASVVVMLNSRSITLPAPAAPAFVVPGHGLTVTADGVPVTGTDLNGARAVPAARGPSMSINEASYTHLEPR

SEQ ID NO: 19516 - DNA, 1539 bp, Sorghum bicolor
  misc_feature: Ceres ANNOT ID no. 8733354
  misc_feature: Encodes the peptide sequence at SEQ ID NO 19517
atggacgcctccctcctcctctccgtcgcgctcgcggtggtgctgatcccgctctcgctcgcgctcctcaaccggctccgcctcggccgcctgccgccgggcccgcggccgtggcccgtcctgggcaacctgcgccagatcaagccgatccggtgccgctgcttccaggagtgggcggagcggtacgggcccgtcatctccgtctggttcgggtcggggctcaccgtggtcgtctccacctccgagctcgccaaggaggtgctcaaggagaatgaccagcagctcgcggaccggccgcggaaccgctccacccagcggttcagccgcaacgggcaggacctgatctgggccgactacggcccgcactacatcaaggtgcgcaagctctgcaacctcgagctcttcacgcccaagaggctcgaggcgctgcgccccatccgcgaggacgaggtcaccgccatggtcgagtccgtttaccgcgccgccactgcccccggtaatgaaggaaagccaatggtagtgaggaaccacctttctatggtggccttcaacaacataacaagactggcatttgggaagcggttcatgaatgcaaacggtgacattgacgaacaagggcgtgagtttaagactattgtgaacaacgggatcaagattggtgcatctctctctgttgctgagtttatttggtatttgagatggttgtgtccacttaatgaggagctttacaaaactcacaatgagagaagggaccgcttgacaatgaagatcattgaggagcacgcaaagtctctcaaggagagtggtgccaagcagcactttgtggatgcactcttcaccctcaaacaacagtacgaccttagtgaagacacagttattggacttctatgggacatgatcactgctggaatggacacaacagtcatctccgttgagtgggcaatggcagagctggtcaggaaccccagggtgcagaagaagctgcaagaggagctcgaccgtgtggttggccgtgaccgcgtcatgttagagaccgacttccagaacctcccgtacctacaggccgtcgtcaaggagtcgctccggctgcacccgccgacgccactcatgctcccccacaaggccagcacgaatgtcaagatcggtggctacgacatccccaagggcgccaacgtgatggtgaacgtgtgggcagtggcacgcgatcccaaggtctggagcaacccgctggagtacaggccggagcgcttcctggaggagaacatcgacatcaagggcagcgacttcagggtgttgccgtttggtgccggccggcgtgtctgccctggtgcgcagctcggcatcaacctcgtggcctccatgatcgggcaccttctgcaccacttcgagtggtccctgccggaaggcaccagaccggaggacgtcaacatgatggagtcccccgggctcgtcacgttcatgggcacaccactacaagctgtcgccaagccgcgcctggagaaggaggagctgtacaatagggtccccgttgagatgtga

SEQ ID NO: 19517 - protein, 512 aa, Sorghum bicolor
  misc_feature: Useful for making plants with altered carbohydrate content
  misc_feature: Functional homolog of the protein sequence given in SEQ ID NO 14458
  misc_feature: Useful for making plants with altered lignin content
  misc_feature: Functional homolog of the protein sequence given in SEQ ID NO 14459
  misc_feature: The sequence is a functional homolog of SEQ ID NO 6 in US patent 7071376
  misc_feature: The sequence is a functional homolog of SEQ ID NO 4 in US patent 7071376
  misc_feature: Useful for making plants with altered cell wall content and/or composition
  misc_feature: Functional homolog of the protein sequence given in SEQ ID NO 14460
  misc_feature: Ceres ANNOT ID no. 8733354
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to aminocyclopropane carboxylic treatment
  misc_feature: Up-regulated in shoot tissues in response to salicylic acid treatment
  misc_feature (43)..(502): SWISSPROT Homolog: EC 1.14.13.21 Flavonoid 3'-monooxygenase
  misc_feature (32)..(486): Pfam ID: p450 Pfam Description: Cytochrome P450
MDASLLLSVALAVVLIPLSLALLNRLRLGRLPPGPRPWPVLGNLRQIKPIRCRCFQEWAERYGPVISVWFGSGLTVVVSTSELAKEVLKENDQQLADRPRNRSTQRFSRNGQDLIWADYGPHYIKVRKLCNLELFTPKRLEALRPIREDEVTAMVESVYRAATAPGNEGKPMVVRNHLSMVAFNNITRLAFGKRFMNANGDIDEQGREFKTIVNNGIKIGASLSVAEFIWYLRWLCPLNEELYKTHNERRDRLTMKIIEEHAKSLKESGAKQHFVDALFTLKQQYDLSEDTVIGLLWDMITAGMDTTVISVEWAMAELVRNPRVQKKLQEELDRVVGRDRVMLETDFQNLPYLQAVVKESLRLHPPTPLMLPHKASTNVKIGGYDIPKGANVMVNVWAVARDPKVWSNPLEYRPERFLEENIDIKGSDFRVLPFGAGRRVCPGAQLGINLVASMIGHLLHHFEWSLPEGTRPEDVNMMESPGLVTFMGTPLQAVAKPRLEKEELYNRVPVEM

SEQ ID NO: 19518 - DNA, 1944 bp, Sorghum bicolor
  misc_feature: Ceres ANNOT ID no. 8733434
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to aminocyclopropane carboxylic treatment
  misc_feature: Up-regulated in shoot tissues in response to salicylic acid treatment
  misc_feature: Encodes the peptide sequence at SEQ ID NO 19519
atgccggaggcgccggtcaccacgatgcgagaggcggcgacggcggcggcggcggcggcggtgcccgagacgcaccgcgagctgctcgagtacatcgagcgcgtgacggcgggggcggcgcaggtgcagcgccgcgtgctggcggagatcctggcgcagaacgcgcccgccgagtacctccggaggctgggcgtggcgggcgacgcgccgggcgccgtcgacgcgttccgccgcgccgcgccgctcgtcacctacgaggacatcctccccgacgtgctgcgcatcgccaacggcgacacgtcgcccatcctctccggcaagcccatccgcgagttcctcaccagttccggcacgtcgggaggggagcgcaagctgatgccggcgatagccgacgagatggaccggcggtcgctgctgtacagcctactgatgccggtgatgagccaggccgtgccggggctggacaagggcaagtgcatgtacctctacttcgtcaaggcggagtcgcgcacgccggggggccacccggcgcgcccggtgctgacgagcttctaccggagccgccacttcctggagcggccgcacgacccttacaccgtgtacaccagccccgacgaggccatcctctgcgtggacgcgtaccagagcatgtacgcgcagctgctgtgcggcctcgtgcaccgcgccgacgtgctccgcgtgggcgccgtcttcgcctcgggttttctccgcgccatccgcttcctggagaagcactggcagcgcctgtgccgggacatccgcaccggcacgctggacgccgaggcggtcacggaccgcgccgtgcgcgccgccgtggagcagcgggtgctcctccgcgccgacccggcgctcgccgacgccgtcgaggccgagtgcgccaggacgtcgtggcaggggatcatccggagggtgtggcccaacaccaagtacatcgacgtcatcgtcaccggcgccatggcgcagtacatcccgcagctcgagttctacggcggcgggctgccgctgacctgcaccatgtacgcctcctccgagagctacttcggcatcaacctgaaccccatgtgcaagcccagcgaggtcgcctacaccctcatccccacaatgtgctacttcgagttcctccccttgccacagcccggcgacgacgacgccggcgagcccgaccagcgcgaccttgtcgacctcgtcgacgtcaagctcgggcacgagtacgagctcgtcgtcaccacctactcagggctgtatcggtatcgcgtgggcgacgtgctgcgcgtggccgggttcaagaaccaggcgcccatgttcaacttcctgcgccgcaagaacgtggtgctgagcatcgacgcggacaagaccgacgaggcggagctgcacgcggcggtgagcggcgcggtgcagcacctggccccgttcggcgcgtcgctggtggagtacacgagctacgcggacgctgggaccatcccgggccactacgtgctcttctgggagctccgcctccgcgctgcggcggctgcgggcgcgacgccgacgccggtgccggcgtcggtgttcgaggactgctgcctggccgtggaggaggcgctgaacagcgtgtaccggcagggccgcgccgccgaccgctccattggcccgctggagatcagggtggtgtcggacggcacgttcgacaagctcatggactacgcgctcgcccgcggcgcgtccatcaaccagtacaaggcgccccggtgcgtgcgcccgggccccgtcgtggagctgctggacgggcgggtgcaggccagctacttcagccccaagtgccccaagtggagccccggagtaggcaagcagtggagcagcgacgccgccgccgccgccaagaaggcggccgccggcggcagcaatggtggaggtggaggaggaggggcggtcgtcgtcgcctga

SEQ ID NO: 19519 - protein, 647 aa, Sorghum bicolor
  misc_feature: Useful for making plants with modulated biomass
  misc_feature: Useful for making plants with modulated light quality response
  misc_feature: Useful for making plants with modulated low light sensitivity
  misc_feature: Functional homolog of the protein sequence given in SEQ ID NO 14293
  misc_feature: Ceres ANNOT ID no. 8733434
  misc_feature (27)..(593): Pfam ID: GH3 Pfam Description: GH3 auxin-responsive promoter
MPEAPVTTMREAATAAAAAAVPETHRELLEYIERVTAGAAQVQRRVLAEILAQNAPAEYLRRLGVAGDAPGAVDAFRRAAPLVTYEDILPDVLRIANGDTSPILSGKPIREFLTSSGTSGGERKLMPAIADEMDRRSLLYSLLMPVMSQAVPGLDKGKCMYLYFVKAESRTPGGHPARPVLTSFYRSRHFLERPHDPYTVYTSPDEAILCVDAYQSMYAQLLCGLVHRADVLRVGAVFASGFLRAIRFLEKHWQRLCRDIRTGTLDAEAVTDRAVRAAVEQRVLLRADPALADAVEAECARTSWQGIIRRVWPNTKYIDVIVTGAMAQYIPQLEFYGGGLPLTCTMYASSESYFGINLNPMCKPSEVAYTLIPTMCYFEFLPLPQPGDDDAGEPDQRDLVDLVDVKLGHEYELVVTTYSGLYRYRVGDVLRVAGFKNQAPMFNFLRRKNVVLSIDADKTDEAELHAAVSGAVQHLAPFGASLVEYTSYADAGTIPGHYVLFWELRLRAAAAAGATPTPVPASVFEDCCLAVEEALNSVYRQGRAADRSIGPLEIRVVSDGTFDKLMDYALARGASINQYKAPRCVRPGPVVELLDGRVQASYFSPKCPKWSPGVGKQWSSDAAAAAKKAAAGGSNGGGGGGGAVVVA

SEQ ID NO: 19520 - DNA, 927 bp, Sorghum bicolor
  misc_feature: Ceres ANNOT ID no. 8733422
  misc_feature: Encodes the peptide sequence at SEQ ID NO 19521
atgtttaacttgtctgctgccggtgatgccaccgacgccggcagcggcatggtgactcttctagggtttccaccgccacaaattcaagtcccaaccaccgagctacccgagatgctaaggaggcaacaaataaccggcggtcatgctagaggcaacctggtaagcttagcacacaagcggtgctttggacttgttgttaacacgttctttgatttggagcacatgcattgcgagatgttcgtaggcaatgattacgtgaagagagcctacttcgttgggcccctatcgttgccatcacagcaggtggcagtaggtgcttacgactcacagtgcatcgattggctggacaagaaaccacctcaatccgtggtgtatttgtgcttcggcagcttgactcatgtctcacaggcccagctccgtgagctagctcttgggttagaggcctatgagaagccattcctgtgggtgatcaggtcagagacatgggtgccaccggaggggtggaaggagcgtgttggggacagggggatgactgtgatactggcgcaccatgccgtgggtgtgtttgtgatgcattgcgggtggaactcggtcctggaaacggtggtggctggtgtaccggtgctgacatggcctatggtgtttgagcaatttatcactgagagatttgtgactgaagtgctggcaatcggagagcgactgtggccacaaggtgccggcgtaagaagcacaagtggcacgagcactggccagtttatggagcccggaggggctggggatgcagcgaggagtaaagtcaaggagctctttgcgaaggcttgtgcagccatggcggaaggcggctcttctcaccgtgatctgcaccgcatgattgatgatctcatggaagcaggaacagcggctgcacggccagttctttccgtctga

SEQ ID NO: 19521 - protein, 308 aa, Sorghum bicolor
  misc_feature: Useful for making plants with altered carbohydrate content
  misc_feature: Functional homolog of the protein sequence given in SEQ ID NO 14714
  misc_feature: Ceres ANNOT ID no. 8733422
  misc_feature (110)..(294): SWISSPROT Homolog: EC 2.4.1.238 Anthocyanin 3'-O-beta-glucosyltransferase
MFNLSAAGDATDAGSGMVTLLGFPPPQIQVPTTELPEMLRRQQITGGHARGNLVSLAHKRCFGLVVNTFFDLEHMHCEMFVGNDYVKRAYFVGPLSLPSQQVAVGAYDSQCIDWLDKKPPQSVVYLCFGSLTHVSQAQLRELALGLEAYEKPFLWVIRSETWVPPEGWKERVGDRGMTVILAHHAVGVFVMHCGWNSVLETVVAGVPVLTWPMVFEQFITERFVTEVLAIGERLWPQGAGVRSTSGTSTGQFMEPGGAGDAARSKVKELFAKACAAMAEGGSSHRDLHRMIDDLMEAGTAAARPVLSV

SEQ ID NO: 19522 - DNA, 981 bp, Sorghum bicolor
  misc_feature: Ceres ANNOT ID no. 8733417
  misc_feature: Encodes the peptide sequence at SEQ ID NO 19523
atggcgtccagggcggctctcctggcgcttctgctctcggcgttcgcggcggcgtcggcggtggcgcagctggacgagaagttctacagccagtcgtgccccagcgtggaggatgtcgtccggaaggagatggtgcgcgcgctctccgtcgcgcccagcctcgccggccccctcctcaggatgcacttccacgactgcttcgtcagggggtgcgacggctccgtcctccttgactccacggcgaacaacaccgcggagaaggacgcgaagccgaacctgacgctgcgcggcttcagcttcatcgagacggtcaaggccgccgtggagaaggcgtgccctgacaccgtctcctgcgccgacttgctggccctcatggccagggacgccgtgtggctgagcaagggcccgttctgggcggtccctctggggcggcgagacggcagggtgtccatcgccaacgagaccaagcagctgccgccgccgacgggcaacttcacgaagctgacccagctgttcggcgccaagaacctggacaccaaggacctggtggtgctgtccgccggccacaccatcggcacgtcgcactgcttctccttctcggaccggctctacaacttcacggggctggacaacgcccgcgacatcgacccgacgctggacctggcgtacatggcgcggctccgcggcaagtgcacgagcctggacgacaacaccacgctggtggagatggacccagggagcttcaagaccttcgacctgagctacttcgccaacgtggccaagcgcaggggcctcttccactccgacggcgcgctgctcaccgaccccaccacccgcgcctacgtgctccgccacgccacggggaactacaaggaggagttcttcgccgacttcgccgcgtccatgctcaagatgggcgccgtcgacgtgctcaccggcagccagggagagatcaggaagaagtgcagcgtcgtcaactaa

SEQ ID NO: 19523 - protein, 326 aa, Sorghum bicolor
  misc_feature: Useful for making plants with altered carbohydrate content
  misc_feature: Functional homolog of the protein sequence given in SEQ ID NO 13757
  misc_feature: Useful for making plants with altered cell wall content and/or composition
  misc_feature: Functional homolog of the protein sequence given in SEQ ID NO 14262
  misc_feature: Useful for making plants with modulated nitrogen use efficiency
  misc_feature: Functional homolog of the protein sequence given in SEQ ID NO 13758
  misc_feature: Useful for making plants with modulated phosphate use efficiency
  misc_feature: Functional homolog of the protein sequence given in SEQ ID NO 13134
  misc_feature: Ceres ANNOT ID no. 8733417
  misc_feature (25)..(326): SWISSPROT Homolog: EC 1.11.1.7 Peroxidase
  misc_feature (40)..(288): Pfam ID: peroxidase Pfam Description: Peroxidase
MASRAALLALLLSAFAAASAVAQLDEKFYSQSCPSVEDVVRKEMVRALSVAPSLAGPLLRMHFHDCFVRGCDGSVLLDSTANNTAEKDAKPNLTLRGFSFIETVKAAVEKACPDTVSCADLLALMARDAVWLSKGPFWAVPLGRRDGRVSIANETKQLPPPTGNFTKLTQLFGAKNLDTKDLVVLSAGHTIGTSHCFSFSDRLYNFTGLDNARDIDPTLDLAYMARLRGKCTSLDDNTTLVEMDPGSFKTFDLSYFANVAKRRGLFHSDGALLTDPTTRAYVLRHATGNYKEEFFADFAASMLKMGAVDVLTGSQGEIRKKCSVVN

SEQ ID NO: 19524 - DNA, 1497 bp, Sorghum bicolor
  misc_feature: Ceres ANNOT ID no. 8733426
  misc_feature: Encodes the peptide sequence at SEQ ID NO 19525
atggcttcagcaaagcagagcaagaagttgcgcatacttctgatcccattcttcgccacaagccacatcggcccctacaccgacctcgccgtccgtctcgcagcggccaggcctggctccgtcgagccctccatcgccgtgaccccggctaacgtcacggtggttcggtccgccctcgagcggcacggccctgcggcgagcggcgtcgtcaagatcgtcacctacccgttcccgtgcgtggacggcctcgctccgggcgtcgagaacctctccactgccggagacgacgcgtggcgcatcgacgccgccgccatcgatgagtccctgtcgcggccggcacaggaggcgctcctccgggagcaggtccccgacgccgtcgtcacggacttccacttcttctggaacagcagcatcgccgccgaactcggcttgccgagcgtcgttttcaatgtcatcggccccttcgcggggctcgtcatgaagctcctcagcggcgccgtcgtcagtggcggcggcactgactctgagtcccatgaggttgccgttcccgggttgccggggccggagatacggatccccgtcagcgagctgccggagttcttgagatgcccagcgaacgtccaaggcacgttcaatccttgcatcgcggcgatggccaggtgcttgggcgtcgccttcaacacgttcgcagacttggagcaggagtacggcgaggcgcgcgtgcgcgtcggatctttgaagcgcggctacttcgtcggcccggtctcactgccattgccaccggccgccgcaagcatcagcgagtctccctgcatcaggtggctcgactccaagccgagctgctcggtggtgtacgtgtgcttcggcacctacgccgccatctcgggcgatcagctccgggagctggcgctcggcctggaagcctcagggacgccgttcctgtgggcggtgagggccgacggatgggcgccgccggagggctgggaggagcgcgtcggggagagggggatgctggtgagagggtgggcgccgcagacggcgatactggcccatccagcggtgggcgcgttcctgacgcactgcgggtccagctcgctgctggaggcggcggcggccggcgtgccgatgctgacgtggccgctggtgttcgaccagttcatcgaggagcggctggtgacggaggtcctcaagatcggggagcgagtctggagcggggcgcggagcacgaggtacgaggagagggagctcgtgccggcggaggccgtggctcgggcggtgggaaggttcttggaggcaggtgggacgggggaggcggcgaggggcagggcgcgggatctcgccgtgaaggcccacgccgccgtagaggaaggcggctcgtcgtcccgtgatctgcaccgcctcatcgacgacttgatcgaagccagagcggctgccggcgtggcaaccttgccgtcagctgcacccgtggaaacgagcaccgatgctgacggcgagtag

SEQ ID NO: 19525 - protein, 498 aa, Sorghum bicolor
  misc_feature: Useful for making plants with altered carbohydrate content
  misc_feature: Functional homolog of the protein sequence given in SEQ ID NO 14714
  misc_feature: Ceres ANNOT ID no. 8733426
  misc_feature (9)..(471): SWISSPROT Homolog: EC 2.4.1.238 Anthocyanin 3'-O-beta-glucosyltransferase
  misc_feature (24)..(475): Pfam ID: UDPGT Pfam Description: UDP-glucoronosyl and UDP-glucosyl transferase
MASAKQSKKLRILLIPFFATSHIGPYTDLAVRLAAARPGSVEPSIAVTPANVTVVRSALERHGPAASGVVKIVTYPFPCVDGLAPGVENLSTAGDDAWRIDAAAIDESLSRPAQEALLREQVPDAVVTDFHFFWNSSIAAELGLPSVVFNVIGPFAGLVMKLLSGAVVSGGGTDSESHEVAVPGLPGPEIRIPVSELPEFLRCPANVQGTFNPCIAAMARCLGVAFNTFADLEQEYGEARVRVGSLKRGYFVGPVSLPLPPAAASISESPCIRWLDSKPSCSVVYVCFGTYAAISGDQLRELALGLEASGTPFLWAVRADGWAPPEGWEERVGERGMLVRGWAPQTAILAHPAVGAFLTHCGSSSLLEAAAAGVPMLTWPLVFDQFIEERLVTEVLKIGERVWSGARSTRYEERELVPAEAVARAVGRFLEAGGTGEAARGRARDLAVKAHAAVEEGGSSSRDLHRLIDDLIEARAAAGVATLPSAAPVETSTDADGE

SEQ ID NO: 19526 - DNA, 1608 bp, Sorghum bicolor
  misc_feature: Ceres ANNOT ID no. 8733415
  misc_feature: Encodes the peptide sequence at SEQ ID NO 19527
atgggtgaaaacagactcctacttctcatgcgaaagatcagggtgtgggatcggcacgagggtgctcgcccactctcgcgtcgatccggaaattccatggggctgttgagctccgctaacagatgttgttgcaagaacatcctgagctgcaacctactcagatgtgcgtgctgctgctcgtggatccgctctgtctgcggcaggagaacgagcaaggccacacaagaggcatcggagacgaagatgaaaaagaagaggggcttttgtggtggggctgagcgagaagcagaggaaccgttgacattggaggcaaagaagaagaggaagaatacggcgatgatccccgagcaagaaaagtgcaagtggacaaagaagatatggaggaaaaagaagaggaagaatgaacagaacgggttagcaaccctagtcaaggaaatttcgctctcaaacagtcacaaggacagggcagcggcaggggagatactacggatcggcaaccataacattcctagtagggtgtttacattccgtgaactggtcgatgccactgattctttcagcccagaaaacatgctgggtgaaggcggctttggaagggtgtacaaaggatgcattccagacactatggaagtcatagcagttaagcagcttgacaaagatgggttgcaaggaaaccgtgagttcctcgtcgaggtgctgatgcttagcctactgcatcatcccaacctagttaccttggttggatacagcaccgattgtgaccagaggatactagtgtatgagtacatgccacttggttcattgcaagatcatctcctcgatctcactccaaattctcagccactatcctggcacacacggatgaagattgcagttggtgcagctaaaggcattgagtacttgcatgaggtagccaacccgccagtgatctaccgtgatctcaaggcatccaacattctcttggatggaagcttcaatgcaaagttatcagactttggtctggcaaagcttggtccaagcggtgacaaaacccatgtcagcacaagggtgatgggcacatatggctattgtgctcctgagtatgccatgactggcaagctaacaaagacatctgacatctatagctttggcgtagttctgttagagctcatcactgggaggcgagcaatcgacaccacaaaaccaactcgcgagcagattcttgttcattgggcagcaccattcttcagggataagaggaagtttgtgaagatggccgacccattgcttgacaggaagtttcctctgaaaggtctataccaggcacttgcaatctcatcaatgtgcttacaagaagaagcaagcagtcggccactgatcagtgatgttgtgaccgcccttacatttcttgctgatccaaactatgatcctccagatgacatcaaagatcctctgcccataacagttccaaacatagacatagaaactaatcaaaacgaaactgaaggaggtaaagaacaattacagcaaaatgaagaagatagccatgagagaaaaaatgaagaagatagccatgagagaaaaagtgaagaagatagccctgagagaaaaaatgaagaagatagctga

SEQ ID NO: 19527 - protein, 535 aa, Sorghum bicolor
  misc_feature: Useful for making plants with modulated drought sensitivity
  misc_feature: Functional homolog of the protein sequence given in SEQ ID NO 14078
  misc_feature: Ceres ANNOT ID no. 8733415
  misc_feature (134)..(527): SWISSPROT Homolog: EC 2.7.11.1 Non-specific serine/threonine protein kinase
  misc_feature (186)..(460): Pfam ID: Pkinase Pfam Description: Protein kinase domain
MGENRLLLLMRKIRVWDRHEGARPLSRRSGNSMGLLSSANRCCCKNILSCNLLRCACCCSWIRSVCGRRTSKATQEASETKMKKKRGFCGGAEREAEEPLTLEAKKKRKNTAMIPEQEKCKWTKKIWRKKKRKNEQNGLATLVKEISLSNSHKDRAAAGEILRIGNHNIPSRVFTFRELVDATDSFSPENMLGEGGFGRVYKGCIPDTMEVIAVKQLDKDGLQGNREFLVEVLMLSLLHHPNLVTLVGYSTDCDQRILVYEYMPLGSLQDHLLDLTPNSQPLSWHTRMKIAVGAAKGIEYLHEVANPPVIYRDLKASNILLDGSFNAKLSDFGLAKLGPSGDKTHVSTRVMGTYGYCAPEYAMTGKLTKTSDIYSFGVVLLELITGRRAIDTTKPTREQILVHWAAPFFRDKRKFVKMADPLLDRKFPLKGLYQALAISSMCLQEEASSRPLISDVVTALTFLADPNYDPPDDIKDPLPITVPNIDIETNQNETEGGKEQLQQNEEDSHERKNEEDSHERKSEEDSPERKNEEDS

SEQ ID NO: 19528 - DNA, 1446 bp, Sorghum bicolor
  misc_feature: Ceres ANNOT ID no. 8733429
  misc_feature: Encodes the peptide sequence at SEQ ID NO 19529
atggccgcgcccgagtccagcaagaagctgcgcatccttctcatgcccttcttcgccaccagtcatatcggcccgttcaccgacctcgccgtccgccttgccacagccagcccggacgccgtcgagctcactctggctgtcactccggcgaacgtccacgtggttcgctcggccctcgggcggcacggcgccgaggcgagcgccgtggtcaagatcaccacctacccgttcccgcgcgtggacggcctcgccccgggcgtggagaacctctcggtcgccggagacgacgggtggcgcattgacgccgtcgccgtcgacgaggccctgacgcgaccggtgcaggaggcgctcatcagggaacagtcccctgacgctgtcatcaccgacatccacttcgtcatctggaacagcgccgtggccggcgaactcggcgtgccgtgcgtcacgttcagcgtcgttggcatcttctcgacgctcgtcatgtaccacctcggccgtgccgccgccgccggcgtcgtcgtcagagatggccaggaggtgatcgtcccagagttcccggggccggagatacgggtccccgtatccgagttgccggagttcctgagacgcccaccggagcacgacgtgatcagccagtgccatgtggcgatgggcaggtgcttcggcgtcgccatcaactcgttcgtggatctggagcagccatactgcgacatgtgcgtgcgcagcggatacctcaagcgcgcctacttcgtcggccccctctcgctgccgttaccaccggccggagcaagcggcggcgactcgccgtgcgtcgcgtggctcggcaccaagccgagattttcggtggtgtacgtatgcttcggcaccttcgctgccatctcggaggagcagctccgggagctggcgcttgggctagaagcctctgggaagccattcctgtgggtggtgagggccggcggctggacgccgccggagggctgggaggagcgcgtcggtgagagggggatgctggtgagagggtgggcgccgcagacggcgatactggcccatccagcggtgggcgcgttcctgacgcactgtgggtccagctcgctgctggaggcggcggcggccggcgtgccgatgctgacgtggccgctggtgttcgaccagttcgtcgaggagaggctggtgacggaggtcctcaagatcggggagagggtgtggagcgggccgcggagcacgagatacgaggagcagacgctcgtgccagcagaggcggtggcgcgagcggtggcaaggttcttggagccgggcggcaccggcgaggcggcgaggagcagggcgggggtgctcgccgccaaggcacgctcggctgtggcggagggcggctcgtcattttgtgatctgcgccgtctcgtcgatgatctgatcgaagcaagaacggctgccggaacccctgcctga

SEQ ID NO: 19529 - protein, 481 aa, Sorghum bicolor
  misc_feature: Useful for making plants with altered carbohydrate content
  misc_feature: Functional homolog of the protein sequence given in SEQ ID NO 14714
  misc_feature: Ceres ANNOT ID no. 8733429
  misc_feature (220)..(470): SWISSPROT Homolog: EC 2.4.1.238 Anthocyanin 3'-O-beta-glucosyltransferase
  misc_feature (24)..(474): Pfam ID: UDPGT Pfam Description: UDP-glucoronosyl and UDP-glucosyl transferase
MAAPESSKKLRILLMPFFATSHIGPFTDLAVRLATASPDAVELTLAVTPANVHVVRSALGRHGAEASAVVKITTYPFPRVDGLAPGVENLSVAGDDGWRIDAVAVDEALTRPVQEALIREQSPDAVITDIHFVIWNSAVAGELGVPCVTFSVVGIFSTLVMYHLGRAAAAGVVVRDGQEVIVPEFPGPEIRVPVSELPEFLRRPPEHDVISQCHVAMGRCFGVAINSFVDLEQPYCDMCVRSGYLKRAYFVGPLSLPLPPAGASGGDSPCVAWLGTKPRFSVVYVCFGTFAAISEEQLRELALGLEASGKPFLWVVRAGGWTPPEGWEERVGERGMLVRGWAPQTAILAHPAVGAFLTHCGSSSLLEAAAAGVPMLTWPLVFDQFVEERLVTEVLKIGERVWSGPRSTRYEEQTLVPAEAVARAVARFLEPGGTGEAARSRAGVLAAKARSAVAEGGSSFCDLRRLVDDLIEARTAAGTPA

SEQ ID NO: 19530 - DNA, 690 bp, Sorghum bicolor
  misc_feature: Ceres ANNOT ID no. 8733439
  misc_feature: Encodes the peptide sequence at SEQ ID NO 19531
atgctgatgcatggcgatttgcacgatggacgacgacaggggcgggagagcgccgacggcgaccaccagcttcaacttcaacgcgttgctccagctccacggcgacgctggccgccacttcttgctcggtcagcatctccacgccttagagcaaaaggctttcaagtcccccctacttcttgcctagcagcagctagggtttcttctcacgcctcgatgggcctctgtcctctggtgcagtcccataaggaacctgaacaagacgcttgctcctcggcgacgagaagtgttcccagctcgcctgcgccggcgaagaagaagccccgagtcgcgacgccgtctccgttgccgaccttcaaggtgaggaaagagaagctcggggacagaatcactgctctccagcaactagtctcgccttttggaaagacggatactgcatcagttcttcacgaggccatcgaatacatcaggttcctgcacgatcaagtagcttccctgagctctccctacctgaggtgtggacggcctgtgcagcagctacagcaacaacaggacggcggcgaggcgaaggaggacctgcgaagtcgagggctgtgccttgtcccggtggcgagcactacttacgcagtggctactagcgaaacggcgccggagttctggccccctacctttgggggcacattacagtag

SEQ ID NO: 19531 - protein, 229 aa, Sorghum bicolor
  misc_feature: Useful for making plants with modulated flowering time
  misc_feature: Functional homolog of the protein sequence given in SEQ ID NO 13101
  misc_feature: Useful for making plants with altered lignin content
  misc_feature: Useful for making plants with modulated nitrogen use efficiency
  misc_feature: Functional homolog of the protein sequence given in SEQ ID NO 13645
  misc_feature: Useful for making plants with modulated heat sensitivity
  misc_feature: Functional homolog of the protein sequence given in SEQ ID NO 12956
  misc_feature: Ceres ANNOT ID no. 8733439
MLMHGDLHDGRRQGRESADGDHQLQLQRVAPAPRRRWPPLLARSASPRLRAKGFQVPPTSCLAAARVSSHASMGLCPLVQSHKEPEQDACSSATRSVPSSPAPAKKKPRVATPSPLPTFKVRKEKLGDRITALQQLVSPFGKTDTASVLHEAIEYIRFLHDQVASLSSPYLRCGRPVQQLQQQQDGGEAKEDLRSRGLCLVPVASTTYAVATSETAPEFWPPTFGGTLQ

SEQ ID NO: 19532 - DNA, 804 bp, Sorghum bicolor
  misc_feature: Ceres ANNOT ID no. 8733511
  misc_feature: Encodes the peptide sequence at SEQ ID NO 19533
atggccgaggaggccaagtacctggagacggcgcgggccgaccgctccgtgtggctcatgaagtgccccccggtcgtctcccgcgcctggcaggccgcctccgcctcttcctccgatcccaacaacgccaaccccgtcgtcgccaaggtcgtcctttccctcgacctactccgcccagaagagccccccgaggatcgccccgaagagccaacgctccagttcaagatggagttggctcaaactaacactggaaatacacctaagagctactctttgaatatgttcaaagatttcgtgcctatgtgtgttttctccgaatctaaccaagggaaactttcatgcgaaggaaaagtcgagcataaatttgacatggaacctcacagtgataatttggcgaactatgggaagttgtgccgtgaaagaacacagaagtacatggttaaatctagacaagtgcaggtacttgacaatgaccacggaatgagcatgaggccaatgcctggcttggttggtctcataccttctggttcaaaggaaaagaagaagcaagcaccagcgaaaccatctgatgtcaaaagaactcgcagggatcgcacagagatggaaaacattatattcaagctttttgaaaggcaacccaattgggccctaaaggcactagtgcaagaaactgaccagccagagcaattcctgaaggagatattgaacgatctttgtgtgtataataaacgaggaccaaaccaaggaacacatgagctcaagccggagtacaagaaatccacaggggatgctgatgctgcttga

SEQ ID NO: 19533 - protein, 267 aa, Sorghum bicolor
  misc_feature: Useful for making plants with altered lignin content
  misc_feature: Functional homolog of the protein sequence given in SEQ ID NO 14715
  misc_feature: Ceres ANNOT ID no. 8733511
  misc_feature (5)..(267): Pfam ID: TFIIF_beta Pfam Description: Transcription initiation factor IIF, beta subunit
MAEEAKYLETARADRSVWLMKCPPVVSRAWQAASASSSDPNNANPVVAKVVLSLDLLRPEEPPEDRPEEPTLQFKMELAQTNTGNTPKSYSLNMFKDFVPMCVFSESNQGKLSCEGKVEHKFDMEPHSDNLANYGKLCRERTQKYMVKSRQVQVLDNDHGMSMRPMPGLVGLIPSGSKEKKKQAPAKPSDVKRTRRDRTEMENIIFKLFERQPNWALKALVQETDQPEQFLKEILNDLCVYNKRGPNQGTHELKPEYKKSTGDADAA

SEQ ID NO: 19534 - DNA, 1521 bp, Sorghum bicolor
  misc_feature: Ceres ANNOT ID no. 8733565
  misc_feature: Encodes the peptide sequence at SEQ ID NO 19535
atggccgccaccccgccgtcgtcgcgggacccgtcgccgcagccccggcggccggcctcctccgcggggcccgccaccaccaagcgcgggggcctcctgctcggccgctacgagctgggccgcctgctcggccacggcaccttcgccaaggtctaccacgcccgccacgccgacaccggcgagaccgtcgccatcaaggtgctcgacaaggagaaggccctccgcaacggcctcgtcccgcacatcaagcgcgagatcgccatcctccgccgcgtgcgccacccaaacatcgtccgcctcttcgaggtcatggccaccaagtccaagatctacttcgtcatggagttcgtccgcggcggggagctcttcgcgcgcgtcgccaagggccgcctcaaggaggacaccgcgcggaggtacttccagcagctcatctccgccgtcggcttctgccacgcccggggcgtcttccaccgggacctcaagcccgagaacctcctcgtcgaccagcgcggcgacctcaaggtctccgatttcggcctctcggcggtcgctgatcagttccaccctgatggcctcctccacacattctgtggcacgccctcctacgtcgccccggaggtgctcgcgcgccgcggctatgacggcgccaaggcggacatatggtcctgcggtgtcatcctgttcgtgctcatggctggctaccttcctttccatgaccagaacctcatggcgatgtaccgtaagatttacaggggggaattccggtgtccgagatggttttccaaggaccttagcagtctattgaatcggcttcttgacacgaacccagagaccaggatcaccgtggctcagataatggagagcaggtggtttcagaaagggttccgaccggtcaggttctacgtcgaggatgatcaagtccacagcttggaagacagtgagaatgaggtgccggaactggggcctagtgagcctccacctccacctcccctgccgccgccaccacagaaagaggacgacggtgatgattctggttgggaatcagactcgtctgtagcatcctgcccagccacattgtcatcagaggagaggagacggcctgttggatctctcccacggccggtaagtctaaatgcgtttgatatcatatcgttctcaaggggattcaatttgtcggggttgtttgaggagcgaggcagtgaagtgagatttgtctcagcacatcccatgcaaacgattgtaacaaaattggaggagattgcgaaggtgaagagctttgcagttcgacggaaggactggcgggtgagcctggaaggcacgagagaaagtgaaaagggtccattgacaattggggctgaagtatttgagctcacaccaagccttgtggtggtggaggtgaggatgaaagcaggggacagggaagaatatgaggatttttgtgagaaggagttgaaacctgggatgcagcacctcgtgcaccatacagcctcggttccagatataccttctgacactgagtag

SEQ ID NO: 19535 - protein, 506 aa, Sorghum bicolor
  misc_feature: Useful for making plants with modulated biomass
  misc_feature: Functional homolog of the protein sequence given in SEQ ID NO 14256
  misc_feature: Useful for making plants with modulated salt sensitivity
  misc_feature: Functional homolog of the protein sequence given in SEQ ID NO 14255
  misc_feature: Ceres ANNOT ID no. 8733565
  misc_feature (48)..(309): SWISSPROT Homolog: EC 2.7.11.1 Non-specific serine/threonine protein kinase
  misc_feature (37)..(291): Pfam ID: Pkinase Pfam Description: Protein kinase domain
  misc_feature (373)..(430): Pfam ID: NAF Pfam Description: NAF domain
MAATPPSSRDPSPQPRRPASSAGPATTKRGGLLLGRYELGRLLGHGTFAKVYHARHADTGETVAIKVLDKEKALRNGLVPHIKREIAILRRVRHPNIVRLFEVMATKSKIYFVMEFVRGGELFARVAKGRLKEDTARRYFQQLISAVGFCHARGVFHRDLKPENLLVDQRGDLKVSDFGLSAVADQFHPDGLLHTFCGTPSYVAPEVLARRGYDGAKADIWSCGVILFVLMAGYLPFHDQNLMAMYRKIYRGEFRCPRWFSKDLSSLLNRLLDTNPETRITVAQIMESRWFQKGFRPVRFYVEDDQVHSLEDSENEVPELGPSEPPPPPPLPPPPQKEDDGDDSGWESDSSVASCPATLSSEERRRPVGSLPRPVSLNAFDIISFSRGFNLSGLFEERGSEVRFVSAHPMQTIVTKLEEIAKVKSFAVRRKDWRVSLEGTRESEKGPLTIGAEVFELTPSLVVVEVRMKAGDREEYEDFCEKELKPGMQHLVHHTASVPDIPSDTE

SEQ ID NO: 19536 - DNA, 1005 bp, Sorghum bicolor
  misc_feature: Ceres ANNOT ID no. 8733572
  misc_feature: Encodes the peptide sequence at SEQ ID NO 19537
atggtcgtcctcgcgaagccaccgccggcgctcgaccaaatctccctgcttcgatgcccgcagcccggggacgcggcgtccttcttcggcgtgccggccgtcgacctgtccagccccggcgcggctctggccgtggtggacgcgtgcgagcggttcggcttcttcaaggtggtgaaccacggcgtgccaacgggcgtcgtggatcggctggaggccgaggccgtcaggttcttcgcgtcgccgcaggcggacaaggacgcgtgcggccccgccaacccgctcgggtacgggaacaagcgcatcggccgcaatggcgacatggggtggctcgagtacctcctcctcgccctcgacggcgcctcctcggtgtccaaggcctcccctgtcccgtcatcctcgctgcgggacgcggtaaaccagtacgtcgccgccgtgcggggactggcgacgtcggtgctggaggcggtggcggaggggctgggcgtggcgccgagggacgcgctgagcggcatggtgacggacgcggcgagcgaccaggtgttccggatcaaccactacccggcgtgcccgctgctgcagcgcctgccggactcgtgcggcgtcaccggcttcggcgagcacacggacccgcagctggtgtccgtgctgcgctccaacggcacggccggcctgcaggtcgcgctccacgacgacggggggcggtgggtgcccgtgccgcccgaccgcgacgccttcttcgtcatcgtcggcgactcgctgcaggtcctgacgaatgggaggctgaaaagtgtgcggcaccgggtggtggccaacagcctgaagccgcgggtgtccatgatctacttcgcgggaccggcgccggcgcagcggatcgcgccattgccgcaggtgctggggcacggcgagcagagcttgtacagggacttcacatggggcgactacaagaaggctgcctaccgatcgcgcctcggagacaaccgcctggaccccttccgcatccagtga

SEQ ID NO: 19537 - protein, 334 aa, Sorghum bicolor
  misc_feature: The sequence is a functional homolog of SEQ ID NO 4 in US patent 7154028
  misc_feature: The sequence is a functional homolog of SEQ ID NO 2 in US patent 7262340
  misc_feature: Ceres ANNOT ID no. 8733572
  misc_feature (1)..(332): SWISSPROT Homolog: EC 1.14.11.13 Gibberellin 2-beta-dioxygenase
  misc_feature (177)..(285): Pfam ID: 2OG-FeII_Oxy Pfam Description: 2OG-Fe(II) oxygenase superfamily
MVVLAKPPPALDQISLLRCPQPGDAASFFGVPAVDLSSPGAALAVVDACERFGFFKVVNHGVPTGVVDRLEAEAVRFFASPQADKDACGPANPLGYGNKRIGRNGDMGWLEYLLLALDGASSVSKASPVPSSSLRDAVNQYVAAVRGLATSVLEAVAEGLGVAPRDALSGMVTDAASDQVFRINHYPACPLLQRLPDSCGVTGFGEHTDPQLVSVLRSNGTAGLQVALHDDGGRWVPVPPDRDAFFVIVGDSLQVLTNGRLKSVRHRVVANSLKPRVSMIYFAGPAPAQRIAPLPQVLGHGEQSLYRDFTWGDYKKAAYRSRLGDNRLDPFRIQ

SEQ ID NO: 19538 - DNA, 663 bp, Sorghum bicolor
  misc_feature: Ceres ANNOT ID no. 8733609
  misc_feature: Encodes the peptide sequence at SEQ ID NO 19539
atggctgccaacggaggcgggtaccgggcggaggacgactacgactacctcttcaaggtggtgctcatcggcgactccggcgtcggcaagtccaacctcctctcccgcttcaccaagaacgagttcagcctcgagtccaagtccaccatcggcgtcgagttcgccacccgcagtctccaggtcgacggcaaggtcatcaaggcccagatttgggacaccgccggccaggagaggtaccgcgctattacaagtgcctattaccgaggagctgtaggggcattacttgtctacgatgtcacccgccgtgctacattcgacaacgtgggccgttggctaagggagctcagagaccacactgatcagagcatcgttgtgatgctgattggcaacaagtccgatctccgccacttggtggccgtctcaaccgatgacgcgaaggagtatgctgaggccgagtccatgtacttcatggaaacgtctgccctcgacgccaccaatgtggacaacgcgttctcagaggtgctgacccagatataccagatcgtgagcaagaagacagtggaagccctggaggaaggcgcggctggcccaggcaaaggggagaagataaacgtgaaggatgacgtgtctgcgatgaagagagttgggtgctgctcaaactga

SEQ ID NO: 19539 - protein, 220 aa, Sorghum bicolor
  misc_feature: Useful for making plants with altered lignin content
  misc_feature: Functional homolog of the protein sequence given in SEQ ID NO 13076
  misc_feature: Useful for making plants with altered terpenoid content
  misc_feature: Functional homolog of the protein sequence given in SEQ ID NO 13157
  misc_feature: Useful for making plants with altered alkaloid content
  misc_feature: Functional homolog of the protein sequence given in SEQ ID NO 13220
  misc_feature: Ceres ANNOT ID no. 8733609
  misc_feature (19)..(134): SWISSPROT Homolog: EC 2.7.11.1 Non-specific serine/threonine protein kinase
  misc_feature (19)..(180): Pfam ID: Ras Pfam Description: Ras family
  misc_feature (19)..(133): Pfam ID: Miro Pfam Description: Miro-like protein
MAANGGGYRAEDDYDYLFKVVLIGDSGVGKSNLLSRFTKNEFSLESKSTIGVEFATRSLQVDGKVIKAQIWDTAGQERYRAITSAYYRGAVGALLVYDVTRRATFDNVGRWLRELRDHTDQSIVVMLIGNKSDLRHLVAVSTDDAKEYAEAESMYFMETSALDATNVDNAFSEVLTQIYQIVSKKTVEALEEGAAGPGKGEKINVKDDVSAMKRVGCCSN

SEQ ID NO: 19540 - DNA, 1011 bp, Sorghum bicolor
  misc_feature: Ceres ANNOT ID no. 8733650
  misc_feature: Encodes the peptide sequence at SEQ ID NO 19541
atgctgtttgctgccattttgattttgtgctcattcgacccgccggcctgtgctgccgcgggcgtgcacggcgtctgctacggcgtcgtcggcgacaacctgccgtcgcgggcggacgtggtgcagctctacaagtccagcaacatccacgccatgcgcatctactacccggacccggaggccctcgcggcgctgcgcggcagcggcatcggcctcatcctcgacgtgggcggcgtggacgacgtccgcggcctcgccagcagcgcctccgccgcggccgcctgggtccacgccaacgtcgtggcgcactacccggacgtcctcatccggtacatcgccgtcggcaacgaggtccccgccggcgacgcggggctcatcctcctcccggccatgcggaacgtgcgcgccgccgtcgcgtctgcggggctcgcgggcgccatcaaggtgtccacggcggtccggatggacgtggtcaccgactccttcccgccgtcgcgcggcgtcttcagccccagcgtgcagcggcacatggtgcccgtcgcgcggttcctggccgacgccgggtcgcccctgctcgccaacgtctacccttacttcgcctacagggacaacccgcgcgacatcacactcggctacgcgacgttccagccgggcacggccgtgacggacgacggcagcgggctcacctacacgaacatcttcgccgccatggtggacgccatccacgccgcgcttgagaaggccggggcgccgggcgtcaggatcgtcgtgtcggagagcgggtggccgtcggccggcgggttcgcggcgaccgtggagaatgcgcggaggtacaaccagggtctgatcgaccatgcctaccgcggcacgcccaagagacccggagcgctggagacgtatgtgtttgccatgttcaacgagaaccagaagcccggggatccgacggagaggaactttgggctcttctaccccaacaaggagcctgtctactcgattagctttcccaattaa

SEQ ID NO: 19541 - protein, 336 aa, Sorghum bicolor
  misc_feature: Useful for making plants with altered carbohydrate content
  misc_feature: Functional homolog of the protein sequence given in SEQ ID NO 14490
  misc_feature: Useful for making plants with altered cell wall content and/or composition
  misc_feature: Functional homolog of the protein sequence given in SEQ ID NO 14489
  misc_feature: Ceres ANNOT ID no. 8733650
  misc_feature (22)..(336): SWISSPROT Homolog: EC 3.2.1.39 Glucan endo-1,3-beta-D-glucosidase
  misc_feature (23)..(334): Pfam ID: Glyco_hydro_17 Pfam Description: Glycosyl hydrolases family 17
MLFAAILILCSFDPPACAAAGVHGVCYGVVGDNLPSRADVVQLYKSSNIHAMRIYYPDPEALAALRGSGIGLILDVGGVDDVRGLASSASAAAAWVHANVVAHYPDVLIRYIAVGNEVPAGDAGLILLPAMRNVRAAVASAGLAGAIKVSTAVRMDVVTDSFPPSRGVFSPSVQRHMVPVARFLADAGSPLLANVYPYFAYRDNPRDITLGYATFQPGTAVTDDGSGLTYTNIFAAMVDAIHAALEKAGAPGVRIVVSESGWPSAGGFAATVENARRYNQGLIDHAYRGTPKRPGALETYVFAMFNENQKPGDPTERNFGLFYPNKEPVYSISFPN

SEQ ID NO: 19542 - DNA, 1101 bp, Sorghum bicolor
  misc_feature: Ceres ANNOT ID no. 8733628
  misc_feature: Encodes the peptide sequence at SEQ ID NO 19543
atggggcggtgcgcgtgcgcgtggcaaatggtcgtcgtgggtgccttggccgtgctcgtcgcggcggcgacgacggcgcgggcggcgccgcaggtgccgtgctacttcatcttcggggactcgctcgtggacaacggcaacaacaacttcatcgtgtccatggcaagggccaactacccgccctacgggatcgacttcgccggcggccctaccggccgcttcagcaacggcctcaccaccgtcgatgccatcgctaagctcctgggcttcgacgacttcgtgcccccgttctccggcgcaagcagccagcagctcctccgcggcgccaacttcgcctccgccgccgccgggatccgggaggagacgggccagcagctgggtgggcggatcagcttcagcgggcaggtgcagaactaccagtcggcggtgcaggaggtgatcagcatcctgggcgacgagggctcggcggcgacgcacctgagccggtgcatcttcacggtggggatgggcagcaacgactacctcaacaactacttcatgccggccttctacagcacgggcagccagtacacgccggagcagtacgcggagtccctggccgacgactactcccgtctcctgcaggtgatgtaccggtacggcgcccggaaggtggcgctgatcggcgtcgggcaggtcgggtgcagccccaacgagctggcgcagcgcagcgccaacggcgtcacctgcgtcgagcagatcaacgccgccgtccggatgttcaaccggcggctcgtcggacttgtggacaggttcaacaagctccccggcgcgcacttcacctacatcaacatctacggcatcttcgacgacatcctcaggtcacccggcgcccacgggctgaaggtgaccaacgcggggtgctgcggcgtgggcaggaacaacgggcaggtgacgtgcctgccgttccagatgccctgcgccaacaggcacgagtacctcttctgggacgccttccacccgacggaggcggccaacgtcctcgtcgcccagaggacctacagcgccaagctcgcctccgacgtgcacccggtcgacctccggacgctcgcacgcctctag

SEQ ID NO: 19543 - protein, 366 aa, Sorghum bicolor
  misc_feature: Useful for making plants with modulated phosphate use efficiency
  misc_feature: Functional homolog of the protein sequence given in SEQ ID NO 14406
  misc_feature: Ceres ANNOT ID no. 8733628
  misc_feature (33)..(305): SWISSPROT Homolog: EC 3.2.1.51 Alpha-L-fucosidase
  misc_feature (35)..(346): Pfam ID: Lipase_GDSL Pfam Description: GDSL-like Lipase/Acylhydrolase
MGRCACAWQMVVVGALAVLVAAATTARAAPQVPCYFIFGDSLVDNGNNNFIVSMARANYPPYGIDFAGGPTGRFSNGLTTVDAIAKLLGFDDFVPPFSGASSQQLLRGANFASAAAGIREETGQQLGGRISFSGQVQNYQSAVQEVISILGDEGSAATHLSRCIFTVGMGSNDYLNNYFMPAFYSTGSQYTPEQYAESLADDYSRLLQVMYRYGARKVALIGVGQVGCSPNELAQRSANGVTCVEQINAAVRMFNRRLVGLVDRFNKLPGAHFTYINIYGIFDDILRSPGAHGLKVTNAGCCGVGRNNGQVTCLPFQMPCANRHEYLFWDAFHPTEAANVLVAQRTYSAKLASDVHPVDLRTLARL

SEQ ID NO: 19544 - DNA, 2742 bp, Sorghum bicolor
  misc_feature: Ceres ANNOT ID no. 8733653
  misc_feature: Encodes the peptide sequence at SEQ ID NO 19545
atgaatccggacaacttcacccacaagacgaacgaggcgctggtggcggcgcacgagatggcgtcggaggccggccacgcgcagctcacgccgctgcatctggccgcggcgctggcggcggacaagggcggcatcctgcggcaggccatcacgggggcgtcggggggcgacggagcggccggggagtcgttcgagcgcgtgctgagcaacgcgctcaagaagctgccgtcgcagtccccgccgccggactccgtcccggcgtccacggcgctgatcaaggtcatccgccgcgcgcagtccgcgcagaagaagcgcggggactcgcacctcgccgtcgaccagctgctgctcggcctggtcgaggactcgcagatctccgactgcctcaaggaggccggcgtgtccgcggcgcgggtgcgcgccgagctcgagaagctccgcggcggcgaggggcgccgcgtggagtccgcgtccggcgacaccaacttccaggcgctcaagacgtacggccgcgacctcgtcgagcaggccgggaagctggaccccgtcatcggccgcgacgaggagatccgccgcgtggtgcgcatcctctcgcgccgcaccaagaacaaccccgtcctcatcggtgagcccggcgtcggcaagacggccgtcgtggaggggctcgcgcagcgcatcgttcgcggcgacgtgcccagcaacctcctcgacgtgcgcctcatcgcgctcgacatgggcgcgctcgtcgcgggcgccaagtaccgcggcgagttcgaggagcggctcaagtccgtgctcaaggaggtggaggaggccgaggggaaggtcattctcttcatcgacgagatacacctcgtcctgggcgcgggcaggacggagggttccatggacgcggccaacctgttcaagccgatgcttgcgaggggacagctccggtgcatcggcgccaccacgctggaggagtaccgcaagtacgtggagaaggacgcggcgttcgagcggcggttccagcaggtgttcgtcgcagagccgagcgtgcccgacaccatcagcattctcagggggctcaaggagaagtacgagggccaccatggtgtcaggatccaggaccgcgccctcgtcgtcgccgcgcagctctccgcgaggtacatcatgggtcggcacctgcctgataaagccattgacttggtggacgaggcctgcgccaatgtgagggtgcagctcgacagccagccggaggagattgataacctggagaggaagagaattcagcttgaagtcgagctccacgcgctcgagaaggagaaggacaaggccagcaaagcccgcctggttgaggtcaagaaggaattggacgatctgagagacaagctgcagcccctgaccatgaagtacaggaaggagaaggagaggatcgatgagatcaggaagctgaagcagcgccgcgaggagctgcagttcagcctgcaggaggccgagcgccggatggacctggctcgtgtggccgacctcaagtacggcgcccttcaggagatcgacgccgcgatctccaagctggagagcgaaactggggagaacctgatgctcactgaaaccgtcggccctgaacaaattgcagaggtggtgagccggtggacgggtattccggtgacccggcttggccagaacgacaaggagaggctggtcggcctggctgacaggcttcaccagagggtggtcggccagacggaggccgtgaacgccgtcgcggaggcggtgctgaggtcaagggccggtcttggcaggccacagcaacccaccggctccttcctcttcctgggtccgaccggtgtaggcaagaccgagctggccaaggctcttgccgagcagctgttcgacgacgagaacctgcttgtccgcatcgacatgtccgagtacatggagcagcactcggttgctcgcctcatcggagcaccacctggctacgtcggccatgaggagggtggacagctgactgaacaggtgaggaggaggccgtacagcgtgatcctcttcgacgaggtggagaaggcccatgtcgccgtgttcaacaccctgcttcaggtcctcgacgacggcaggctgacggacgggcaaggcaggacggtggacttcaggaacaccgtgatcatcatgacatccaacctcggcgccgagcacctcctcgccgggatggtgggcaagaactccatgaaggtcgctcgcgatctggtcatgcaggaggtgaggaggcacttccgccctgagctgctgaaccggctcgacgagatcgtgatcttcgaccctctgtcccacgagcagctgaggaaggtggctcgccttcagatgaaggacgtggccgtccgccttgccgagaggggcatcgctctggccgtcaccgacgccgcactggacatcatcttgtctctctcttacgatccggtgtacggcgcgcggccgatcaggaggtggatcgagaagagggtggtgacgcagctgtcgaagatgctgatccaggaggagatcgacgagaactgcacggtgtacatcgacgccgcgccggccaaggacgagctggcctacagggtggaccggagcggcgggctggtgaacgcggagacggggttgaagtcggacatcctgatccaggtccccaacgacgccgtcaggagcgacgccgcgcaggccgtcaagaagatgaggatcatggaggaggaggacgaggacggcatggacgaggagtga

SEQ ID NO: 19545 - protein, 913 aa, Sorghum bicolor
  misc_feature: Useful for making plants with modulated heat sensitivity
  misc_feature: Functional homolog of the protein sequence given in SEQ ID NO 14451
  misc_feature: Ceres ANNOT ID no. 8733653
  misc_feature (371)..(808): SWISSPROT Homolog: EC 3.4.21.53 Endopeptidase La
  misc_feature (598)..(763): Pfam ID: AAA_2 Pfam Description: ATPase family associated with various cellular activities (AAA)
  misc_feature (98)..(148): Pfam ID: Clp_N Pfam Description: Clp amino terminal domain
  misc_feature (17)..(69): Pfam ID: Clp_N Pfam Description: Clp amino terminal domain
  misc_feature (204)..(398): Pfam ID: AAA Pfam Description: ATPase family associated with various cellular activities (AAA)
MNPDNFTHKTNEALVAAHEMASEAGHAQLTPLHLAAALAADKGGILRQAITGASGGDGAAGESFERVLSNALKKLPSQSPPPDSVPASTALIKVIRRAQSAQKKRGDSHLAVDQLLLGLVEDSQISDCLKEAGVSAARVRAELEKLRGGEGRRVESASGDTNFQALKTYGRDLVEQAGKLDPVIGRDEEIRRVVRILSRRTKNNPVLIGEPGVGKTAVVEGLAQRIVRGDVPSNLLDVRLIALDMGALVAGAKYRGEFEERLKSVLKEVEEAEGKVILFIDEIHLVLGAGRTEGSMDAANLFKPMLARGQLRCIGATTLEEYRKYVEKDAAFERRFQQVFVAEPSVPDTISILRGLKEKYEGHHGVRIQDRALVVAAQLSARYIMGRHLPDKAIDLVDEACANVRVQLDSQPEEIDNLERKRIQLEVELHALEKEKDKASKARLVEVKKELDDLRDKLQPLTMKYRKEKERIDEIRKLKQRREELQFSLQEAERRMDLARVADLKYGALQEIDAAISKLESETGENLMLTETVGPEQIAEVVSRWTGIPVTRLGQNDKERLVGLADRLHQRVVGQTEAVNAVAEAVLRSRAGLGRPQQPTGSFLFLGPTGVGKTELAKALAEQLFDDENLLVRIDMSEYMEQHSVARLIGAPPGYVGHEEGGQLTEQVRRRPYSVILFDEVEKAHVAVFNTLLQVLDDGRLTDGQGRTVDFRNTVIIMTSNLGAEHLLAGMVGKNSMKVARDLVMQEVRRHFRPELLNRLDEIVIFDPLSHEQLRKVARLQMKDVAVRLAERGIALAVTDAALDIILSLSYDPVYGARPIRRWIEKRVVTQLSKMLIQEEIDENCTVYIDAAPAKDELAYRVDRSGGLVNAETGLKSDILIQVPNDAVRSDAAQAVKKMRIMEEEDEDGMDEE

SEQ ID NO: 19546 - DNA, 1239 bp, Sorghum bicolor
  misc_feature: Ceres ANNOT ID no. 8733659
  misc_feature: Encodes the peptide sequence at SEQ ID NO 19547
atggaggtttcggccgagtgcgcgggcggcgggagggtcaggaaggaggccgacctcttcctcgtcgacgacctcctcgacctgccgtgcgacgacgaggaggaggcgcaggaggccgtggtggtgggcgatggggaaggggacggggacgggagtaagcagcagcaggctgctgcgttgttgggcggccgggcttgtggtgccggcggggaggacggtgccggcgccggtaacgcgtcgaacgactcgtcggcggtgacgactgcgctggacagctgcagcaattccctctccgtttccggactcgccgacggggacttctccggcgggctgtgcgagccgtacgaccaactggcggagctggaatggctgtccaactacatgggcgaggacaacttccccacggaggacctcaagaagctgcagctcatcaccggcattccgccggccggcactgccaccgccacggcgccagctcccgctcctgcggtcgtcgccgcacagcaggcacaggcacagccagccggcggcgtgttgccaccggaggcgcccgtcccaggaaaggcgcgcagcaagcggtcgcgcatcgcgccatgcagctgggcctcccgcctgctcgtgctcccgccacctccggcgtcgccaccgtccccggcgtccgcggccatctcgccgtccgagtccggtaccgcggcgcctgcgttcccggccaagaagccgtcgaagcctgcgaagaagaaggaggcgtcgacgccgtcgctgccaaacaacaacgccgccgccgctgcggctgctgctgcgtcggcggcggccgcgggggaagggaggcggtgcctgcactgcgagaccgacaagacgcctcagtggaggacggggccgctgggccccaagacgctgtgcaacgcgtgcggtgtgcggtacaagtcggggcgcctcgtgccggagtaccgtccggcggcgagcccgacgttcgtggtgtccaagcactccaactcccaccggaaggtgctggagctgcgccgccagaaggaggcgcacctgcacccgcacccgcaccaccagtaccagccacagccgccgcaggggccgctcgcccacatcggcggcgccggtggcggggcggccttgatgcacgcgccgaacccgctgatgttcgacgggccggcggggccgctcatcggcgacgacttcttgatccacaaccaccacatagggccggacttccgtcagctcatctag

SEQ ID NO: 19547 - protein, 412 aa, Sorghum bicolor
  misc_feature: The sequence is a functional homolog of SEQ ID NO 1655 in the 10/374,780 US patent application
  misc_feature: Ceres ANNOT ID no. 8733659
  misc_feature (278)..(313): Pfam ID: GATA Pfam Description: GATA zinc finger
MEVSAECAGGGRVRKEADLFLVDDLLDLPCDDEEEAQEAVVVGDGEGDGDGSKQQQAAALLGGRACGAGGEDGAGAGNASNDSSAVTTALDSCSNSLSVSGLADGDFSGGLCEPYDQLAELEWLSNYMGEDNFPTEDLKKLQLITGIPPAGTATATAPAPAPAVVAAQQAQAQPAGGVLPPEAPVPGKARSKRSRIAPCSWASRLLVLPPPPASPPSPASAAISPSESGTAAPAFPAKKPSKPAKKKEASTPSLPNNNAAAAAAAAASAAAAGEGRRCLHCETDKTPQWRTGPLGPKTLCNACGVRYKSGRLVPEYRPAASPTFVVSKHSNSHRKVLELRRQKEAHLHPHPHHQYQPQPPQGPLAHIGGAGGGAALMHAPNPLMFDGPAGPLIGDDFLIHNHHIGPDFRQLI

SEQ ID NO: 19548 - DNA, 1038 bp, Sorghum bicolor
  misc_feature: Ceres ANNOT ID no. 8733680
  misc_feature: Encodes the peptide sequence at SEQ ID NO 19549
atggaggaaagctccggagagagagctccttccactccgcagctgctgaacctcatccgagacgagagagaatggaaggtgatcagagaggcggaagatggagggggctcatcaaccaccagaagccctgatgtcgaggacgattccaagcttgagctgaagctcggcctccctggcgcccaagatgatgagagaatggcgcggcaaggagagaagatggagcaacagcaggagagctgcacggtactctcccttggttctggttgcttcccatcgcattccaagctcgccaccagcactggtgctactaccaccggggcaaagagagggttcttggcaaccgttggtgccaaagcagaaggttgtaagcagaggcaggaggacagggaagggtgtgggaatgagttattaacattgggaggtgaaaacatggcaggtgagaggaagaaagggtgctgtcccccgtcgtcgtcgcatgactcggctgctgggcctgctgtgcacagcagcaacccccacctgacgagaggctctgttcttccagtggttggttggcctccagtacggtccttcaggagaaacctcacaaatgtcagctcatctaagcaatcccctgaccaacaaaacgatgaagcttgtgacaaggcgaaacaaacttgcaagagaagcccacttatcaaaataaacatggacggcatccccattggaaggaaaataaacctctcagcatacaacaactatcagaagctgtcatctgccgtcgaagatttgttttgtggctttcttgaagctgcccaaaaggatttagcctgttctgaaattggagagcaaggagcagaagagaaaatattttcagggttgttggatggaactggtgaatacactttaatttttgaagacagtgaaggaggcaggacactagttggggacctaccatggaatgtatttgtttctactgctaagaggctgagggttatgaaaagctctgaacttcctcatgtcctgattaaaactgcctctgagagggctgataactga

SEQ ID NO: 19549 - protein, 345 aa, Sorghum bicolor
  misc_feature: The sequence is a functional homolog of SEQ ID NO 1757 in the 11/479,226 US patent application
  misc_feature: Ceres ANNOT ID no. 8733680
  misc_feature (52)..(332): Pfam ID: AUX_IAA Pfam Description: AUX/IAA family
MEESSGERAPSTPQLLNLIRDEREWKVIREAEDGGGSSTTRSPDVEDDSKLELKLGLPGAQDDERMARQGEKMEQQQESCTVLSLGSGCFPSHSKLATSTGATTTGAKRGFLATVGAKAEGCKQRQEDREGCGNELLTLGGENMAGERKKGCCPPSSSHDSAAGPAVHSSNPHLTRGSVLPVVGWPPVRSFRRNLTNVSSSKQSPDQQNDEACDKAKQTCKRSPLIKINMDGIPIGRKINLSAYNNYQKLSSAVEDLFCGFLEAAQKDLACSEIGEQGAEEKIFSGLLDGTGEYTLIFEDSEGGRTLVGDLPWNVFVSTAKRLRVMKSSELPHVLIKTASERADN

SEQ ID NO: 19550 - DNA, 783 bp, Sorghum bicolor
  misc_feature: Ceres ANNOT ID no. 8733681
  misc_feature: Encodes the peptide sequence at SEQ ID NO 19551
atgggtcgtgttattcgagcgcagcgcaagggtgcggcggggtcggtgttcaagtcccacacccaccaccgcaagggccccgcccgcttccgcgcgctcgacgtcggcgagcgcagcgggtacctcaagggcgtggtcaccgacatcgtgcacgaccccgggcgcggcgccccgctcgcacgcgtcaccttccgccacccgttccgctacaggcagcagaaggagctgttcctcgccgccgagggcatgtacaccggccagctcatctactgcggccgccgcgccaacctctccatcggcaacgtcctccccgtcggcaccctgcccgagggaaccgtcatctgcaacgtcgagagccgcgtcggcgaccgcggcgccctcgcgcgttgctccggcgactacgccatcgtcatcagccacaacacggacaacgggacgaccagggtgaagctcccgtctggcgccaagaagttgctgcagagcaactgccgagcgatggtcgggcaggtcgccggcggcggcaggacggagaagccgttgctcaaggccggcaacgcctaccacaagttccgcgtgaagaggaactgctggcccagggtgcgcggcgtggccatgaaccccgtggaccatccgcacggaggaggcaaccaccagcacataggccacgcatccaccgtccgtcgggacgctcctcctggagcaaagtcgggccacatcgcggcacggaggactggaagacgcagagggcaagctgctgtggcagccggcaaatcaatgttatga

SEQ ID NO: 19551 - protein, 260 aa, Sorghum bicolor
  misc_feature: Useful for making plants with modulated nitrogen use efficiency
  misc_feature: Functional homolog of the protein sequence given in SEQ ID NO 14286
  misc_feature: Ceres ANNOT ID no. 8733681
  misc_feature (97)..(232): Pfam ID: Ribosomal_L2_C Pfam Description: Ribosomal Proteins L2, C-terminal domain
  misc_feature (11)..(91): Pfam ID: Ribosomal_L2 Pfam Description: Ribosomal Proteins L2, RNA binding domain
MGRVIRAQRKGAAGSVFKSHTHHRKGPARFRALDVGERSGYLKGVVTDIVHDPGRGAPLARVTFRHPFRYRQQKELFLAAEGMYTGQLIYCGRRANLSIGNVLPVGTLPEGTVICNVESRVGDRGALARCSGDYAIVISHNTDNGTTRVKLPSGAKKLLQSNCRAMVGQVAGGGRTEKPLLKAGNAYHKFRVKRNCWPRVRGVAMNPVDHPHGGGNHQHIGHASTVRRDAPPGAKSGHIAARRTGRRRGQAAVAAGKSML

SEQ ID NO: 19552 - DNA, 498 bp, Sorghum bicolor
  misc_feature: Ceres ANNOT ID no. 8733682
  misc_feature: Encodes the peptide sequence at SEQ ID NO 19553
atgtcttggcagacgtacgtggacgagcacctgatgtgcgagatcgagggccaccacctcacgtcggcggccatcgccggccacgacggcgccgtctgggctcagagcgccacattccccgagttcaagcccgaggacatgaccaacatcatgaaggatttcgatgagccggggcacctcgcgccgacaggcctgtttcttggagccacgaagtacatggtcatccaaggtgaacccggcgctgtcattcgtggcaagaagggatcaggaggcatcactgtgaagaagacagggcaggcactcatcattggcatctacgacgagccgatgactcccgggcagtgcaacatggtggtggaaaggctgggcgactacctgggatcaggaggcatcaccgtgatgaagacagggctgggattcatcattggcatctacgaccaaccgatgactgccaggcagtgcaacatgttggtggaaaggctgggcatctacccctga

SEQ ID NO: 19553 - protein, 165 aa, Sorghum bicolor
  misc_feature: Useful for biocontainment applications
  misc_feature: Useful for making plants with modulated biomass
  misc_feature: Functional homolog of the protein sequence given in SEQ ID NO 13035
  misc_feature: Ceres ANNOT ID no. 8733682
  misc_feature (2)..(126): Pfam ID: Profilin Pfam Description: Profilin
MSWQTYVDEHLMCEIEGHHLTSAAIAGHDGAVWAQSATFPEFKPEDMTNIMKDFDEPGHLAPTGLFLGATKYMVIQGEPGAVIRGKKGSGGITVKKTGQALIIGIYDEPMTPGQCNMVVERLGDYLGSGGITVMKTGLGFIIGIYDQPMTARQCNMLVERLGIYP

SEQ ID NO: 19554 - DNA, 1842 bp, Sorghum bicolor
  misc_feature: Ceres ANNOT ID no. 8733704
  misc_feature: Encodes the peptide sequence at SEQ ID NO 19555
atggaggtcgacgaggggagctctactactcccattgaggcagaatttttatattctattgctgtcaccaaaggtgcacctaagaagaatagcaatggtcctaagaaatatcgtggcctcagtgagcagtctttgagtgccactgctctcatctcggcggagctcctgacatgggcattcctcgccgtcctaggtcagctccatggctccgacatcaccgccaccgttgagtggtcgttgccgctctcagctctgtgctgcgtcgaagctcatgcgacgccgaagacgatcgcggaggagggagaaggaatgggatggatcacgagagcagacctctttcccccggccggccggcgagccagaaaacctttggcggtggcctccatgaagaagatcgtagttctctaccccggcctcgccgtcagccacttcatccccatgatgcagctcgctgacgtcctcctggaggaaggctacgacgtcgtggtcgcgctcatcgacatcaccatggaacacaacatcgccttggccgccgccgtcgaccgcgtcatcgcatcctccaagccggcggtcaccttccacacgctccctcgaatccacgatcctcccaccgtcaccaacgacgtgaacctcctcctcggatacttggagatcatacggcgctacaacgagcacctccgcgagttcctctgctccatcccgccgccaagcatccacgcggtgatcgtggactcgtggtccgacgcggcgctcgacgtcaccggccatctcggcatcccagcctacagcttcttcgcctccaacgcctccgccctcgctgtatgcctccaactcccttattgggcccgacgtcgtgcggagggccagccgagcttcaaggagctagcaggagacgccactgtcaacttccatggcgtcccaccgataccggcttctcacctcattcgcgaggtgctcgaggaccccaacactgagatatacagggcggtgatgaactcgctgggcaagaatctggaggccgctggcatactggtgaacacgttcgcatcgctagagcctcgggcagtggcagccctcaaggacccgcactttctcaccactgaaagtgggcttacagtgcctccggtgtactgcgtcgggccacttgtcgaggaggctgctgctgagacgaaacaaaagcacgagtgtctcacatggctcgatgagcaaccagagcgcagtgtcgtgttcctgtgctttggaagcctaggcaaccactcggagacgcagctgaaggagatcgccgccggcctcgagagatctggccaccgtttcctctgggtcgtgcgagctcctctcggcgacaacccggagaagacattcggcgaccaggccaacccggatctccacacgctcctgccggaaggattcttggagaggaccagagggcgtggcctcgtcgtcaagctatgggcgccgcaggtggaggtcctccgtcacaaggcgacaggcgccttcgtgacgcactgcgggtggaactctgtactggaggcgatcatggccggcggcgtgccgatgctctgctggccattgtacgcggagcaaaagatgaataaggtgctcatggtggaggagatcgggatcggtgtggaacttgccgggtggcagcatgggctggtcaaggccgacgagctggaggccaaggtgaggctagtgatgatggagtctgaggaaggggagcagcttagagctcgtgtgacagcgcacaaagaggccgcaggcatggcctggaaggatggtggatcgtcgcgcatggcgtttggccagttcttgtcagacgcggccaagggagaacctctttag

SEQ ID NO: 19555 - protein, 613 aa, Sorghum bicolor
  misc_feature: Useful for making plants with altered carbohydrate content
  misc_feature: Functional homolog of the protein sequence given in SEQ ID NO 14362
  misc_feature: Ceres ANNOT ID no. 8733704
  misc_feature (133)..(602): SWISSPROT Homolog: EC 2.4.1.218 Hydroquinone glucosyltransferase
  misc_feature (133)..(611): Pfam ID: UDPGT Pfam Description: UDP-glucoronosyl and UDP-glucosyl transferase
MEVDEGSSTTPIEAEFLYSIAVTKGAPKKNSNGPKKYRGLSEQSLSATALISAELLTWAFLAVLGQLHGSDITATVEWSLPLSALCCVEAHATPKTIAEEGEGMGWITRADLFPPAGRRARKPLAVASMKKIVVLYPGLAVSHFIPMMQLADVLLEEGYDVVVALIDITMEHNIALAAAVDRVIASSKPAVTFHTLPRIHDPPTVTNDVNLLLGYLEIIRRYNEHLREFLCSIPPPSIHAVIVDSWSDAALDVTGHLGIPAYSFFASNASALAVCLQLPYWARRRAEGQPSFKELAGDATVNFHGVPPIPASHLIREVLEDPNTEIYRAVMNSLGKNLEAAGILVNTFASLEPRAVAALKDPHFLTTESGLTVPPVYCVGPLVEEAAAETKQKHECLTWLDEQPERSVVFLCFGSLGNHSETQLKEIAAGLERSGHRFLWVVRAPLGDNPEKTFGDQANPDLHTLLPEGFLERTRGRGLVVKLWAPQVEVLRHKATGAFVTHCGWNSVLEAIMAGGVPMLCWPLYAEQKMNKVLMVEEIGIGVELAGWQHGLVKADELEAKVRLVMMESEEGEQLRARVTAHKEAAGMAWKDGGSSRMAFGQFLSDAAKGEPL

SEQ ID NO: 19556 - DNA, 1428 bp, Sorghum bicolor
  misc_feature: Ceres ANNOT ID no. 8733703
  misc_feature: Encodes the peptide sequence at SEQ ID NO 19557
atgacggggaagaagaggacgttcgtgctctacccttcgctgggcgtgggccacctgatcccgatggtggagctagccaagcacctgctgcgccacggccacggcgcgctcatcgccgtggtcgacccacccgacaccgacgccgtgtcggccgccgcggtggcgcgcctggcggcggccaacccggccatcgcgttccgcctcctgccggcgccggccagcccggacgtcgtcggcgtgcacccggcgaagcgcgacaaggacacgctccagctcgccaaccccgcgcttcgtgacctcctgcgggactccctgcccggcgccgtcgacgcgctcctcctcgacatgttctgcgtcgacgcgctcgacgtcgcggcggaggtcggcgtcccggcatacttcttcttcgcctccgcggcgggggacctcgccgtgttcctcaacctgccgtacctctacccgaccctgccgtcgtcgttcagggaaatgggcgagacgcttgtgcgctgccccggcatgccgacaccgatccaggcgctggacatgccgtggacggtgctggacagggagagcgacgggaccaaggtccggatgtaccagtggaagcgcatcgcggaggcgaggggcgtgctggtcaacagcttcgactggctggagccccgagccctgacagcgctcggcgacggcgtctgcgtgcccggccggccgacgccgagagtcttctgcatcggcccactcgtcaacgacggcagcacaggtcagagcggcgagaggcacgagtgcctggcgtggctggacgcgcagccgaagcggagcgtcgtgttcctctgcttcggcagcaagggcgccttccccgccgcgcagttgcaggagatcgcccgcggattggagagctccggccaccggttcctgtgggtggtgaggagcccgccggaagaagagggccagtctcccgaactggacttggggcggctgctccccgcagggttcttggacaggaacaggggcagaggcatggtggtgaagaactgggtgccgcaggcgcaggtggtgcggcacgaggcggtcggcgcgttcgtcacgcactgcgggtggaactcggcgctcgaggccatcgtgtcggggctgcccatgatttgctggccgctgtacgcggagcaggcgctgaacaaggtgttcatggtggaggagatgaagatcgcggtggcgctggggaggtacgaagagttcgttagggcggaggaggtggaagcgaaggtgaggctggtgatggaggcggaggaagggaggattctccgggagaggctcgcggtggcgagggagaaggcgttggaggctactagggagtgcgggtcttctcaagtggcattcgcggagttcttgagagatttggacaagagcagctccgtaaacggagaatgcaattga

SEQ ID NO: 19557 - protein, 475 aa, Sorghum bicolor
  misc_feature: Useful for making plants with altered carbohydrate content
  misc_feature: Functional homolog of the protein sequence given in SEQ ID NO 14447
  misc_feature: Ceres ANNOT ID no. 8733703
  misc_feature (10)..(459): SWISSPROT Homolog: EC 2.4.1.218 Hydroquinone glucosyltransferase
  misc_feature (7)..(468): Pfam ID: UDPGT Pfam Description: UDP-glucoronosyl and UDP-glucosyl transferase
MTGKKRTFVLYPSLGVGHLIPMVELAKHLLRHGHGALIAVVDPPDTDAVSAAAVARLAAANPAIAFRLLPAPASPDVVGVHPAKRDKDTLQLANPALRDLLRDSLPGAVDALLLDMFCVDALDVAAEVGVPAYFFFASAAGDLAVFLNLPYLYPTLPSSFREMGETLVRCPGMPTPIQALDMPWTVLDRESDGTKVRMYQWKRIAEARGVLVNSFDWLEPRALTALGDGVCVPGRPTPRVFCIGPLVNDGSTGQSGERHECLAWLDAQPKRSVVFLCFGSKGAFPAAQLQEIARGLESSGHRFLWVVRSPPEEEGQSPELDLGRLLPAGFLDRNRGRGMVVKNWVPQAQVVRHEAVGAFVTHCGWNSALEAIVSGLPMICWPLYAEQALNKVFMVEEMKIAVALGRYEEFVRAEEVEAKVRLVMEAEEGRILRERLAVAREKALEATRECGSSQVAFAEFLRDLDKSSSVNGECN

SEQ ID NO: 19558 - DNA, 1437 bp, Sorghum bicolor
  misc_feature: Ceres ANNOT ID no. 8733702
  misc_feature: Encodes the peptide sequence at SEQ ID NO 19559
atggcggagcccagtcctaacccgaccgtggtgctgcacgcctgcctcggcgtgggccacctgatccccatggtggagctcgccaagcagctcctccgccgcggcctcgctgtcatcatcgccgtgcccaccccaccagcctccaccgccgacttcttcgcctcctccgcatccgccgtcgccgcgcttgcggccgccaaccctgccgtctccttccaccacctcccgcccccagactaccctgtcccggactcagaccccttcctccagatgctcgacgcgctccgcctcacagtcccgtccctcaccgccttcctccgctcccttccctccgtcgccgggctcgtgctcgacctcttctgcggcgacgcgctcgacgcggccgcagccaccggcatcccggcctacttctactacacctcctgcgctggcgacctcgccgcgttcctctaccttccccactacttcgccacgacggagggcggccccagcttcaaagacatgggcaaggcgctcctccacttccccggcatcccgccgatcccggcttcggacatgcctcacactgtcgtcgaccgcacgagtcggacctgcgcctcgcggatcgtgcactacggccgcgtcccagaggcgcggggcgtgctgatcaacacctacgagtggctggaggcgcgggccgtcagggcactcagggacggcgtctgcgtccccggccgccccacgccgccggtgtaccccatcggcccgctcatcgtcaagggcgaggaggcggcggaggaagtggagcggcacgcgtgcctgtcgtggctggacgcacagccggagcggagcgtggtgttcctctgcttcggcagcctgggcgccgtctccgcggcgcagattaaggagatcgctcgcgggctggagagttccgggcatcggttcctgtgggtcgtgcggagcccgccggaggacccggccaagttcttcctcgcgcgtcccgagccggacctggactcgctgctcccggaggggttcctggagcggacgagcggcagggggatggtggtgaagatgtgggcgccgcaggtggaggtgctgcggcacgcggcgacgggcgcgttcatgacccactgcgggtggaactcggtgctggaggcggcgtccgccggcgtccccatgctgtgctggccgatgtacgcagagcagaggctgaacaaggtgtttgtagtggacgagatcaaggccggggtggtgatggacggctacgacgaggagctggtgagggcggaggaggtggagaagaaggtgaggctggtgatggagtctgaggaaggggagaagctcagggggaggctggcaatggcgaaggagaaggcggcagaggcgctggctgatggcgggccgtcgtgggtggcgtttgaagagttcttgaaggatttgaagctcgccaaatga

SEQ ID NO: 19559 - protein, 478 aa, Sorghum bicolor
  misc_feature: Useful for making plants with altered carbohydrate content
  misc_feature: Functional homolog of the protein sequence given in SEQ ID NO 14447
  misc_feature: Ceres ANNOT ID no. 8733702
  misc_feature (106)..(469): SWISSPROT Homolog: EC 2.4.1.218 Hydroquinone glucosyltransferase
  misc_feature (9)..(478): Pfam ID: UDPGT Pfam Description: UDP-glucoronosyl and UDP-glucosyl transferase
MAEPSPNPTVVLHACLGVGHLIPMVELAKQLLRRGLAVIIAVPTPPASTADFFASSASAVAALAAANPAVSFHHLPPPDYPVPDSDPFLQMLDALRLTVPSLTAFLRSLPSVAGLVLDLFCGDALDAAAATGIPAYFYYTSCAGDLAAFLYLPHYFATTEGGPSFKDMGKALLHFPGIPPIPASDMPHTVVDRTSRTCASRIVHYGRVPEARGVLINTYEWLEARAVRALRDGVCVPGRPTPPVYPIGPLIVKGEEAAEEVERHACLSWLDAQPERSVVFLCFGSLGAVSAAQIKEIARGLESSGHRFLWVVRSPPEDPAKFFLARPEPDLDSLLPEGFLERTSGRGMVVKMWAPQVEVLRHAATGAFMTHCGWNSVLEAASAGVPMLCWPMYAEQRLNKVFVVDEIKAGVVMDGYDEELVRAEEVEKKVRLVMESEEGEKLRGRLAMAKEKAAEALADGGPSWVAFEEFLKDLKLAK

SEQ ID NO: 19560 - DNA, 726 bp, Sorghum bicolor
  misc_feature: Ceres ANNOT ID no. 8733718
  misc_feature: Encodes the peptide sequence at SEQ ID NO 19561
atggaaaactcgccgctccatggagtcatccggcaaccaaacactccgccgctggctacgggtacgtgccttgccccgctgccgccggccgtagccgcgccacagccgccggagcagcatgcgtgcagcagcgatgcgacgacgacgtccctcgtcccgggcgcggccacgatgatgagttgcccgccggcggccgtggactgggcgtcgctgcttctcccgcgcgcgccggggacgctgcacgtcgggacgacgccgccgccggtcgcgagcgaagtcgagagcggcggtagtagcgctgtgacggtggccgggagcagtgctagtgcgacggcggcgggagagggagataataattataaggccggaaaagctgggaaggccggcggcggcgggagggggaagaagaaggcgagccggccacggttcgcgttccagacgcggagcgacaacgacgtcctcgacgacggctaccggtggaggaagtacgggcagaaggccgtcaagaacagcgcatttccaaggagctactaccggtgcacgcaccacacgtgcgacgtgaagaagcaggtgcaacggctggccaaggacacgagcatcgtggtgaccacgtacgagggcgtgcacaaccacccgtgcgagaagctcatggaggcactcagccccatcctcaagcagctccagctcctctcgcaactccagtcttgcactaatcaactcctctga

SEQ ID NO: 19561 - protein, 241 aa, Sorghum bicolor
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8733718
  misc_feature (154)..(213): Pfam ID: WRKY Pfam Description: WRKY DNA -binding domain
MENSPLHGVIRQPNTPPLATGTCLAPLPPAVAAPQPPEQHACSSDATTTSLVPGAATMMSCPPAAVDWASLLLPRAPGTLHVGTTPPPVASEVESGGSSAVTVAGSSASATAAGEGDNNYKAGKAGKAGGGGRGKKKASRPRFAFQTRSDNDVLDDGYRWRKYGQKAVKNSAFPRSYYRCTHHTCDVKKQVQRLAKDTSIVVTTYEGVHNHPCEKLMEALSPILKQLQLLSQLQSCTNQLL

SEQ ID NO: 19562 - DNA, 1533 bp, Sorghum bicolor
  misc_feature: Ceres ANNOT ID no. 8733711
  misc_feature: Encodes the peptide sequence at SEQ ID NO 19563
atgagagacacggtggttctgtacccaggcctcggcgtcagccatctcctgccgatggtggagctgagcgggctcttcctgcggcgcggcctcgccgtaaccgtcgtcgtcgtcgagccgccagccgcgtcgacggacgcctcgtccagggtcgcgcgcgctgctgaggccaacccgtccatccacttccacgtgctgccgctgccgccgcccgacaccaccgtttccccggagctgccgcgtgatcctttcgctctcttccgcctcgccaacgcgccgctccgcgactacctccgctcggtgtccccctccgccgcctccatgcgcgcgctcgtattcgacttcttctgcatcgacgcgctcgacgtcgccgcggaactcggcgtgccggcgtacctcttctacacgtcgggcgcctgcagcctcgccgtcagcctgcacttgccgcacaagcaggctgaggtgagcgccagcttcggggacatcggcgacgcgccgctctgctttccgggcgttcccccgttcatacccacggacctccccgagaacgccctcgaccgcgacaacaaggtgtacaggaagatcctgtacacgttcgagcgggtcccggcgtgccacggcatcctcgtcaacacgttcgagtggctggaggccaaggcggtggccgcgatcagggaaggcgcgtgcgtcccgggtcgtgccacgccgccggtctactgcgtcgggccacttgtctcaggcggcggagaagccaagaagcacgagtgcctctcgtggctggacgcgcagccggagaagagcgtcgtgttcttctgcttcgggagcatgggctcgttctccaagaggcagctcgaggcgatcgccactgggctcgagatgtccgggcagaggttcctctgggtggtacggagcccgcggcgcgatggcgcgagcttgtatgccgacgatggtcatcagccacctgaacctgacctccgcgagctcctgccagaggggttcttggagaggaccaaagcctgggggctggtggccaagtcatgggcgccggcgacgggcgcgttcgtcacccactgcgggtggaactcggtgcgggaggggataacggcaggcgtgccgctgctgtgctggccgctgtacgcggagcagaggctgaacaaggtgttcatggtggaggaggcgagagttggggtggagatggcagggtatgacagggaggtggtcgccgcagactcggaggacggacgtcgactccgtgggcgagcaatggcggcgaatgagaggccctggaggctgtgcagcaaggttaccagagaacatcctcgttgcacggcgcatcgcaaaggtagggagggcgggcacgcgcggcagctggagggcgggcgcgcgcggcagggagggcggacgggcgtagagaaatcgcgcggggggagggggggagggacgaagtccgacatggaaggccgaaattgtagatgcaaagtggtagtaaggtttgcatatatgcaaagcctcaacctctatttgcaaagttaa

SEQ ID NO: 19563 - protein, 510 aa, Sorghum bicolor
  misc_feature: Useful for making plants with altered carbohydrate content
  misc_feature: Functional homolog of the protein sequence given in SEQ ID NO 14447
  misc_feature: Ceres ANNOT ID no. 8733711
  misc_feature (5)..(397): SWISSPROT Homolog: EC 2.4.1.218 Hydroquinone glucosyltransferase
  misc_feature (4)..(447): Pfam ID: UDPGT Pfam Description: UDP-glucoronosyl and UDP-glucosyl transferase
MRDTVVLYPGLGVSHLLPMVELSGLFLRRGLAVTVVVVEPPAASTDASSRVARAAEANPSIHFHVLPLPPPDTTVSPELPRDPFALFRLANAPLRDYLRSVSPSAASMRALVFDFFCIDALDVAAELGVPAYLFYTSGACSLAVSLHLPHKQAEVSASFGDIGDAPLCFPGVPPFIPTDLPENALDRDNKVYRKILYTFERVPACHGILVNTFEWLEAKAVAAIREGACVPGRATPPVYCVGPLVSGGGEAKKHECLSWLDAQPEKSVVFFCFGSMGSFSKRQLEAIATGLEMSGQRFLWVVRSPRRDGASLYADDGHQPPEPDLRELLPEGFLERTKAWGLVAKSWAPATGAFVTHCGWNSVREGITAGVPLLCWPLYAEQRLNKVFMVEEARVGVEMAGYDREVVAADSEDGRRLRGRAMAANERPWRLCSKVTREHPRCTAHRKGREGGHARQLEGGRARQGGRTGVEKSRGGRGGGTKSDMEGRNCRCKVVVRFAYMQSLNLYLQS

SEQ ID NO: 19564 - DNA, 1431 bp, Sorghum bicolor
  misc_feature: Ceres ANNOT ID no. 8733705
  misc_feature: Encodes the peptide sequence at SEQ ID NO 19565
atgaagaagaccgtcgtcctgtacccgggcctcgccgtcagccacttcgtccccatggttcaggtcgccgacgtgctcctggaggagggctacgacgtcgtggtcgcgttcatcgaccccaccctgaaaggagacatcgccttggccgccgtcatcgacagcgtcgccgcctccaagccgtccgtggttttccacaagctcccacgagtcgaggacgctcccacctttgtccatgactccaagttcgtggtcaggtacttggaattcgtgggccgctactgccagcacttccacgacttcctcttctccatgcctcccggcagcgtccacgccgtgcttgtggacgtgatgtccaccgaggtgctcggcgtcaccagcaagctcggcatcccagcttacgctttcttcccctcgaatgcctccgcacttgccgtgttcgtccaggcttcatcagttcgttcagaagggcagccaagtttccgggagctaggagacgcgcctctaaacttccatggcgtcccaactatgccagcttctcatctcactgctgaaatgctcgagggtccagggagtgagacattcaagacaacgatgaacatgaagagcaggatacaaaaagccaatggaatacttgtgaacacgtccgcatcgattgagcctcgtgcggtgtcagccctcggcgatccacggcgcttgccaaaaatgcctccggtgtactgcgtcgggccgttggtcgccgggaacggcggccaggcaacagacaagcacgagtgcctggcatggctcgacgagcaaccggagcagagcgtagtgttcctctgttttggaagcacaggcgccagcaaccactcagagcagcagctaaaggagatagccaatggcctggagagggccggccaccggttcctgtgggtggtgcgggcgcctccccacgacgacccggagaagccattcgatccccgcgcggacccggacctcgacgcgcttctgcccgccggtttcttggagagaactgggggtcgcggccgcgtcgtcaagctgtgggcgccgcaggtggacgtgctccatcacgcggcgacaggggcgttcgtgacacactgtgggtggaactcggtgctcgaggggattgttgccggcgtgccgatgctctgctggcctctgtacgcggagcagaagatgaacaaggtgttcatggtggaggaatatggagtcgccgtggagatggtcggctggcagcagggattggtgaaggccgaggaggtggaggccaaggtgaggttggtgatggagtcggaggaaggcaagctactgagggcacaggtgtccgagcacaaggaaggtgcggcaatggcatggaaggatggcggctcgtcgcgcgctgcgtttgctcagttcctgtcgcacgcaggcagcgtttcgggcagagcctga

SEQ ID NO: 19565 - protein, 476 aa, Sorghum bicolor
  misc_feature: Useful for making plants with altered carbohydrate content
  misc_feature: Functional homolog of the protein sequence given in SEQ ID NO 14362
  misc_feature: Ceres ANNOT ID no. 8733705
  misc_feature (5)..(464): SWISSPROT Homolog: EC 2.4.1.218 Hydroquinone glucosyltransferase
  misc_feature (4)..(473): Pfam ID: UDPGT Pfam Description: UDP-glucoronosyl and UDP-glucosyl transferase
MKKTVVLYPGLAVSHFVPMVQVADVLLEEGYDVVVAFIDPTLKGDIALAAVIDSVAASKPSVVFHKLPRVEDAPTFVHDSKFVVRYLEFVGRYCQHFHDFLFSMPPGSVHAVLVDVMSTEVLGVTSKLGIPAYAFFPSNASALAVFVQASSVRSEGQPSFRELGDAPLNFHGVPTMPASHLTAEMLEGPGSETFKTTMNMKSRIQKANGILVNTSASIEPRAVSALGDPRRLPKMPPVYCVGPLVAGNGGQATDKHECLAWLDEQPEQSVVFLCFGSTGASNHSEQQLKEIANGLERAGHRFLWVVRAPPHDDPEKPFDPRADPDLDALLPAGFLERTGGRGRVVKLWAPQVDVLHHAATGAFVTHCGWNSVLEGIVAGVPMLCWPLYAEQKMNKVFMVEEYGVAVEMVGWQQGLVKAEEVEAKVRLVMESEEGKLLRAQVSEHKEGAAMAWKDGGSSRAAFAQFLSHAGSVSGRA

SEQ ID NO: 19566 - DNA, 1440 bp, Sorghum bicolor
  misc_feature: Ceres ANNOT ID no. 8733706
  misc_feature: Encodes the peptide sequence at SEQ ID NO 19567
atgaagaagaccgtcgtcctgtaccccggcctcgccgtcagccacttcgtccccatgctgcagctcgccgacgtccttctggaggagggctacgccgtcgtggtcccgttcatcgaccccactgagaaaggagatatcgccttggccgccgtcatcgaccgtgtcgccgcctccaagccgtccgtggtcttccacgtgttgccaaggaccgaggactctccatgcacctttgtccacgactcggagttcatcgtcaggtacttggaaatcgtgggccgctacagccagcacctccacgacttcctcctctccatgcctcctggcagcgtccacgccctgatcgtcgacatgctgtctatcgaggtgctcgacgtcaccaccaagctcggcatcccggcttacgccttcttccccccgaatgcctccgcccttgccgtgtccgtccaggctgcatcacttcattcagaagggcagcagccaagtttcggggagctaggagacgcgcctctaaacatccatggcgtgccacctatgccagcttcccatctcaatgctgaaatgctcgacgatccagggagtgccactctcaaggcaacggtgaacatgtttcgcagaatacaagaagccaatggaatactagtgaacacgtttgcatccatcgagcctcgtgcggtgtcagccctcagcgatccacggagtttcccgaaaatgcctccggtgtactgcatcgggccgttggtcaccggtaagggcagccagggaacagagaagaagcacgagtgcctggcatggctcgacgagcagccggagcagagcgtagtgtttctctgttttggaagcacaggcgccggcaaccattcagaggagcagctaaaggagatagccactggcctggagaggtccggccaccggttcctgtgggtggtgcgcgcgcctccccacgacgacccggagaagccgttcgactcccgcgcggacccggacctcgacgcgcttctgcccgcgggtttcttggagaggaccggcggtcgcggccgcgtcgtcaagctgtgggcgccgcaggtggaggtgctccaccacgcggcgacaggggcgttcgtgacgcattgtgggtggaactcggtgctggaggggatcatcgcgggggtgccgatgctctgctggcctctgtacgcggagcagaagatgaacaaggtgttcatggtggaggaatatggagtcggggtggagctggtcggttggcagcagggactggtgaaggccgaggaggtggaggccaaggtgacgttggtgatggagtcggaagaaggcaagctgctcagggcacgggtgtccaagcacaaggaaggtgcggcaatggcatggaaggatggcggttcgtcgcgcgctgcgtttgcccagttcctgtcgcacgcaggcaacgccacgggcaggggctga

SEQ ID NO: 19567 - protein, 479 aa, Sorghum bicolor
  misc_feature: Useful for making plants with altered carbohydrate content
  misc_feature: Functional homolog of the protein sequence given in SEQ ID NO 14362
  misc_feature: Ceres ANNOT ID no. 8733706
  misc_feature (5)..(467): SWISSPROT Homolog: EC 2.4.1.218 Hydroquinone glucosyltransferase
  misc_feature (4)..(476): Pfam ID: UDPGT Pfam Description: UDP-glucoronosyl and UDP-glucosyl transferase
MKKTVVLYPGLAVSHFVPMLQLADVLLEEGYAVVVPFIDPTEKGDIALAAVIDRVAASKPSVVFHVLPRTEDSPCTFVHDSEFIVRYLEIVGRYSQHLHDFLLSMPPGSVHALIVDMLSIEVLDVTTKLGIPAYAFFPPNASALAVSVQAASLHSEGQQPSFGELGDAPLNIHGVPPMPASHLNAEMLDDPGSATLKATVNMFRRIQEANGILVNTFASIEPRAVSALSDPRSFPKMPPVYCIGPLVTGKGSQGTEKKHECLAWLDEQPEQSVVFLCFGSTGAGNHSEEQLKEIATGLERSGHRFLWVVRAPPHDDPEKPFDSRADPDLDALLPAGFLERTGGRGRVVKLWAPQVEVLHHAATGAFVTHCGWNSVLEGIIAGVPMLCWPLYAEQKMNKVFMVEEYGVGVELVGWQQGLVKAEEVEAKVTLVMESEEGKLLRARVSKHKEGAAMAWKDGGSSRAAFAQFLSHAGNATGRG

SEQ ID NO: 19568 - DNA, 1632 bp, Sorghum bicolor
  misc_feature: Ceres ANNOT ID no. 8733712
  misc_feature: Encodes the peptide sequence at SEQ ID NO 19569
atgggaagtccttgcacacatcgaagatcgaaccagccacggtcgctgatgtacgttccttgtttcatggacgctcccccgttttgtcattttcacacgcgttgcacaagagccattattatagctggacttgttcctgcacgcctccatacgcgactgcagcaggccagacaccccgccggccagcccgagtttagcgtgatgagagacacggtggttctgtacccaagcctcggcgtcagccatctcctgccgatggtggagctgagcgggctcttcctgcggcgcggcctcgccgtaaccttcgtcgtcgtcgagccgccagccgcgtcgacggacgcctcgtacagggtcgcgcgcgctgctgaggccaacccgtccatccacttccacgtgctgccgctgccgccgcccgacaccaccgtttccccggagctgccgcgtgatcctttcgctctcttccgcctcgccaacgcgccgctccgcgactacctccgctcggtgtccccctccgccgcctccatgcgcgcgctcgtattcgacttcttctgcatcgacgcgctcgacgtcgccgcggaactcggcgtgccggcgtacctcttctacacgtcgggcgcctgcagcctcgccgtcagcctgcacttgccgcacaagcaggctgaggtgagcgccagcttcggggacatcggcgacgcgccgctctgctttccgggcgttcccccgttcatacccacggacctccccgagaacgccctcgaccgcgacaacaaggtgtacaggaagatcctgtacacgttcgagcgggtcccggcgtgccacggcatcctcgtcaacacgttcgagtggctggaggccaaggcggtggccgcgatcagggaaggcgcgtgcgtcccgggtcgtgccacgccgccggtctactgcgtcgggccacttgtctcgggcggcggagaagccaagaagcacgagtgcctctcgtggctggacgcgcagccggagaagagcgtcgtgttcttctgcttcgggagcatgggctcgttctccaagaggcagctcgaggcgatcgccactgggctcgagatgtccgggcagaggttcctctgggtggtacggagcccgcggcgcgatggcgcgagcttgtatgccgacgatggtcatcagccacctgaacctgacctcggcgagctcctgccggaggggttcttggagaggaccaaagcccgggggctggtggccaagtcatgggcgccgcaggcggacgtgctccggcacagggcgacgggcgcgttcgtcacccactgcgggtggaactcggtgctggaggggataacggcaggcgtgccgctgctgtgctggccgctgtacgcggagcagaggctgaacaaggtgttcatggtggaggaggcgagggttggggtggagatggcagggtatgacagggaggtggtcaccgcagaggaggtggaggcgaaggtcaggtgggtgatggactcagaggacggacgtgcactccgtgcgcgagtaatggtggcgaaggaaaaggccgtggaggctgtgcagcaaggtggtacatcgcacaacgctttggtcgagctcttggcggatttgggttttgatgaatgtggaacacactag

SEQ ID NO: 19569 - protein, 543 aa, Sorghum bicolor
  misc_feature: Useful for making plants with altered carbohydrate content
  misc_feature: Functional homolog of the protein sequence given in SEQ ID NO 14447
  misc_feature: Ceres ANNOT ID no. 8733712
  misc_feature (72)..(531): SWISSPROT Homolog: EC 2.4.1.218 Hydroquinone glucosyltransferase
  misc_feature (71)..(539): Pfam ID: UDPGT Pfam Description: UDP-glucoronosyl and UDP-glucosyl transferase
MGSPCTHRRSNQPRSLMYVPCFMDAPPFCHFHTRCTRAIIIAGLVPARLHTRLQQARHPAGQPEFSVMRDTVVLYPSLGVSHLLPMVELSGLFLRRGLAVTFVVVEPPAASTDASYRVARAAEANPSIHFHVLPLPPPDTTVSPELPRDPFALFRLANAPLRDYLRSVSPSAASMRALVFDFFCIDALDVAAELGVPAYLFYTSGACSLAVSLHLPHKQAEVSASFGDIGDAPLCFPGVPPFIPTDLPENALDRDNKVYRKILYTFERVPACHGILVNTFEWLEAKAVAAIREGACVPGRATPPVYCVGPLVSGGGEAKKHECLSWLDAQPEKSVVFFCFGSMGSFSKRQLEAIATGLEMSGQRFLWVVRSPRRDGASLYADDGHQPPEPDLGELLPEGFLERTKARGLVAKSWAPQADVLRHRATGAFVTHCGWNSVLEGITAGVPLLCWPLYAEQRLNKVFMVEEARVGVEMAGYDREVVTAEEVEAKVRWVMDSEDGRALRARVMVAKEKAVEAVQQGGTSHNALVELLADLGFDECGTH

SEQ ID NO: 19570 - DNA, 1134 bp, Sorghum bicolor
  misc_feature: Ceres ANNOT ID no. 8733728
  misc_feature: Encodes the peptide sequence at SEQ ID NO 19571
atggcgcagcatgatccaagcaatgggcaaggaccccaatatcctccgtgcagacgcacggggtggaagtggaacggagcacatgcattgcgcacgctctctctgatgagtttgccagcatcggacagcgactccttggcctcgcggcggtccaagaaacccaagtattctaagtttacccagcaggagcttccagcatgcaagccactgttaactcctggaatcgtcattggtgctttctcgctcatcggcgtcatcttcgtcccaatcggcctcgcttcactggctgcatcacagaatattgttgagttgatagatcggtatgacgccgagtgcgtatccgcgaacgacaaggtcgggttcattcaggataccaagactgacaaagcgtgcacaagaaagatcactgtgccaaagccaatgaaagggccgatacacatatattaccagcttgaaaatttctatcagaatcatcgccggtacgtgaagagtcgcaacgacaagcagttgctgtacaaggatgctgcgagcacgataacaaactgtgagcctgaagccatcagtgaagacggcggcaagcccatcgtgccctgcggtctcatcgcttggagcttgttcaacgacacctactccttctctctcaacaagaaggccgtcgaggtgaacaagaagaacattgcctgggacagcgacaagaacaaaaagtttggcagcgatgttttccccagcaacttccagaaagggggactgatcggcggtgctaaactgaacgagaaaataccactgagtgagcaggaggacctgattgtctggatgagaacagcggccctcccgacgttcaggaagctgtacggcaggatcgagtcggacatgatggcgagcgacgagatcactgtggtgatccagaacaactacaacacgtacagcttcggggggacgaaggcgctggtgctgtccaccacgtcgtggatcggcggcaggaacaacttcatcggcgtcgcgtacgtcgccatcggcggcatctgcctcttcctcgccatgggcttcgtcatcctctacgtgattaagccaagggcccttggagaccctaactacttgtcatggaacaaagaaaacccagaccatccatactga

SEQ ID NO: 19571 - protein, 377 aa, Sorghum bicolor
  misc_feature: Useful for making plants with modulated nitrogen use efficiency
  misc_feature: Functional homolog of the protein sequence given in SEQ ID NO 13263
  misc_feature: Ceres ANNOT ID no. 8733728
  misc_feature (94)..(364): Pfam ID: CDC50 Pfam Description: LEM3 (ligand-effect modulator 3) family / CDC50 family
MAQHDPSNGQGPQYPPCRRTGWKWNGAHALRTLSLMSLPASDSDSLASRRSKKPKYSKFTQQELPACKPLLTPGIVIGAFSLIGVIFVPIGLASLAASQNIVELIDRYDAECVSANDKVGFIQDTKTDKACTRKITVPKPMKGPIHIYYQLENFYQNHRRYVKSRNDKQLLYKDAASTITNCEPEAISEDGGKPIVPCGLIAWSLFNDTYSFSLNKKAVEVNKKNIAWDSDKNKKFGSDVFPSNFQKGGLIGGAKLNEKIPLSEQEDLIVWMRTAALPTFRKLYGRIESDMMASDEITVVIQNNYNTYSFGGTKALVLSTTSWIGGRNNFIGVAYVAIGGICLFLAMGFVILYVIKPRALGDPNYLSWNKENPDHPY

SEQ ID NO: 19572 - DNA, 1431 bp, Sorghum bicolor
  misc_feature: Ceres ANNOT ID no. 8733731
  misc_feature: Encodes the peptide sequence at SEQ ID NO 19573
atggagggttgcaactcgcacggcggtggcggcggcggaggaggaggaggaggaggaggagggtcgagctcgccgccgccgttcctcatcaagacctacgagatggtggaggacccggcgacgaaccacgtggtgtcgtggggacccggcggcgccagcttcgtggtgtggaacccgccggacttctcgcgggacctgctgcccaagtacttcaagcacaacaacttctccagcttcatcaggcagctcaacacatacggtttccgaaagatcgatccagagagatgggagtttgccaacgacgacttcatacggggacacacgcaccttctgaagaacatccaccggcgcaaaccggtgcacagccactcgctgcagacgcaggtgaacgggccattagcggagtccgagaggcgcgagcttgaggacgagatcaacaggctcaagtacgagaagagcctgctgctggcagatctccagaggcagaaccagcagcggtgcgggatcagctggcagatgcagtcgctggagagcaggctggtggcgatggaggagcgccagaggcacatcgtggcgtccctgtgtgacatcctgcagagacacggggttgttccgggctcgacgacgacgacgctggagatggagacgccggcggaccacttcagcaagaagaggagggtgccgaagttcggtttcttcgtcgacgccgacgaacccaaggtggaagaacagcaggtgccgtcgttcctgcagacggtgggaggagtagtagcagagacaccaggcatgtctccgatccgccttttgaatgatgagccgtttgagaagatggagctggccttggtgtcgctggagaatttcttccagagggcaacccattcgcctgctgccaatgacattgacatgtacgctggtggtgctgctgaaccacccagccctgctctgagtctcggggagatgttctcagtctcagcaccaatggataccagtatcaatctgcagtcatcagctcgccactgccagaatccctttgcttccacctcagggcaagaccagtcgtcatctccattggcacaagcagaacctccgagctacgacgcccggagcccgatcctgccattggcacagctccatgaatatgcccctagggcagctgaagtcgatatgaactctgacaccacaactggcgacacttcacaagatgagaccaccagtgaaactgaaggttcccatttgccggccaaggcgaacgatatattctgggagcagtttctcaaagacgaagagggtaaaatagaagcaaaggaagatgtgaagactgccgtagaccgcagctgtcgtcgtctacaggacaatgttgatcagatcactgagcagatggggcagctcgattcagctgagaacggctcttatgcaccccagacttactga

SEQ ID NO: 19573 - protein, 476 aa, Sorghum bicolor
  misc_feature: The sequence is a functional homolog of SEQ ID NO 2282 in the 10/374,780 US patent application
  misc_feature: The sequence is a functional homolog of SEQ ID NO 872 in the 10/225,066 US patent application
  misc_feature: The sequence is a functional homolog of SEQ ID NO 918 in the 11/435,388 US patent application
  misc_feature: Ceres ANNOT ID no. 8733731
  misc_feature (26)..(194): Pfam ID: HSF_DNA-bind Pfam Description: HSF-type DNA-binding
MEGCNSHGGGGGGGGGGGGGGSSSPPPFLIKTYEMVEDPATNHVVSWGPGGASFVVWNPPDFSRDLLPKYFKHNNFSSFIRQLNTYGFRKIDPERWEFANDDFIRGHTHLLKNIHRRKPVHSHSLQTQVNGPLAESERRELEDEINRLKYEKSLLLADLQRQNQQRCGISWQMQSLESRLVAMEERQRHIVASLCDILQRHGVVPGSTTTTLEMETPADHFSKKRRVPKFGFFVDADEPKVEEQQVPSFLQTVGGVVAETPGMSPIRLLNDEPFEKMELALVSLENFFQRATHSPAANDIDMYAGGAAEPPSPALSLGEMFSVSAPMDTSINLQSSARHCQNPFASTSGQDQSSSPLAQAEPPSYDARSPILPLAQLHEYAPRAAEVDMNSDTTTGDTSQDETTSETEGSHLPAKANDIFWEQFLKDEEGKIEAKEDVKTAVDRSCRRLQDNVDQITEQMGQLDSAENGSYAPQTY

SEQ ID NO: 19574 - DNA, 831 bp, Sorghum bicolor
  misc_feature: Ceres ANNOT ID no. 8733785
  misc_feature: Encodes the peptide sequence at SEQ ID NO 19575
atggccgccgcgggtcccgggctctactccgagatcgggaagaaggctagagatctcctgtacaaggactaccacacggaccagaagttcacgctcaccacctacgccgccaacggagctgccattactgctgcaagcacgaggaaagatgaagctatcttcaatgaaatccagagccagctgaagcacaacaatgtgactgtggatgtgaaagcaacttcagaatcaaatttgataactacaatcacagttcacgagctgggcacaccaggcctgaagggaattttatgcattcctttcccgtaccagaaatctgcaaaggctgaactccagtacttgcaccaccatgctggtgttgctgcaagtgtcggcctaaatgcaaaccctgttgttaacctttctggtgtatttggaactaaaactattgctgttggcgctgatgctgcatatgatacgtcatctggggacttaaccaaatacaatgctggactgagctacactacttctgactttgttgctgcagcgactctgaaccacaaaggagacaacattgccgcttcctactaccacttggtgagtccaaccacagctgttggaggagagctgagccacagcttctcaaccaacgggaacaccatcacctttgggacgcagcatgccctggaccccctgaccactgtgaaggcgcgcttcaacaactacggcatggcaagcgcactgatccaacatgagtggaggcccaagtcattggtcaccatctccgcggaggtggacaccaaggcaattgagaagagctccaaggttgggctctccctggtcctcaagccctga

SEQ ID NO: 19575 - protein, 276 aa, Sorghum bicolor
  misc_feature: Useful for making plants with modulated drought sensitivity
  misc_feature: Functional homolog of the protein sequence given in SEQ ID NO 13169
  misc_feature: Ceres ANNOT ID no. 8733785
  misc_feature (5)..(269): Pfam ID: Porin_3 Pfam Description: Eukaryotic porin
MAAAGPGLYSEIGKKARDLLYKDYHTDQKFTLTTYAANGAAITAASTRKDEAIFNEIQSQLKHNNVTVDVKATSESNLITTITVHELGTPGLKGILCIPFPYQKSAKAELQYLHHHAGVAASVGLNANPVVNLSGVFGTKTIAVGADAAYDTSSGDLTKYNAGLSYTTSDFVAAATLNHKGDNIAASYYHLVSPTTAVGGELSHSFSTNGNTITFGTQHALDPLTTVKARFNNYGMASALIQHEWRPKSLVTISAEVDTKAIEKSSKVGLSLVLKP

SEQ ID NO: 19576 - DNA, 1332 bp, Sorghum bicolor
  misc_feature: Ceres ANNOT ID no. 8733786
  misc_feature: Encodes the peptide sequence at SEQ ID NO 19577
atggagagcagtggaatgatgatggtgaagagcgagatcgagagctgcggctacccggggccgtcgtcgtcgacggcacctgcggcaggcgtggtcatcggcggcagcgcgacgacggaacgcggcgagggggggcaccatcatcatcatcatcaggtggtggtgaggaggaggaggagggagccgcctctgctcgcaccaatcgccggcggcggcattggcaagccgctgcccagcatcaccgtcaagaggagctccaggttccgtggagtcagcaggcatcgatggacaggtcgttttgaggcacatctgtgggacaagaactcgtggaatccgacgcagcggaagaagggcaaacaggtctatctgggagcttacgatgaggaggaggctgctgccagagcctacgaccttgctgctctcaagtactgggggcccaccacctacacgaacttcccggtcatggactacgagaaggagctcaagataatggagaacctcacaaaggaagagtaccttgcatcactgaggaggaagagcagtggtttttcaagaggagtgtccaagtacagaggcgttgccagacatcatcagaacgggaggtgggaggcaagaattgggcgcgtttttgggaacaagtacctttacctaggaacttacagcactcaagaagaagccgcccgcgcatacgacatcgcggcgatagagtacaaaggcgtgaacgcggtgaccaacttcgacctgaggtcctacatcacatggctgaaacccagcggtgctccggccgccttcaacccggaggcggcgctcctgatgcaggcagctccggccgagcagctcctccacccggcagagacggcccagatgctcccacgagtcggcaacccgttcctgctggaccacggcgccgcgccgccgggcagtagcggcggcggcgggcaggacgcctccatgtcgtccatggtgtctcccggtgccggcggcggcatgaggaggagaggctcctccaccgcgctcagcctgctgctcaagtcgtccatgttcaggcagctggtcgagaagaactccgacgccgaggagggcgtcagggacagggaagatgccgccgccgccgccgctgctgcgcatccagctggaccaggagacgcctatgagtaccacaacttcttccagggagaagcgcctccggacatgtgcgatctcttctcgtcaggcggcggtggcgaccacgcgcggaatgctgggttccatggagagatcgccgcgtgctacgatgatggcgaggggttggatggctggaatgggtttggcaacatgtcatctctgcaatag

SEQ ID NO: 19577 - protein, 443 aa, Sorghum bicolor
  misc_feature: The sequence is a functional homolog of SEQ ID NO 1313 in the 10/374,780 US patent application
  misc_feature: The sequence is a functional homolog of SEQ ID NO 1458 in the 10/412,699 US patent application
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: The sequence is a functional homolog of SEQ ID NO 1314 in the 10/374,780 US patent application
  misc_feature: The sequence is a functional homolog of SEQ ID NO 1459 in the 10/412,699 US patent application
  misc_feature: The sequence is a functional homolog of SEQ ID NO 1900 in the 10/412,699 US patent application
  misc_feature: The sequence is a functional homolog of SEQ ID NO 358 in the 10/666,642 US patent application
  misc_feature: The sequence is a functional homolog of SEQ ID NO 676 in the 11/435,388 US patent application
  misc_feature: Useful for biocontainment applications
  misc_feature: Functional homolog of the protein sequence given in SEQ ID NO 13650
  misc_feature: Ceres ANNOT ID no. 8733786
  misc_feature (86)..(146): Pfam ID: AP2 Pfam Description: AP2 domain
  misc_feature (188)..(240): Pfam ID: AP2 Pfam Description: AP2 domain
MESSGMMMVKSEIESCGYPGPSSSTAPAAGVVIGGSATTERGEGGHHHHHHQVVVRRRRREPPLLAPIAGGGIGKPLPSITVKRSSRFRGVSRHRWTGRFEAHLWDKNSWNPTQRKKGKQVYLGAYDEEEAAARAYDLAALKYWGPTTYTNFPVMDYEKELKIMENLTKEEYLASLRRKSSGFSRGVSKYRGVARHHQNGRWEARIGRVFGNKYLYLGTYSTQEEAARAYDIAAIEYKGVNAVTNFDLRSYITWLKPSGAPAAFNPEAALLMQAAPAEQLLHPAETAQMLPRVGNPFLLDHGAAPPGSSGGGGQDASMSSMVSPGAGGGMRRRGSSTALSLLLKSSMFRQLVEKNSDAEEGVRDREDAAAAAAAAHPAGPGDAYEYHNFFQGEAPPDMCDLFSSGGGGDHARNAGFHGEIAACYDDGEGLDGWNGFGNMSSLQ

SEQ ID NO: 19578 - DNA, 2346 bp, Sorghum bicolor
  misc_feature: Ceres ANNOT ID no. 8733796
  misc_feature: Encodes the peptide sequence at SEQ ID NO 19579
atggtctcagcatggcccacatctttgtccagcagtgacagtgagcacggccatcactcccgtcggcagcagggtcaaaccaccgccaccaccagcgcgcacgcagctgtgcacgaggtctcctcacccgccgccccgccgcgtcgggacccagctcggcaactcgcccctcctcctcccgctgccggctgccgcccgcgcgcttggccccgttctcacggccacagagggcggtgtcgatcagtaggccgtcctgctcacggcgccccccgacgcgtggctcgtaaggcacgcttcccgcggtacaagtgcgacccacggcgctggcggggagaggaacccagcagcggaagcgcaacgagttcagggatggcctccggtggaaccttcaggaaccttctcctggtgctccccctctgcctcgcgctcgcctccttggttggtggcgaggcgtcgaggaggttctggatcgagaacgatacctttaggaaggatggggcaccgttccagatcgtcggcggcgacgtccactatttccgcattgttcctgagtactggaaggatcgccttttaagagcaaaagcattaggcttgaacacaattcaaacatatgtaccttggaatttgcatgagccagaacagcagagctggaaattcgagggctttgcggatattgagtcatatctgagacttgctcaagaactagaaatgttggtcatgcttcggataggtccatacatttgtggagaatgggatctaggaggttttccaccttggttgctcaccatagaaccagcccttaaactgcgatcatcagattcgtcctatctttccttggtggagagatggtggggagtactacttccgaaagtggcaccattattatacaataatgggggttcagttattatggttcagattgaaaatgaatttggttcttttggggacgataagaattaccttcattaccttgttcagctggccagaagatatcttggaaacaacattattctttatacaactgatgggggcgccatgggtaatttaaagaatggatcaattcctcaagatgatgttttcgctgctgttgattttgaaactggatccaatccatggcccatattcaggttgcagaagaaatacaacttgccaggaaagtcagcccctttaagttcggaattttatactggatggttaacacactggggtgaaagaatcgcaacaacagatgctactagtacagctaaagcccttaaaaccattttgtgctacaatggttctgctgtactttatatggctcatggtgggaccaattttggattttataatggtgcaaatactggtcaagatgaatctgactacaagccagacctcacttcttatgactatgcaacactgagaagagtaatacatgaatgtactgggactcctcttcatccacttccttctgacattgaaaaagcaagttacgggcttgtgaaattagaaaaggttgcttctctgtttgatatcattgataatatcagtgatcctctgaaagtttctgtttcggagcatccactttatatggaacagataggccagatgtttggatttctcttgtacatgtcagaatacgaagggaaactcccatcaagcatcctgtcaattccaaaggtacatgacagagctcaggtgtttgtgtcttgctcagttgatggtgtcagaaacctaagatatggtggtgtaattgaaagatggtctaataaaacactagagataccgaacttaagatgttcatctactaccagcctatatatcctggtagaaaatatgggtcgtgtaaattatgggccatatatttttgaccggaagggaatactatctcctattcaaatagatggcattactatccgtcactggaaaatgtatccacttgcactcaattcactggacaggcttccaaaacttcaactaatcactcaaataccttatgttggagccagtaaaatgtccattcatggagactcagaaaagaatttgcaggaatcgtcatcctattcaaatggaagcatttctgcactacctgcgttttatgaaggacatttccatattgactatgagagtgagataaaggatacattcatatcatttcgtggttggaacaagggtgttgcttttgtgaacaacttcaacatcggaagattttggccggtccgcggaccacaatgtgccctttatgttccagcgcctatcctcagatctggggacaacattgttgtaatctttgaactgcatgatccaaatcctgagctcactatcgattttgttacggaaccggatttcacgtgcggtccgaaacagtaa

SEQ ID NO: 19579 - protein, 781 aa, Sorghum bicolor
  misc_feature: Useful for making plants with altered cell wall content and/or composition
  misc_feature: Functional homolog of the protein sequence given in SEQ ID NO 14716
  misc_feature: Ceres ANNOT ID no. 8733796
  misc_feature (149)..(778): SWISSPROT Homolog: EC 3.2.1.23 Beta-galactosidase
  misc_feature (161)..(473): Pfam ID: Glyco_hydro_35 Pfam Description: Glycosyl hydrolases family 35
MVSAWPTSLSSSDSEHGHHSRRQQGQTTATTSAHAAVHEVSSPAAPPRRDPARQLAPPPPAAGCRPRAWPRSHGHRGRCRSVGRPAHGAPRRVARKARFPRYKCDPRRWRGEEPSSGSATSSGMASGGTFRNLLLVLPLCLALASLVGGEASRRFWIENDTFRKDGAPFQIVGGDVHYFRIVPEYWKDRLLRAKALGLNTIQTYVPWNLHEPEQQSWKFEGFADIESYLRLAQELEMLVMLRIGPYICGEWDLGGFPPWLLTIEPALKLRSSDSSYLSLVERWWGVLLPKVAPLLYNNGGSVIMVQIENEFGSFGDDKNYLHYLVQLARRYLGNNIILYTTDGGAMGNLKNGSIPQDDVFAAVDFETGSNPWPIFRLQKKYNLPGKSAPLSSEFYTGWLTHWGERIATTDATSTAKALKTILCYNGSAVLYMAHGGTNFGFYNGANTGQDESDYKPDLTSYDYATLRRVIHECTGTPLHPLPSDIEKASYGLVKLEKVASLFDIIDNISDPLKVSVSEHPLYMEQIGQMFGFLLYMSEYEGKLPSSILSIPKVHDRAQVFVSCSVDGVRNLRYGGVIERWSNKTLEIPNLRCSSTTSLYILVENMGRVNYGPYIFDRKGILSPIQIDGITIRHWKMYPLALNSLDRLPKLQLITQIPYVGASKMSIHGDSEKNLQESSSYSNGSISALPAFYEGHFHIDYESEIKDTFISFRGWNKGVAFVNNFNIGRFWPVRGPQCALYVPAPILRSGDNIVVIFELHDPNPELTIDFVTEPDFTCGPKQ

SEQ ID NO: 19580 - DNA, 660 bp, Sorghum bicolor
  misc_feature: Ceres ANNOT ID no. 8733790
  misc_feature: Encodes the peptide sequence at SEQ ID NO 19581
atggcggcagtcggagcgcgcccagtgctgtaccaccacccggcgccggcgggcgacgccgcctccatgtcctcctacttctcccagggaggcagctccaccacctccagctccgcgtccgccagcttctccgccgcgctcgcgccgacgacgaccacgctcgccgagcagttcgacatctccgagttcctcttcgacgacgcgggagtcgccggcgcgccaggcgtgttcgccgatggctcggcccccgtcgtcgtgtcggatgccgccgccgctgctggtggtggtgcaatcagcgcagccgctgggagcgcggctgcggcggcggaggccgtgccggagcggccgcggacggagcggatcgcgttccggacgaggtcggagatcgagatcctggacgacggctacaagtggaggaagtacggcaagaagtccgtcaagaacagtcccaacccaaggaactactaccggtgctcgacggaagggtgcaacgtgaagaagcgggtggagcgggacagggacgaccccagctacgtggtgacgacatacgaggggacgcacaaccacgtcagccccagcacggtgtactacgccagccaggacgccgcctccggccgcttcttcgtcgccggcacgcagccgccgggctccctcaactaa

SEQ ID NO: 19581 - protein, 219 aa, Sorghum bicolor
  misc_feature: The sequence is a functional homolog of SEQ ID NO 132 in the 10/714,887 US patent application
  misc_feature: The sequence is a functional homolog of SEQ ID NO 132 in the 11/435,388 US patent application
  misc_feature: The sequence is a functional homolog of SEQ ID NO 158 in the 10/714,887 US patent application
  misc_feature: The sequence is a functional homolog of SEQ ID NO 158 in the 11/435,388 US patent application
  misc_feature: The sequence is a functional homolog of SEQ ID NO 1533 in the 10/374,780 US patent application
  misc_feature: The sequence is a functional homolog of SEQ ID NO 1617 in the 10/412,699 US patent application
  misc_feature: The sequence is a functional homolog of SEQ ID NO 86 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8733790
  misc_feature (132)..(191): Pfam ID: WRKY Pfam Description: WRKY DNA -binding domain
MAAVGARPVLYHHPAPAGDAASMSSYFSQGGSSTTSSSASASFSAALAPTTTTLAEQFDISEFLFDDAGVAGAPGVFADGSAPVVVSDAAAAAGGGAISAAAGSAAAAAEAVPERPRTERIAFRTRSEIEILDDGYKWRKYGKKSVKNSPNPRNYYRCSTEGCNVKKRVERDRDDPSYVVTTYEGTHNHVSPSTVYYASQDAASGRFFVAGTQPPGSLN

SEQ ID NO: 19582 - DNA, 900 bp, Sorghum bicolor
  misc_feature: Ceres ANNOT ID no. 8733783
  misc_feature: Encodes the peptide sequence at SEQ ID NO 19583
atgccctgcttggccacagccttagtgggcctgacacaagttatatgggccgctctcctcttcccttctccgtcctcggcgtcctcgccgccgtcatcggcgcgggtggaggcggtggtgctcttcaacgtctgcgacagctacgtgcggcgcccggaccaggcggaccgcgtcatcggcacactcctcggctccctcctccccgacggcaccgtccacgtccgcaactcctacgttgtcccccacagcgagtcggccgaccaggtcgccatcgacatcgactaccaccataacatgtacgcctcgcaccagaaggtgaaccccaaggaagtcatcgtcggctggttctcaactggatttggtgtttctgggggaagtacgctcatccatgagttctattcaagggaagtacaaaaccccatccatcttacagtcgacactggcttcacaaggggggaggcttccatcaaagcctacatctcatccaacctgtcccttggagataggcacctcgctgcgcaatttcaggaaatccctctggatctaaggatgattgaggcagaaaaggctggattcgagatcctgaaatctaccatggtagagaagctccccaatgatctggaaggaatggagtcctcaatggagaagctttacattcttattgatgagatctacaaatatgtcgatgatgttgtggaaggacgcgtggcacctgataacagaattggaaggttcatctctgattctgttgcttcaatgccaaagttgtccccagctgctttcgataagcttttcaatgacaagattcaggataaccttgcgctggtatacctgtcaagcatcacaaggacacaaatcaccatcgcggagaagttgaacactgctgctcaagtgctgtaa

SEQ ID NO: 19583 - protein, 299 aa, Sorghum bicolor
  misc_feature: Useful for making plants with altered alkaloid content
  misc_feature: Useful for making plants with altered terpenoid content
  misc_feature: Functional homolog of the protein sequence given in SEQ ID NO 14717
  misc_feature: Ceres ANNOT ID no. 8733783
  misc_feature (29)..(139): Pfam ID: Mov34 Pfam Description: Mov34/MPN/PAD-1 family
MPCLATALVGLTQVIWAALLFPSPSSASSPPSSARVEAVVLFNVCDSYVRRPDQADRVIGTLLGSLLPDGTVHVRNSYVVPHSESADQVAIDIDYHHNMYASHQKVNPKEVIVGWFSTGFGVSGGSTLIHEFYSREVQNPIHLTVDTGFTRGEASIKAYISSNLSLGDRHLAAQFQEIPLDLRMIEAEKAGFEILKSTMVEKLPNDLEGMESSMEKLYILIDEIYKYVDDVVEGRVAPDNRIGRFISDSVASMPKLSPAAFDKLFNDKIQDNLALVYLSSITRTQITIAEKLNTAAQVL

SEQ ID NO: 19584 - DNA, 579 bp, Sorghum bicolor
  misc_feature: Ceres ANNOT ID no. 8733788
  misc_feature: Encodes the peptide sequence at SEQ ID NO 19585
atggagtcgtggcggaggcggacgctcctcaaggtcatcgtcctcggcgacagcggatacgtgagcaagaagttcagccagcagtacaaggcgacgatcggtgccgatttcctcaccaaggaggtcctcattggcgacaggcttgtcaccttgcagatatgggacacggcggggcaggagaggttccagagtcttggcgtagcgttctacaggggagcagattgctgtgtgctagtttatgatgtcaatgctaagagaagctttaatacactcaacacctggcatgatgagttcctcaatcaagctagcccatcagatcctcaacattttccattcattttggtcgggaacaagattgatttagatggcggaagcaaaagaatggtttctgagaagaaagcgagggaatggtgtgcctccaagggcgacattccatacttcgaaacctctgcaaaggaggaccacaatgttgacactgcttttctatgcattgccaagctcgctttggagcatgattacttcaagacagttgcagaacaagtcccggatactgaacagacaggcggatgtgcttgctag

SEQ ID NO: 19585 - protein, 192 aa, Sorghum bicolor
  misc_feature: Useful for making plants with modulated water use efficiency
  misc_feature: Functional homolog of the protein sequence given in SEQ ID NO 14718
  misc_feature: Ceres ANNOT ID no. 8733788
  misc_feature (11)..(170): Pfam ID: Ras Pfam Description: Ras family
MESWRRRTLLKVIVLGDSGYVSKKFSQQYKATIGADFLTKEVLIGDRLVTLQIWDTAGQERFQSLGVAFYRGADCCVLVYDVNAKRSFNTLNTWHDEFLNQASPSDPQHFPFILVGNKIDLDGGSKRMVSEKKAREWCASKGDIPYFETSAKEDHNVDTAFLCIAKLALEHDYFKTVAEQVPDTEQTGGCAC

SEQ ID NO: 19586 - DNA, 1143 bp, Sorghum bicolor
  misc_feature: Ceres ANNOT ID no. 8733794
  misc_feature: Encodes the peptide sequence at SEQ ID NO 19587
atggcggcgacggcggccatctgcgtggatgacgaggcgacctgcgccgccgcggaatgcgcgccgggggtcgagaagctggatctcgctgccgccggcgccggcgccgacggcaaggccggcggcagcaagaggagcgtctacctcatggactgcgcgccggtctggggctgcgcgtccacgcgcggccgcagcgccgagatggaggacgcctgcgccgcgttcccgcgcttcgccgacgtgccggtgcgcctgctcgccaggcgccgggacctcgacggcctgggcctcgacgccgacgcgctccgcctgccggcgcacctgttcggcgtcttcgacggccacggcggcgccgaggtggcgaactactgccgggagaggctccaggtgctgttgcggcaggagctgaggctactcggcaaggatttgggggagacaagcgaggtggagatgaaggagcactgggacgacctgttcaccaggtgtttccagaggctggacgacgaggtgtcagggcaggcgagcaggctcgtcggtggcgttcaggagtcacggccggtggccgccgagaacgtgggctcgactgcggttgtcgccgtcgtgtgctcgtcccatgtggtggtcgccaactgcggggattcgcgtgttgtcctctgccgtggaaaggagcccgtagagctgtcgattgatcacaagcctgacaggaaggatgagcgggcgaggattgaggccctgggaggcaaggtcatccaatggaacggttaccgggtctccggtatacttgctatgtcaagatcgattggggaccggtatttaaaaccattcgtcattccaaaaccagaagttacagtctttcctagggcgaaagatgatgactgcctcattcttgcaagtgatggactgtgggatgtcataccgaatgaagaggcatgcaaagttgcacggcgtcaaatccaactgtggcacaagaacaatggtgtcgcatcatcattgtgtgatgagggtgatgaatccactgatcctgctgcacaagctgcagctgattatcttatgaggctcgcactgaagaagggtactgaggacaatatcactgtcattgtggttgatttgaaacctcgaaagaagctcaagagcaactcataa

SEQ ID NO: 19587 - protein, 380 aa, Sorghum bicolor
  misc_feature: Useful for making plants with modulated drought sensitivity
  misc_feature: Functional homolog of the protein sequence given in SEQ ID NO 14719
  misc_feature: Ceres ANNOT ID no. 8733794
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature (107)..(378): SWISSPROT Homolog: EC 3.1.3.16 Phosphoprotein phosphatase
  misc_feature (56)..(363): Pfam ID: PP2C Pfam Description: Protein phosphatase 2C
MAATAAICVDDEATCAAAECAPGVEKLDLAAAGAGADGKAGGSKRSVYLMDCAPVWGCASTRGRSAEMEDACAAFPRFADVPVRLLARRRDLDGLGLDADALRLPAHLFGVFDGHGGAEVANYCRERLQVLLRQELRLLGKDLGETSEVEMKEHWDDLFTRCFQRLDDEVSGQASRLVGGVQESRPVAAENVGSTAVVAVVCSSHVVVANCGDSRVVLCRGKEPVELSIDHKPDRKDERARIEALGGKVIQWNGYRVSGILAMSRSIGDRYLKPFVIPKPEVTVFPRAKDDDCLILASDGLWDVIPNEEACKVARRQIQLWHKNNGVASSLCDEGDESTDPAAQAAADYLMRLALKKGTEDNITVIVVDLKPRKKLKSNS

SEQ ID NO: 19588 - DNA, 2184 bp, Sorghum bicolor
  misc_feature: Ceres ANNOT ID no. 8733806
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 19589
atggctgggcaggctgcgcggcgaggaggaacgatgaggccaccgagcagcggcagcggcatgcgcgcggcggccgcgcggtcgccagccgcctcgttcctgctggccgctgcggcagcggcgtcgctcgtcggagggttctacttctggctggtggtatcgtcgtttcggctccccgactcgggcgccgccgggtgccgccccgacggcgaggggtcgtgggcggtcgggatgttctacggcagcagccctctcgcgctccgtcccatcgagctggaagggagaagcaatgacaacagctcggcgtggccggtggcaaaccccgtgctgacctgcgcgaccccgacggaggcggggtacccgagcaatttcgttgccgacccgttcctctacatcgagggggatacactatatcttttctttgaatcaaaaacaaccacctcaatgcaaggtgatattggagttgcaagaagcttcaaccaaggtgcaacgtgggaatttcttggcattgctctagatgaggcatggcatctgtcatatccttttgtgttcaagtatgagaatgagatttatatgatgccagagggaaacaaaaagaaggagctgcgcctttatcgtgctactaagtttccccttgaatggacattggagaaggttcttgtcaataagccacttattgatgcctcattagtccaatttgagggatactggtggctatttgcctctgattttacacgatatggcgttgagaagaatgcggagcttgagatttggtacagtaactctcctcttggtccttggactgagcacaagcaaaatcctatctacaaatcggacaaaagtttgggagctcgaaatggcgggaggctcttcgtttttgaagggtcattatatcgccctggtcaggattgcagtggtacttatggtcggagggttaagttgtacaaagttgaaaagctaagcaaggaagaatacaaagaggtccctgtaaatcttgggatagaggagccaaagaaagggagaaatgcatggaatggcatgaggtaccatcacatggatgcacaacaacttgcatctggtggatggattgctgtaatggatggtgatcgagtcccttcaggcgattcaaccagacgttctctcattggttacatagctttcctgttggccagtgcccttgtcatttttgtgggttttatgaaaggtgcaatcagttgctacattcctcccagttcatgggttcctcttacaaggagaacagaattatcccgtgtcttctctgtgcaccgcttcaaccagaaagtccgcagatattctaccaatattagcagatatatctctgctactaaaactaagctcagtgaaaagacttggtccaacatgcttttcttctgtgtagttgctctatttggtatcgtgaatgtctgcattgctgtgcatttcttatgtggtggcaatggtgctgaagaggcatacacatatcaagggcaacactctcaattcaccatggtcacaatgacatatgaagctcgtatctggaatttgaaagtattcattgaacactactccagatgtgaatcagttagggagatagttgttgtctggaacaaaggtacccctccaagtagtgatgcatttgactctactgtgcctgtgaggatacgagttgaggagatcaattctcttaacaacagatttagggttgatcctctgataaagacccgtgctgtttttgaactggatgatgatatcatgatgacttgcactgacttagaaaaaggatttagggtctggagagaacaccctgagcggatggtgggcttttacccccggatgatagatggcaaccctatgcaatacaggaatgagaggtatgctaggggtaagaatggctacaatctgatactcacaggtgctgccttcatggacagtgagtttgctttcacgacttactggaatgagaaagctcgtgagggaagggactatgtgcacaagaacttcaactgtgaggacttgctcatgaattttctgtatgcgaatgcaagctccacaaggaccgtggagtatgtccaccctgcatgggctatcgatacatccaagctttcttctgtcaacagattgcttggcaaagttttcctccatatatggtcccctccctcagaaatgggagttcggcatgcgtga

SEQ ID NO: 19589 - protein, 727 aa, Sorghum bicolor
  misc_feature: Useful for making plants with altered carbohydrate content
  misc_feature: Functional homolog of the protein sequence given in SEQ ID NO 13847
  misc_feature: Ceres ANNOT ID no. 8733806
  misc_feature (484)..(694): SWISSPROT Homolog: EC 2.4.1.223 Glucuronyl-galactosyl-proteoglycan 4-alpha-N-acetylglucosaminyltransferase
  misc_feature (501)..(721): Pfam ID: EXTL2 Pfam Description: EXTL2, alpha-1,4-N-acetylhexosaminyltransferase
MAGQAARRGGTMRPPSSGSGMRAAAARSPAASFLLAAAAAASLVGGFYFWLVVSSFRLPDSGAAGCRPDGEGSWAVGMFYGSSPLALRPIELEGRSNDNSSAWPVANPVLTCATPTEAGYPSNFVADPFLYIEGDTLYLFFESKTTTSMQGDIGVARSFNQGATWEFLGIALDEAWHLSYPFVFKYENEIYMMPEGNKKKELRLYRATKFPLEWTLEKVLVNKPLIDASLVQFEGYWWLFASDFTRYGVEKNAELEIWYSNSPLGPWTEHKQNPIYKSDKSLGARNGGRLFVFEGSLYRPGQDCSGTYGRRVKLYKVEKLSKEEYKEVPVNLGIEEPKKGRNAWNGMRYHHMDAQQLASGGWIAVMDGDRVPSGDSTRRSLIGYIAFLLASALVIFVGFMKGAISCYIPPSSWVPLTRRTELSRVFSVHRFNQKVRRYSTNISRYISATKTKLSEKTWSNMLFFCVVALFGIVNVCIAVHFLCGGNGAEEAYTYQGQHSQFTMVTMTYEARIWNLKVFIEHYSRCESVREIVVVWNKGTPPSSDAFDSTVPVRIRVEEINSLNNRFRVDPLIKTRAVFELDDDIMMTCTDLEKGFRVWREHPERMVGFYPRMIDGNPMQYRNERYARGKNGYNLILTGAAFMDSEFAFTTYWNEKAREGRDYVHKNFNCEDLLMNFLYANASSTRTVEYVHPAWAIDTSKLSSVNRLLGKVFLHIWSPPSEMGVRHA

SEQ ID NO: 19590 - DNA, 1251 bp, Sorghum bicolor
  misc_feature: Ceres ANNOT ID no. 8733887
  misc_feature: Encodes the peptide sequence at SEQ ID NO 19591
atggggagggggagcgcgatggcgcaagcccttgcgctcgtcgccttgctcctcgcctgctccgacgtcgccgtcgtcgcggcgcaggagactgagaggatccaagggagtgctggtgatgtgcttgaagatgatcctgtcggaaggctcaaggtatatgtctatgagctgccccccaagtacaacaagaatatactggcaaaggattcgagatgcctcagccacatgtttgctacagagatattcatgcatcgcttcctcttgacgagcgcggtccggactctaaatccggacgaagctgattggttctatactccagtatacacaacgtgcgaccttacaccatggggtcatcccttgactacaaagtctccacgaatgatgagaagtgcgattcagtatatttccaagcgttggccctactggaacaggacggagggagcagaccatttctttgtcacaccacatgactttggagcatgcttctatttccaggaagagacggccatccagcgaggtgtccttccggtgctgcgccgtgctacactggtccagacttttgggcagaagcatcatgtgtgcctgaaggaaggctccatcaccatcccgccgtatgctcctcctcataagatcagaactcacattgttccaccagagacccctcgttcaatctttgtctacttccgtggtctgttctatgacaccgcaaatgatcccgagggtggttactatgcaaggggtgcccgtgcgtcagtatgggagaacttcaagaacaatgctctgttcgacatctccacagaacacccgccaacctactatgaggacatgcagcgtgccatcttctgcctgtgcccactggggtgggcgccatggagtccccgtctagtggaggccgtggtgtttggctgcatccccgtgatcatcgcggacgacatcgtgctcccctttgcggacgcgatcccatgggaggagatcgccgtgttcgtggccgaggacgacgtcctgaagctggacaccatcctgacgtccatacccatggaggagatcctccgcaaacagcggctgctggcgaacccgtcgatgaagcaggcgatgctgttcccgcagcccgcggagccccgggacgcgttccaccaggtgctcaacgggctggcgcggaagctcccccacggcaagggcgtgttcctcaagcccgggcagaaggtgctcaactggaccgaggggacccgggaagacctcaagccgtggtag

SEQ ID NO: 19591 - protein, 416 aa, Sorghum bicolor
  misc_feature: Useful for making plants with altered carbohydrate content
  misc_feature: Functional homolog of the protein sequence given in SEQ ID NO 13639
  misc_feature: Useful for making plants with altered cell wall content and/or composition
  misc_feature: Functional homolog of the protein sequence given in SEQ ID NO 13640
  misc_feature: Ceres ANNOT ID no. 8733887
  misc_feature (52)..(356): Pfam ID: Exostosin Pfam Description: Exostosin family
MGRGSAMAQALALVALLLACSDVAVVAAQETERIQGSAGDVLEDDPVGRLKVYVYELPPKYNKNILAKDSRCLSHMFATEIFMHRFLLTSAVRTLNPDEADWFYTPVYTTCDLTPWGHPLTTKSPRMMRSAIQYISKRWPYWNRTEGADHFFVTPHDFGACFYFQEETAIQRGVLPVLRRATLVQTFGQKHHVCLKEGSITIPPYAPPHKIRTHIVPPETPRSIFVYFRGLFYDTANDPEGGYYARGARASVWENFKNNALFDISTEHPPTYYEDMQRAIFCLCPLGWAPWSPRLVEAVVFGCIPVIIADDIVLPFADAIPWEEIAVFVAEDDVLKLDTILTSIPMEEILRKQRLLANPSMKQAMLFPQPAEPRDAFHQVLNGLARKLPHGKGVFLKPGQKVLNWTEGTREDLKPW

SEQ ID NO: 19592 - DNA, 1227 bp, Sorghum bicolor
  misc_feature: Ceres ANNOT ID no. 8733902
  misc_feature: Encodes the peptide sequence at SEQ ID NO 19593
atggacagcacgagctgcctgctggacgacgcgagcagcggcgcgtccacgggcaacaagaacccggcgccggctccggctgcggcgaccggcggcaagccgctacagcgcgtgggcagcggcgccagcgcggtgatggacgcggcggagccgggcgccgaggcagactccggctcgggcggcgcggggcgcgccaccggaggctgcggcgtggtcagcgggaacgggaagctgccgtcgtccaagtacaagggcgtggtgccgcagcccaacgggcggtggggcgcgcagatctacgagcggcaccagcgcgtgtggctcggcacgttcacgggcgaggccgaggccgcgcgcgcctacgacgtcgccgcgcagcggttccggggacgcgacgccgtcaccaacttccgcccgctggccgagtccgacccggaggccgccgtggagctccggttcctcgcgtcccggaccaaggccgaggtcgtcgacatgctccgcaagcacacctacggtgaggagctcgcgcagaacaggcgcgccttcgccgcagcgtccccggcggcctcgccgccgccggccaagaataataaccccgccgcctcgtcgtcgtcgcccacggcggtcacggcgcgcgagcacctcttcgacaagacggtgacgccgagcgacgtggggaagctgaaccggctggtgataccgaagcagcacgcggagaagcacttcccgctgcagctcccggcggccgccgctgcggtcgtcggcggcgagtgcaagggcgtgctcctcaacttcgaggacgccaccgggaaggtgtggaggttccggtactcgtactggaacagcagccagagctacgtgctgaccaaggggtggagccgcttcgtcaaggagaaggggctccacgccggcgacgccgtcgggttctaccgttccgccggcggcaagcagcagttcttcatcgactgcaagctccggcccaagactactaccacggcagcatccttcgtcaacgcgacgacgaccacggccgcaccttcccccgtgaaagcggtgaggctttttggcgtggacttgctcacgacaccgaggccagggccagcagtggtggcggcgccggagcaggaggagattgccatggcgaacaagagagctagggacgccatcgccgcgtgtactccagtacacatggttttcaagaagcaatgcatatacttcgcgctgacctag

SEQ ID NO: 19593 - protein, 408 aa, Sorghum bicolor
  misc_feature: The sequence is a functional homolog of SEQ ID NO 48 in the 10/838,616 US patent application
  misc_feature: The sequence is a functional homolog of SEQ ID NO 1179 in the 10/374,780 US patent application
  misc_feature: The sequence is a functional homolog of SEQ ID NO 34 in the 10/838,616 US patent application
  misc_feature: The sequence is a functional homolog of SEQ ID NO 52 in the 10/838,616 US patent application
  misc_feature: The sequence is a functional homolog of SEQ ID NO 736 in the 11/435,388 US patent application
  misc_feature: The sequence is a functional homolog of SEQ ID NO 1178 in the 10/374,780 US patent application
  misc_feature: The sequence is a functional homolog of SEQ ID NO 1374 in the 10/412,699 US patent application
  misc_feature: The sequence is a functional homolog of SEQ ID NO 53 in the 10/838,616 US patent application
  misc_feature: The sequence is a functional homolog of SEQ ID NO 1186 in the 10/374,780 US patent application
  misc_feature: The sequence is a functional homolog of SEQ ID NO 38 in the 10/838,616 US patent application
  misc_feature: The sequence is a functional homolog of SEQ ID NO 740 in the 11/435,388 US patent application
  misc_feature: The sequence is a functional homolog of SEQ ID NO 50 in the 10/838,616 US patent application
  misc_feature: The sequence is a functional homolog of SEQ ID NO 36 in the 10/838,616 US patent application
  misc_feature: The sequence is a functional homolog of SEQ ID NO 738 in the 11/435,388 US patent application
  misc_feature: The sequence is a functional homolog of SEQ ID NO 1185 in the 10/374,780 US patent application
  misc_feature: The sequence is a functional homolog of SEQ ID NO 40 in the 10/838,616 US patent application
  misc_feature: The sequence is a functional homolog of SEQ ID NO 742 in the 11/435,388 US patent application
  misc_feature: Useful for making plants with altered alkaloid content
  misc_feature: Useful for making plants with altered lignin content
  misc_feature: Functional homolog of the protein sequence given in SEQ ID NO 13939
  misc_feature: The sequence is a functional homolog of SEQ ID NO 1184 in the 10/374,780 US patent application
  misc_feature: The sequence is a functional homolog of SEQ ID NO 24 in the 10/838,616 US patent application
  misc_feature: The sequence is a functional homolog of SEQ ID NO 758 in the 11/435,388 US patent application
  misc_feature: The sequence is a functional homolog of SEQ ID NO 1182 in the 10/374,780 US patent application
  misc_feature: The sequence is a functional homolog of SEQ ID NO 18 in the 10/838,616 US patent application
  misc_feature: The sequence is a functional homolog of SEQ ID NO 754 in the 11/435,388 US patent application
  misc_feature: The sequence is a functional homolog of SEQ ID NO 1183 in the 10/374,780 US patent application
  misc_feature: The sequence is a functional homolog of SEQ ID NO 22 in the 10/838,616 US patent application
  misc_feature: The sequence is a functional homolog of SEQ ID NO 756 in the 11/435,388 US patent application
  misc_feature: Useful for making plants with modulated water use efficiency
  misc_feature: Functional homolog of the protein sequence given in SEQ ID NO 14443
  misc_feature: The sequence is a functional homolog of SEQ ID NO 26 in the 10/838,616 US patent application
  misc_feature: The sequence is a functional homolog of SEQ ID NO 760 in the 11/435,388 US patent application
  misc_feature: Useful for making plants with altered protein content
  misc_feature: Useful for making plants with altered terpenoid content
  misc_feature: Functional homolog of the protein sequence given in SEQ ID NO 13938
  misc_feature: The sequence is a functional homolog of SEQ ID NO 44 in the 10/838,616 US patent application
  misc_feature: The sequence is a functional homolog of SEQ ID NO 46 in the 10/838,616 US patent application
  misc_feature: The sequence is a functional homolog of SEQ ID NO 1258 in the 11/479,226 US patent application
  misc_feature: The sequence is a functional homolog of SEQ ID NO 138 in the 10/225,068 US patent application
  misc_feature: The sequence is a functional homolog of SEQ ID NO 170 in the 10/374,780 US patent application
  misc_feature: The sequence is a functional homolog of SEQ ID NO 2 in the 10/838,616 US patent application
  misc_feature: The sequence is a functional homolog of SEQ ID NO 208 in the 11/375,241 US patent application
  misc_feature: The sequence is a functional homolog of SEQ ID NO 580 in the 10/412,699 US patent application
  misc_feature: The sequence is a functional homolog of SEQ ID NO 630 in the 11/435,388 US patent application
  misc_feature: The sequence is a functional homolog of SEQ ID NO 796 in the 10/225,066 US patent application
  misc_feature: The sequence is a functional homolog of SEQ ID NO 1892 in the 10/412,699 US patent application
  misc_feature: The sequence is a functional homolog of SEQ ID NO 32 in the 11/375,241 US patent application
  misc_feature: The sequence is a functional homolog of SEQ ID NO 370 in the 10/374,780 US patent application
  misc_feature: The sequence is a functional homolog of SEQ ID NO 420 in the 10/225,066 US patent application
  misc_feature: The sequence is a functional homolog of SEQ ID NO 550 in the 11/435,388 US patent application
  misc_feature: The sequence is a functional homolog of SEQ ID NO 78 in the 10/225,068 US patent application
  misc_feature: The sequence is a functional homolog of SEQ ID NO 8 in the 10/838,616 US patent application
  misc_feature: The sequence is a functional homolog of SEQ ID NO 42 in the 10/838,616 US patent application
  misc_feature: The sequence is a functional homolog of SEQ ID NO 1176 in the 10/374,780 US patent application
  misc_feature: The sequence is a functional homolog of SEQ ID NO 1372 in the 10/412,699 US patent application
  misc_feature: The sequence is a functional homolog of SEQ ID NO 30 in the 10/838,616 US patent application
  misc_feature: The sequence is a functional homolog of SEQ ID NO 732 in the 11/435,388 US patent application
  misc_feature: The sequence is a functional homolog of SEQ ID NO 2728 in the 10/374,780 US patent application
  misc_feature: The sequence is a functional homolog of SEQ ID NO 374 in the 10/225,066 US patent application
  misc_feature: The sequence is a functional homolog of SEQ ID NO 396 in the 10/666,642 US patent application
  misc_feature: The sequence is a functional homolog of SEQ ID NO 64 in the 10/838,616 US patent application
  misc_feature: Ceres ANNOT ID no. 8733902
  misc_feature (214)..(328): Pfam ID: B3 Pfam Description: B3 DNA binding domain
  misc_feature (81)..(130): Pfam ID: AP2 Pfam Description: AP2 domain
MDSTSCLLDDASSGASTGNKNPAPAPAAATGGKPLQRVGSGASAVMDAAEPGAEADSGSGGAGRATGGCGVVSGNGKLPSSKYKGVVPQPNGRWGAQIYERHQRVWLGTFTGEAEAARAYDVAAQRFRGRDAVTNFRPLAESDPEAAVELRFLASRTKAEVVDMLRKHTYGEELAQNRRAFAAASPAASPPPAKNNNPAASSSSPTAVTAREHLFDKTVTPSDVGKLNRLVIPKQHAEKHFPLQLPAAAAAVVGGECKGVLLNFEDATGKVWRFRYSYWNSSQSYVLTKGWSRFVKEKGLHAGDAVGFYRSAGGKQQFFIDCKLRPKTTTTAASFVNATTTTAAPSPVKAVRLFGVDLLTTPRPGPAVVAAPEQEEIAMANKRARDAIAACTPVHMVFKKQCIYFALT

SEQ ID NO: 19594 - DNA, 1512 bp, Sorghum bicolor
  misc_feature: Ceres ANNOT ID no. 8734000
  misc_feature: Encodes the peptide sequence at SEQ ID NO 19595
atgccgccgccgctcgaggcgcgcgacttcctcggcgccggcgccacctcgtcgtgctgctcgtcgtcctgctcctccggcggcgatgggacggtgccgcacctcgcgctgcggctcgggctcccggggtccgactcccccggccgaggcgcgcaggcggagcacgcccacgtggacgccgcgctcaccctcggacccacccctgcccccgcgccgcccaggggaggcgccccgcgcgggttcgccgactccctcgaccggtccgcgaagcgggacggtgctgcggcggatgacgacgctgctgggggcgtaactggggaggataagggggtagctgcggccgctgccggagctccgccggctgccaaggcacaagttgttggatggccacctgttaggagctaccgaaagaatacactagctgcaagtgccacaaagacaaaggtggaagatgaaggtaggagtgaggcgggatgctgttatgttaaggtcagcatggatggagccccatacctaaggaaggtagacctcaagacctattcaagctatgagaatctctcgcttggtctggagaaaatgttcagctgcttcatcactggtcaaaacagttcttgcaagacatcaagaagggataggtttactgatggttctagggctgatgcccttcaggaccaagaatatgtccttacttacgaagataaagatgctgactggatgcttgttggtgatctgccctgggacttgttcaccacaatttgtcggaaactaagaatcatgagaggctctgatgctgctggcatgggacggacgggaccgaccctgtccctggggggctgggggcaccgcgcgcggcagcccacagcctggtggtggtggcgaccggatcaccaggcgtccaggcccaaggggaccaaaacggcacggcagcaacagcacagaccgaggaccactgcgacctcgacgacacatggctcgggagcctcgggctccggtcgtggcctcgacctgacccagcgtccgcgccgagccgcctctttcaagccgcggaaacgaagaaacgaacgagaaccggtcgaggcgcgacgcgaacgccgacggcgacgccaccgtgctttcaccgtctcaggcgcctgcgcctgctggctcgatcgcggtcgcggacgccgcggcaacagggcgcgaccggagcacatgtgcatgtggccgcgcgcgggacgtgtcgatgcgcgcgcgcgcgcgtgcgtacgttctggttctgctgcggtgcacgagagcggggccaggacctccagcgccatcgggttcggtgggcgaccgcgacgggaacacggccagttgcgcgccatgactcgcagagccgcggccacggacagccccagtgggcgggcacccgccggtcacatggccgcggggccccgcctgcttgtgcctacggccgccgtccccgtccgcgcccggtgcgtgccgttgccatgccgggagtatcggcgggcgaagcgaaaccggggctga

SEQ ID NO: 19595 - protein, 503 aa, Sorghum bicolor
  misc_feature: Useful for making plants with altered terpenoid content
  misc_feature: Functional homolog of the protein sequence given in SEQ ID NO 13610
  misc_feature: Useful for making plants with altered alkaloid content
  misc_feature: Functional homolog of the protein sequence given in SEQ ID NO 13611
  misc_feature: The sequence is a functional homolog of SEQ ID NO 652 in the 11/479,226 US patent application
  misc_feature: Ceres ANNOT ID no. 8734000
  misc_feature (37)..(270): Pfam ID: AUX_IAA Pfam Description: AUX/IAA family
MPPPLEARDFLGAGATSSCCSSSCSSGGDGTVPHLALRLGLPGSDSPGRGAQAEHAHVDAALTLGPTPAPAPPRGGAPRGFADSLDRSAKRDGAAADDDAAGGVTGEDKGVAAAAAGAPPAAKAQVVGWPPVRSYRKNTLAASATKTKVEDEGRSEAGCCYVKVSMDGAPYLRKVDLKTYSSYENLSLGLEKMFSCFITGQNSSCKTSRRDRFTDGSRADALQDQEYVLTYEDKDADWMLVGDLPWDLFTTICRKLRIMRGSDAAGMGRTGPTLSLGGWGHRARQPTAWWWWRPDHQASRPKGTKTARQQQHRPRTTATSTTHGSGASGSGRGLDLTQRPRRAASFKPRKRRNEREPVEARRERRRRRHRAFTVSGACACWLDRGRGRRGNRARPEHMCMWPRAGRVDARARACVRSGSAAVHESGARTSSAIGFGGRPRREHGQLRAMTRRAAATDSPSGRAPAGHMAAGPRLLVPTAAVPVRARCVPLPCREYRRAKRNRG

SEQ ID NO: 19596 - DNA, 1101 bp, Sorghum bicolor
  misc_feature: Ceres ANNOT ID no. 8734027
  misc_feature: Encodes the peptide sequence at SEQ ID NO 19597
atggtggcgatcacggcgccgagctcgatcgagcagatcccgctggtgcagtgtcccagggccaatgcgagcgcggccatcccgtgcgtggacctgtcggcgccgggcgcggccgcggcggtggccgacgcgtgccgcggcgtgggcttcttcagggcgaccaaccacggcgtgccggcgcgcgtggtcgaggcgctggaggcccgcgcgatggcgttcttcgcgctgcccgcccaggagaagctggacatgtccggcgccgctcgccccatggggtacggcagcaagcgcatcggctccaacggcgacgtcgggtggctcgagtacctcctcctctccgtcagcgccaacaccgtcaagatctcctccctgccgccctcgctccgagcggcattggaggagtacacggcggcggtgagggaggtgtgcgggcgggtgctggagctcatagcggaggggctgggcgtggacaggtccctgctgcgtgcgatggtggtggggcgggaaggcagcgacgagctggtgcgggtgaaccactacccgccctgcccgctgctgccgccggtggactgcggcgtgacggggttcggggagcacacggacccgcagatcatctccgtgctcaggtccaacagcacggctggcctgcagatcaagctccgggacggcaggtgggtccccgtgccccccgccccggaatccttcttcgtcaacgtcggagacgcgctgcaggtcctgacgaacgggcggttcaagagcgtgaagcaccgggtggtggcgccggaaggggcgcagtcacggctgtcggtgatctacttcggcgggccggcgccgtcgcagcggatcgcgccgctgccggaggtgatgcgggacggggagcagagcctgtaccgggagttcacctgggccgagtacaagaccgccatgtacaagacccgcctcgccgaccaccgcctcggccccttcgagctgcgcgccaccaacaccaacagctgcgtgccgccgccgccgccgcccagcgtcgacccgtactgcaacggcagcggcatctgcatgccgcagccgccgccgcagcagcagcaggtggcagaggtgcactag

SEQ ID NO: 19597 - protein, 366 aa, Sorghum bicolor
  misc_feature: The sequence is a functional homolog of SEQ ID NO 4 in US patent 7154028
  misc_feature: The sequence is a functional homolog of SEQ ID NO 2 in US patent 7262340
  misc_feature: Ceres ANNOT ID no. 8734027
  misc_feature (1)..(328): SWISSPROT Homolog: EC 1.14.11.13 Gibberellin 2-beta-dioxygenase
  misc_feature (171)..(276): Pfam ID: 2OG-FeII_Oxy Pfam Description: 2OG-Fe(II) oxygenase superfamily
MVAITAPSSIEQIPLVQCPRANASAAIPCVDLSAPGAAAAVADACRGVGFFRATNHGVPARVVEALEARAMAFFALPAQEKLDMSGAARPMGYGSKRIGSNGDVGWLEYLLLSVSANTVKISSLPPSLRAALEEYTAAVREVCGRVLELIAEGLGVDRSLLRAMVVGREGSDELVRVNHYPPCPLLPPVDCGVTGFGEHTDPQIISVLRSNSTAGLQIKLRDGRWVPVPPAPESFFVNVGDALQVLTNGRFKSVKHRVVAPEGAQSRLSVIYFGGPAPSQRIAPLPEVMRDGEQSLYREFTWAEYKTAMYKTRLADHRLGPFELRATNTNSCVPPPPPPSVDPYCNGSGICMPQPPPQQQQVAEVH

SEQ ID NO: 19598 - DNA, 180 bp, Sorghum bicolor
  misc_feature: Ceres ANNOT ID no. 8734024
  misc_feature: Encodes the peptide sequence at SEQ ID NO 19599
atggttagatttctcacaaaatttaccatcccaacattgacaagcattcaggcacttctgagcgccccaaatccagatgatcctctctcagacaacattgcgagacactggaaatccaatgaagctgaagctgttgagacagcgaaggagtggactcgcctgtatgcaagtggggcatga

SEQ ID NO: 19599 - protein, 59 aa, Sorghum bicolor
  misc_feature: Useful for biocontainment applications
  misc_feature: Functional homolog of the protein sequence given in SEQ ID NO 13996
  misc_feature: Ceres ANNOT ID no. 8734024
  misc_feature (13)..(56): SWISSPROT Homolog: EC 6.3.2.19 Ubiquitin--protein ligase
MVRFLTKFTIPTLTSIQALLSAPNPDDPLSDNIARHWKSNEAEAVETAKEWTRLYASGA

SEQ ID NO: 19600 - DNA, 972 bp, Sorghum bicolor
  misc_feature: Ceres ANNOT ID no. 8734039
  misc_feature: Encodes the peptide sequence at SEQ ID NO 19601
atgacgtggtgcaatggtttcaacgacgtgcgcgccgccgtggagagcagcctgtctccggccgccgccgccgtgggcaagaaggcggcggcgtcgctcgccgtcctcgtcaagatgtgcccctcgtgcggccaccgcgcgcagtatgagcaggagagcacgacgatccaggacttgccggggctgccggccggcgtgaagtttgacccgacggaccaggagctgctggagcacttggaggggaaggcgaggcccgacacccggaagctccaccctctcgtcgacgagttcatccccaccatcgacggcgagaacggcatctgctacacgcacccggaaaatctccctggtgtgagcaaggacgggcttgtccggcacttcttccaccggccgtccagggcgtacacgacggggacgaggaagcggcggaaggtgcacagcggcgacggcgacgacggcggcggggagacgcggtggcacaagacgggcaagacgaggccggtgctgtccaacggcaggccgcgcgggtacaagaagatcctggtgctctacaccaactacggcaagcagcgcaagcccgagaagaccaactgggtgatgcaccagtaccacctcggctccgacgaggaggagcgcgacggcgagctcgtcgtctctaaggtcttcttccagacgcagcccaggcagtgcggctccgccatggccaggcaggaagccggcgtcgtccctgccgccgccttcaccggcagcagcgacgcgcttattgccgtcggtcatcaccagggtggtggcggtggcggcggcctcagggaagcaaacggcggcgttgatcagttctacagcccaggagcaatgatggggtatggccagggcgtcccagcaggtaacagggcacctcctgcccctgctgctgctccccatttcatgcctaactttgctgtgcatgcagcaagagctagctttggcccttga

SEQ ID NO: 19601 - protein, 323 aa, Sorghum bicolor
  misc_feature: Useful for making plants with altered carbohydrate content
  misc_feature: Functional homolog of the protein sequence given in SEQ ID NO 14394
  misc_feature: The sequence is a functional homolog of SEQ ID NO 210 in the 10/666,642 US patent application
  misc_feature: The sequence is a functional homolog of SEQ ID NO 562 in the 11/435,388 US patent application
  misc_feature: The sequence is a functional homolog of SEQ ID NO 542 in the 10/666,642 US patent application
  misc_feature: The sequence is a functional homolog of SEQ ID NO 1710 in the 10/374,780 US patent application
  misc_feature: The sequence is a functional homolog of SEQ ID NO 318 in the 10/374,780 US patent application
  misc_feature: The sequence is a functional homolog of SEQ ID NO 848 in the 10/225,066 US patent application
  misc_feature: The sequence is a functional homolog of SEQ ID NO 1713 in the 10/374,780 US patent application
  misc_feature: Ceres ANNOT ID no. 8734039
  misc_feature (62)..(206): Pfam ID: NAM Pfam Description: No apical meristem (NAM) protein
MTWCNGFNDVRAAVESSLSPAAAAVGKKAAASLAVLVKMCPSCGHRAQYEQESTTIQDLPGLPAGVKFDPTDQELLEHLEGKARPDTRKLHPLVDEFIPTIDGENGICYTHPENLPGVSKDGLVRHFFHRPSRAYTTGTRKRRKVHSGDGDDGGGETRWHKTGKTRPVLSNGRPRGYKKILVLYTNYGKQRKPEKTNWVMHQYHLGSDEEERDGELVVSKVFFQTQPRQCGSAMARQEAGVVPAAAFTGSSDALIAVGHHQGGGGGGGLREANGGVDQFYSPGAMMGYGQGVPAGNRAPPAPAAAPHFMPNFAVHAARASFGP

SEQ ID NO: 19602 - DNA, 2124 bp, Sorghum bicolor
  misc_feature: Ceres ANNOT ID no. 8734042
  misc_feature: Encodes the peptide sequence at SEQ ID NO 19603
atggcggggatcgacctcaacgacaccgtggaggaggacgaggaggaggcggagcccggcaaccccgcctgctcccagcaaagccggaccagctccgcggccacgcccccacccccgccgctgaccccgctgctccagccgaggccgggcgccgcggtgtgcctcgagctctggcacgcctgcgccggccccgtcgcgccgctgccgcggaaagggaccgtcgtcgtctacctcccgcagggacacctggagcacctcggtgacgccgccgcggccgcagccggaggcgcgccggcgcccgccgccctgccgccccacgtcttctgccgcgtcgtcgacgtcactctccatgcggacgcgtccacggacgaggtgtacgcccagctcgccctcgtcgccgagaacgaggatgtcgcgaggcggctgcgcggagggtccgaggacgggagcgctggggacggcgacgacggggaggccgtgaagcagcggttctcgcggatgccgcacatgttctgcaagacgctcacggcctccgacaccagcacgcacggcggcttctccgtgccgcgccgcgccgccgaggactgcttcccgcctctggactacagccagcagcggccgtcgcaggagcttgtcgccaaggatttgcacggaaccgagtggaggttccgccacatttatcgaggccagccccgcaggcaccttttaaccactggatggagtgcatttgtcaacaagaagaagcttgtctcaggggacgctgtactatttttgagaggtgatgatggggagctaagacttggagtgcgccgtgcagctcagcttaaaaatggatctgcttttccagctctttataatcagtgttctaatcttggttcactagctaacgtagcacatgctgtggccacaaaaagcgtgttccacatctactacaaccccagattaagccaatctgaattcattataccgtattcaaagtttatgaagagcttcagtcaacaattttctgctggtttgaggttcaaaatgagatatgagagtgatgatgcttctgaaagaagatgcactggggtaatagcaggaattggtgatgctgaccccatgtggcgtggttcgaagtggaaatgtttgatggtccgatgggatgatgatgtagattttcgtcgaccgaacaggatttctccttgggagattgagctgactagttcagtttcaggatcccatctgtctgcaccaaatgcaaagagactcaaaccatgtcttcccccggactacctagttccaaatggaagtggttgtcctgattttgcggaatctgcccaattccacaaggtcttgcaaggtcaagaattattgggttatagaactcgtgacaatgctgctgttgcaacttctcaaacaccactaggaaaccctaggttttcctaccattgctcaggctttggggagtctccaagattccaaaaggtcttgcaaggtcaagaagtatttcaaccctaccgaggaactctagtcgatccaagtttgagaaatagtggctttcatcagcaagatggttctcatgtgcctactcaagcgaataagtggcatccacagcttcatgggtgtgcttttcgtgggacacaagcaccagctattccatctcaatcctcatcgccaccatctgtcctaatgtttcaacgagataatccaaagatgtccccttttgaatttgggcattgtcacatggataagaatgaggatatgcgtgcaatgtttggccatgctggaggtattggaagaactgagcaaacaatgatgctccaggctcataatgtttctggaggaatgggaaatagagatgtgaccgttgagaaatttcagcccactgttgctgttggaagggatggatcagacaacagggaagttaccaaaaatagttgcaaaatatttggcatatctttgactgagaaggttccagcaatcaaagaaaaggactgtggtgataccaactatccatcccccttcctgtctttgaagcaacacgtgccaaaatcgctgggcaacagttgtgccactattcatgagcagaggcctgttgttggtagggtgattgatgtttcaacagtggatatgatgatctga

SEQ ID NO: 19603 - protein, 707 aa, Sorghum bicolor
  misc_feature: The sequence is a functional homolog of SEQ ID NO 696 in the 11/479,226 US patent application
  misc_feature: The sequence is a functional homolog of SEQ ID NO 2380 in the 10/374,780 US patent application
  misc_feature: The sequence is a functional homolog of SEQ ID NO 962 in the 10/225,066 US patent application
  misc_feature: Ceres ANNOT ID no. 8734042
  misc_feature (297)..(378): Pfam ID: Auxin_resp Pfam Description: Auxin response factor
  misc_feature (170)..(275): Pfam ID: B3 Pfam Description: B3 DNA binding domain
MAGIDLNDTVEEDEEEAEPGNPACSQQSRTSSAATPPPPPLTPLLQPRPGAAVCLELWHACAGPVAPLPRKGTVVVYLPQGHLEHLGDAAAAAAGGAPAPAALPPHVFCRVVDVTLHADASTDEVYAQLALVAENEDVARRLRGGSEDGSAGDGDDGEAVKQRFSRMPHMFCKTLTASDTSTHGGFSVPRRAAEDCFPPLDYSQQRPSQELVAKDLHGTEWRFRHIYRGQPRRHLLTTGWSAFVNKKKLVSGDAVLFLRGDDGELRLGVRRAAQLKNGSAFPALYNQCSNLGSLANVAHAVATKSVFHIYYNPRLSQSEFIIPYSKFMKSFSQQFSAGLRFKMRYESDDASERRCTGVIAGIGDADPMWRGSKWKCLMVRWDDDVDFRRPNRISPWEIELTSSVSGSHLSAPNAKRLKPCLPPDYLVPNGSGCPDFAESAQFHKVLQGQELLGYRTRDNAAVATSQTPLGNPRFSYHCSGFGESPRFQKVLQGQEVFQPYRGTLVDPSLRNSGFHQQDGSHVPTQANKWHPQLHGCAFRGTQAPAIPSQSSSPPSVLMFQRDNPKMSPFEFGHCHMDKNEDMRAMFGHAGGIGRTEQTMMLQAHNVSGGMGNRDVTVEKFQPTVAVGRDGSDNREVTKNSCKIFGISLTEKVPAIKEKDCGDTNYPSPFLSLKQHVPKSLGNSCATIHEQRPVVGRVIDVSTVDMMI

SEQ ID NO: 19604 - DNA, 837 bp, Sorghum bicolor
  misc_feature: Ceres ANNOT ID no. 8734046
  misc_feature: Encodes the peptide sequence at SEQ ID NO 19605
atggcacgcctcgccatcctgttggtgctcctggcgtcgtcgtcggcgctgtccgcggcgcagaaagccgcgacgaccaaggcgccggcgacggcgaaggccgcgccaggtccagcagcgtcgtcgtcgggcggcggcgcggcggacgcggcgccaccgacggacatcaacaaggcgctcaaggacgagcagttcagcgagttcaagcagctgctccacgacacgcgcgtggacacgcagatcaacgcgcagctgacggacagctacaacgggctgaccatcatggcgcccaccaacacggcgttcgacaagatgaaggccggcgtgctcaacgggctgtcgccgcaggagcagatccagatggtgctctactgcgtgctgccgcgcttctacagcctctccatgctcggcaccctcgacggcaaggtcaacacgcagggctccggccacgacgggccttacaagtacgacatcaagcggtcgggcaacaacgtcaacatgtccacgggcgtcaactggatgctgctgggcagccccgtcagcaaggaattcccgctcgccatctaccccgtcgacaaggtgccgctcccctacgagctgttcggccccaagccgcccacgccggcgcccgcgcccgcacccgcgccggccaagtccaagaccaagaagaagaagaagtccgcgggcatcgccgagccgcccaccgccgacgacgacacctctacctccgacgaccagaaggcggcggccgcgcccggcgttggcgcgcccaccaggtgggtcactgccgcgctctccgtgctcggcgccgctgtcctcggcggcggcctcttctaa

SEQ ID NO: 19605 - protein, 278 aa, Sorghum bicolor
  misc_feature: Useful for making plants with altered carbohydrate content
  misc_feature: Functional homolog of the protein sequence given in SEQ ID NO 14720
  misc_feature: Ceres ANNOT ID no. 8734046
  misc_feature (64)..(197): Pfam ID: Fasciclin Pfam Description: Fasciclin domain
MARLAILLVLLASSSALSAAQKAATTKAPATAKAAPGPAASSSGGGAADAAPPTDINKALKDEQFSEFKQLLHDTRVDTQINAQLTDSYNGLTIMAPTNTAFDKMKAGVLNGLSPQEQIQMVLYCVLPRFYSLSMLGTLDGKVNTQGSGHDGPYKYDIKRSGNNVNMSTGVNWMLLGSPVSKEFPLAIYPVDKVPLPYELFGPKPPTPAPAPAPAPAKSKTKKKKKSAGIAEPPTADDDTSTSDDQKAAAAPGVGAPTRWVTAALSVLGAAVLGGGLF

SEQ ID NO: 19606 - DNA, 3183 bp, Sorghum bicolor
  misc_feature: Ceres ANNOT ID no. 8734055
  misc_feature: Encodes the peptide sequence at SEQ ID NO 19607
atggcggggaacgactggatcaacagctacctggaggccatcctggacgcgggcggggccgcgggagaaatctcagcagccgcaggcagcgggggcggtggcgacgggacggccggggagaagcgggataagtcgtcgctgatgctccgggagcgcggccggttcagccccgcgcgatacttcgtcgaggaggtcatctccggcttcgacgagaccgacctctacaagacctgggtccgcacgtcggctatgaggagtccccaggagcggaacacgcggctggagaacatgtcgtggaggatctggaacctcgtcaggaagaagaagcagatagaaggagaggaagcctctcgcttgtctaaacgacgcatggaacttgagaaagctcgtcaatatgctgctactgatttgtctgaagacctatctgaaggcgaaaaaggagaaacaaataatgaaccatctattcatgatgagagcatgaggacgcggatgccaaggattggttcaactgatgctattgagacatgggcaaaccagcacaaagataaaaagttgtacatagtattgataagcattcatggtcttatacgcggggagaatatggagctggggcgcgattcagatacaggtggtcaggtgaaatatgttgtagaacttgctagggctttaggttcaacaccaggagtatacagagtggatctactaacaaggcaaatttctgcacctgatgttgattggagttatggggaacctactgagatgctcagtccaataagttcagagaactttgggcatgagctaggcgaaagcagtggtgcctatattgtccggataccatttggaccaagagacaaatatatccctaaagagcatctatggcctcacatccaggaatttgttgatggcgcacttgtccatatcatgcagatgtccaaggttcttggagaacaaattggtagtgggcaaccagtatggccagttgttatacatggacactatgctgatgctggtgattctgctgctttactgtctggggcactcaatgtacccatggtattcactggtcattctcttggcagagacaagttggagcagattttgaagcaagggcgtcaaaccagggatgaaataaatgcaacctataagataatgcgtcgaattgaggctgaggaactttgccttgatgcatctgaaatcataattacaagcaccaggcaagaaatagaacaacaatggggattatatgatggttttgatctaactatggctcggaaactcagagcaagaataaaacgtggtgtgagctgctttggtcgttacatgccccgtatgattgcaatacctcctggcatggagtttagtcatatagcaccacatgatgttgatcaggacagtgaggaaggaaatgaagatggctcaggttcaccggatccacctatttgggctgatataatgcggttcttctcaaacccccgtaagcccatgattcttgctcttgctcgtccggacccgaagaagaatatcactactctagtcaaagcatttggtgaacatcgtgaactgagaaatttagcaaatcttacactgatcatgggcaatcgtgatgtcattgatgaaatgtcaagcacaaatgcagctgttttgacttcagtactcaagttaattgataaatacgatctatatggacaagtggcataccccaagcaccacaagcaatttgaagttcctgatatttatcgtttagctgcaagaacaaaaggagtttttatcaattgtgcattcattgaaccatttggactcaccttgattgaggctgctgcttatggtctacccatggttgccacccgaaatggtgggcctgtggacatacatcgggttcttgataatggaattcttgttgacccccacaatcaaaatgaaataggtgaggcactttataagcttgtgtcagataagcaattgtggacacgatgtcgccagaatggtctgaaaaacatccatcaattttcgtggcctgaacattgcaagaactatttggcacgtgtagtcactctcaagcctagacatccccgctggcaaaagaatgatgttgcaactgaaatatctgaagcagactcacctgaggactctctgagggatatccatgacatatcacttaacttgaagctttccttggacagtgaaaaatcaggcagcaaagaagggaattcaaatactgtgagaaggcatttggaggatgcagtgcaaaagttgtcaggtgttagtgacatcaaaaaggatgggccaggtgagaatggtaagtggccatcattgcgtaggaggaagcacatcattgtaattgctgtagactctgtgcaagatgcagactttgttcaggttattaaaagtatttttgaggcttcaagcaatgagagatcaaatggctctgttggttttgtattgtcaacggctagagcaatatcagagatacatgctttgcttatatctggagggatagaagctagtgactttgacgccttcatatgcaacagtggcagtgatctttgttatccatcttcaaactctgaggacatgcttagccctgctgagctcccattcatgattgatcttgattatcactcccaaattgaatatcgctggggaggagaaggtttaaggaagacactaattcgttgggcgtctgagaaaaataatgaaagtggacaaaaaatacttgttgaggatgaagaatgctcatccacttactgcatttcatttaaagtgtccaatactgcagctgcacctcctgtgaaggagattaggaggacaatgagaattcaagcactgcgctgccatgttttgtacagccatgatggtagcaagctgaacgtaattcctgttttggcttctcgctcacaggctttaaggtatttgtatatcagatggggggtagagctgtcaaacatcactgtggttgtcggtgaatgtggtgacacagattatgaaggactacttggaggcgtgcacaaaactatcatactcaaaggctcgttcaatactgctccaaaccaagtccatgctaacagaagctattcattccaagatgttgtatcccttgagaaacaaggaattgcttcaattgagggatatggtccagacaatctaaaatcagctctaaggcaatttggtatatcgaaagactaa

SEQ ID NO: 19607 - protein, 1060 aa, Sorghum bicolor
  misc_feature: Useful for making plants with altered cell wall content and/or composition
  misc_feature: Useful for making plants with modulated biomass
  misc_feature: Useful for making plants with modulated carbohydrate content
  misc_feature: Functional homolog of the protein sequence given in SEQ ID NO 13827
  misc_feature: Useful for making plants with altered carbohydrate content
  misc_feature: Functional homolog of the protein sequence given in SEQ ID NO 13828
  misc_feature: Ceres ANNOT ID no. 8734055
  misc_feature (44)..(1059): SWISSPROT Homolog: EC 2.4.1.14 Sucrose-phosphate synthase
  misc_feature (482)..(665): Pfam ID: Glycos_transf_1 Pfam Description: Glycosyl transferases group 1
  misc_feature (774)..(1026): Pfam ID: S6PP Pfam Description: Sucrose-6F-phosphate phosphohydrolase
MAGNDWINSYLEAILDAGGAAGEISAAAGSGGGGDGTAGEKRDKSSLMLRERGRFSPARYFVEEVISGFDETDLYKTWVRTSAMRSPQERNTRLENMSWRIWNLVRKKKQIEGEEASRLSKRRMELEKARQYAATDLSEDLSEGEKGETNNEPSIHDESMRTRMPRIGSTDAIETWANQHKDKKLYIVLISIHGLIRGENMELGRDSDTGGQVKYVVELARALGSTPGVYRVDLLTRQISAPDVDWSYGEPTEMLSPISSENFGHELGESSGAYIVRIPFGPRDKYIPKEHLWPHIQEFVDGALVHIMQMSKVLGEQIGSGQPVWPVVIHGHYADAGDSAALLSGALNVPMVFTGHSLGRDKLEQILKQGRQTRDEINATYKIMRRIEAEELCLDASEIIITSTRQEIEQQWGLYDGFDLTMARKLRARIKRGVSCFGRYMPRMIAIPPGMEFSHIAPHDVDQDSEEGNEDGSGSPDPPIWADIMRFFSNPRKPMILALARPDPKKNITTLVKAFGEHRELRNLANLTLIMGNRDVIDEMSSTNAAVLTSVLKLIDKYDLYGQVAYPKHHKQFEVPDIYRLAARTKGVFINCAFIEPFGLTLIEAAAYGLPMVATRNGGPVDIHRVLDNGILVDPHNQNEIGEALYKLVSDKQLWTRCRQNGLKNIHQFSWPEHCKNYLARVVTLKPRHPRWQKNDVATEISEADSPEDSLRDIHDISLNLKLSLDSEKSGSKEGNSNTVRRHLEDAVQKLSGVSDIKKDGPGENGKWPSLRRRKHIIVIAVDSVQDADFVQVIKSIFEASSNERSNGSVGFVLSTARAISEIHALLISGGIEASDFDAFICNSGSDLCYPSSNSEDMLSPAELPFMIDLDYHSQIEYRWGGEGLRKTLIRWASEKNNESGQKILVEDEECSSTYCISFKVSNTAAAPPVKEIRRTMRIQALRCHVLYSHDGSKLNVIPVLASRSQALRYLYIRWGVELSNITVVVGECGDTDYEGLLGGVHKTIILKGSFNTAPNQVHANRSYSFQDVVSLEKQGIASIEGYGPDNLKSALRQFGISKD

SEQ ID NO: 19608 - DNA, 1902 bp, Sorghum bicolor
  misc_feature: Ceres ANNOT ID no. 8734071
  misc_feature: Encodes the peptide sequence at SEQ ID NO 19609
atggctggcttggctctatataaatattcggtgccaactgtgggagaggtgatcattagccttggtaaagggtttgagagatcaggagttctttggccggtcgcaaaggtcaatctgggttgggtcggagggggtagatgctgcagagcttttgcgtttgagttggttggattacttgccatcagtttgtcgaattcaccagagatggaattcttcagcgaatacggcgatgccaacagatacaggattcaggaaatcattggcaaaggaagttatggggttgtttgttcagctattgaccgacataccggtgagaaggtagcgatcaagaagatacagaatatcttcgagcatctgtccgacgctgctaggatcctccgtgagatcaagcttctccggctgctaaggcatcctgatattgttgagatcaaacatgtcatgttacctccatcgaggagggactacagagatatttatgttgtatttgaactgatggatactgaccttcaccaagttattaaggctaacgatgacttgacaaaggaacaccaccagttctttctctatcaaatgctgcgtgcgctgaaatatattcatactgctaatgtttatcatcgtgatttaaagccaaaaaatatattagcaaatgctaactgcaaactcaagatatgtgattttgggctagcaagggttgcatttaatgactctcctaccacagttttctggacggactatgttgctaccagatggtacagggctcctgagctgtgtggatctttctttagtaagtattcaccggctattgatatgtggagcatcggttgcatttttgcggagattttgactgggaagcctttattccctggtaaaaatgtggttcaccagttggatttgatgactgatctcctgggcacaccatcagcagaaactatttcacagattcgaaatgagaaagcaaggaggtatctgagcagcatgaggaggaaacagccaatacccttttcagagaagttccccaatgcagatccttcggcgctaaagctcttacaaaggcttctagcatttgatcctaaggatcgaccaacggctgaagaggcgttggctgattcctattttaaaggcattgcaaaagtggagagggaaccatcctgtcagccaatttcgaaaatggaatttgagtttgaacagaagtttaccaaagaggacgtcaaggaacttatattccaggagatactgcagtaccatcctcaacttctgaaggattacaagaatggctctgaaaaaacgagctttctatatcccaggttccgtagacaatttgctagcttagaagaaaatggagggaggaatgccacacttgataggaagcatgaatctctcccaaggacaactaccgttcactccactacaattcctgcaaaggaaggcccagcagctacctcccaggtcgctcaaaggattccagcagctagaccaggaagagtggtaggtccagtattaccattcgagagtgcaagcgtcactgatcaacacatcgcgcgacgggtggcaaggaatcaagctgttcctccagcaaccaacacctcgtcagtctactgctaccacctgaaatcagacagctctgacaggcaggagcatcaggtagagcgtgagaaagaccggaggcagtataggcaagggcagcatctcatggatgccaaggtagcacctgagatgggccgggacatacgcccatcacagtactatgtctcaaggggcatgcccaaagctgatctaacagacagggccactctccataggagcacgctgcacggcgttgctcccttcaatagcatcgcagcggtcgctggtgggtacagtcaggccagtgttcttcactacggagttacaagtttgtactag

SEQ ID NO: 19609 - protein, 633 aa, Sorghum bicolor
  misc_feature: Useful for making plants with altered cell wall content and/or composition
  misc_feature: Functional homolog of the protein sequence given in SEQ ID NO 14430
  misc_feature: Ceres ANNOT ID no. 8734071
  misc_feature (69)..(633): SWISSPROT Homolog: EC 2.7.11.24 Mitogen-activated protein kinase
  misc_feature (81)..(372): Pfam ID: Pkinase Pfam Description: Protein kinase domain
MAGLALYKYSVPTVGEVIISLGKGFERSGVLWPVAKVNLGWVGGGRCCRAFAFELVGLLAISLSNSPEMEFFSEYGDANRYRIQEIIGKGSYGVVCSAIDRHTGEKVAIKKIQNIFEHLSDAARILREIKLLRLLRHPDIVEIKHVMLPPSRRDYRDIYVVFELMDTDLHQVIKANDDLTKEHHQFFLYQMLRALKYIHTANVYHRDLKPKNILANANCKLKICDFGLARVAFNDSPTTVFWTDYVATRWYRAPELCGSFFSKYSPAIDMWSIGCIFAEILTGKPLFPGKNVVHQLDLMTDLLGTPSAETISQIRNEKARRYLSSMRRKQPIPFSEKFPNADPSALKLLQRLLAFDPKDRPTAEEALADSYFKGIAKVEREPSCQPISKMEFEFEQKFTKEDVKELIFQEILQYHPQLLKDYKNGSEKTSFLYPRFRRQFASLEENGGRNATLDRKHESLPRTTTVHSTTIPAKEGPAATSQVAQRIPAARPGRVVGPVLPFESASVTDQHIARRVARNQAVPPATNTSSVYCYHLKSDSSDRQEHQVEREKDRRQYRQGQHLMDAKVAPEMGRDIRPSQYYVSRGMPKADLTDRATLHRSTLHGVAPFNSIAAVAGGYSQASVLHYGVTSLY

SEQ ID NO: 19610 - DNA, 861 bp, Sorghum bicolor
  misc_feature: Ceres ANNOT ID no. 8734054
  misc_feature: Encodes the peptide sequence at SEQ ID NO 19611
atggcgattggagcaccgccggatgattcccggcagcggcctgctgctgaccaggctgcaaacatcctcgagaatgtgtgggctaccatcatagcaggctccgctaccccggcgtcgtcgtcgacggccgcgtcgtcggaggtgggcgaagagaggccgccggaggcgatcttggagaggcttcccagcctggggaggtggatttccatgggagccgaggagtgggacgagctcctgctcagtggcacagcggcgctcgcgtcgggcgccgccgcctccggtgagctgctcgccgcctcgccggcgaaccaagaagcagaccggcagcacggtaatcgggccaccagcagctccaaagcggcggcggctgcgtgcaagagctacaggggcgtgaggcgacggccgtggggcaagttcgcggcggagatcagggacacgcggaggaaaggcgcgcgggtgtggctcggcacgttcgcgaccgccgacgaggccgcgctggcctacgacaaggcggcgctgcgcatgcgcggcccgcgcgcgcacctcaacttcccgctcgacgtcgtgcagcgcgagatgcaggcggcggcggccggggacggctgcgccgggacgacccgcgtgctgcgccggaagaggaggagaagcaatcacgatgctgctactgctgatggtacaagaagccatgggagtgtggcggcgggaactggccgtgatccgaccatggtgtcgttcgcctgtgccaagaaagatcaggggacgccgccgtcgatagtgcaagaacgctcgatcagcgatccaggagcggtgatcgagtttgaggacatcggcggcgagtactgggactacttgttcacctaa

SEQ ID NO: 19611 - protein, 286 aa, Sorghum bicolor
  misc_feature: Useful for making plants with altered lignin content
  misc_feature: Functional homolog of the protein sequence given in SEQ ID NO 13219
  misc_feature: Ceres ANNOT ID no. 8734054
  misc_feature (126)..(178): Pfam ID: AP2 Pfam Description: AP2 domain
MAIGAPPDDSRQRPAADQAANILENVWATIIAGSATPASSSTAASSEVGEERPPEAILERLPSLGRWISMGAEEWDELLLSGTAALASGAAASGELLAASPANQEADRQHGNRATSSSKAAAAACKSYRGVRRRPWGKFAAEIRDTRRKGARVWLGTFATADEAALAYDKAALRMRGPRAHLNFPLDVVQREMQAAAAGDGCAGTTRVLRRKRRRSNHDAATADGTRSHGSVAAGTGRDPTMVSFACAKKDQGTPPSIVQERSISDPGAVIEFEDIGGEYWDYLFT

SEQ ID NO: 19612 - DNA, 882 bp, Sorghum bicolor
  misc_feature: Ceres ANNOT ID no. 8734087
  misc_feature: Encodes the peptide sequence at SEQ ID NO 19613
atggggcggccggcgcgctcccgatctccggccatcgagccgcctccggaggtcactggccttcgctcctccaagatctccttccgctcccgtaagattgtcaagacaccatccgcgaaacctttggccacgaccgccctcgcaccactgccgccggcacctccgcctccagtgcttcctgcgctgtcgtcccccggagagcttgcggccgcgctgagccacctccaagccgcggaccccctcctcgccgcggtcattgcctccactgaggcgcccaccttcgccgccaccccctccctccccgcgttccactccctcgcgcgctccatcctctaccagcagctcgcgccctccgctgcggatgccatctacgctcgcttcctcgcgctcctcccctctgcttcggcggcggccgcgaacgtagccgctgacgcggtcacagtcacacccgccgccgtccttgccctcgccgccgccgacctgcgtaccatcggcgtctccggccgtaaggcatcctacctacacgacctcgcggccagattcgcagccggggagctctctgactccgccgtcgctgccatggatgaggctgcgctcctcgcggagctcaccaaggtcagaggcgtcggcgagtggactgtccacatgttcatgatcttctcactgcaccgccccgacgtgctgccgtgcggcgacctcggtgtgcgcaagggcgtgcaggagctgtacaatctcaaggggctccccaatccggaggagatggtggcattgtgcgagcggtggaggccgtacaggtcagtcggcgcgtggtacatgtggcgcctcatggagagtaagggcgctgcggccaagaagaagaataagggtaatgcgagttcttag

SEQ ID NO: 19613 - protein, 293 aa, Sorghum bicolor
  misc_feature: Useful for making plants with modulated nitrogen use efficiency
  misc_feature: Functional homolog of the protein sequence given in SEQ ID NO 14721
  misc_feature: Ceres ANNOT ID no. 8734087
  misc_feature (162)..(274): SWISSPROT Homolog: EC 3.2.2.21 DNA-3-methyladenine glycosylase II
  misc_feature (107)..(263): Pfam ID: HhH-GPD Pfam Description: HhH-GPD superfamily base excision DNA repair protein
MGRPARSRSPAIEPPPEVTGLRSSKISFRSRKIVKTPSAKPLATTALAPLPPAPPPPVLPALSSPGELAAALSHLQAADPLLAAVIASTEAPTFAATPSLPAFHSLARSILYQQLAPSAADAIYARFLALLPSASAAAANVAADAVTVTPAAVLALAAADLRTIGVSGRKASYLHDLAARFAAGELSDSAVAAMDEAALLAELTKVRGVGEWTVHMFMIFSLHRPDVLPCGDLGVRKGVQELYNLKGLPNPEEMVALCERWRPYRSVGAWYMWRLMESKGAAAKKKNKGNASS

SEQ ID NO: 19614 - DNA, 1791 bp, Sorghum bicolor
  misc_feature: Ceres ANNOT ID no. 8734079
  misc_feature: Encodes the peptide sequence at SEQ ID NO 19615
atggggtacgagtacggtgacgcggcggaggcggcggaccaccaccacctgcctcgccgggtggcggcgggcgagatggacttcttcaagaaggagaggaaggacgccgccgccgccgccgccttggccgcctttgtgccgtcgtcgtcggacgagcacggcatcaaggaagacgacctcaccatcaacatgggtctgcaccacgtcagcgggaggaagagcagcatcaggagcgaggagtccagcgtcgacgacggcgtctcctccaacggcgtggatcacagggagaccaaagctgagctggcactggcaaaatccgagcttgggcgcctgaacgaagagaacaagcagctcaaggacatgctcagcaggatgaccatcaagttcaacgccttccaggtgcagatgccggtctacactacactgatgcagcagcagcagcaaaggaccaataaccatcaagcccttctccgcggagctccaggccatgagctgatgaacgtcgatccggagacgaaggatcatcaggaggggagcggcggcagccacctgctcccacggcagttcatcagcagcctcggcaccgcccccgacgacccgctgcgctccgtgggctcggacgcaatgcacggcggcggaaacagctcggggtcgtccaccagcaacgcggaaccgccgccgccgcaacccttggactactgccctggcaacgggctcatggtcagcagcaaggagatgatgccgctgccggcgttcgagcacggccaccagcagccgcagcagcacctcgcccacgagatgggtagcagcagccgggcggatgagccgccgcagccgcaccacctggcggcggcgcagcagggctggctctccaacaaggtgcataagttcctcccctccaagggccccgagcccgtccccgaggccgccaccatgcgcaaggcccgcgtctccgtccgagcccgctccgaggcacccatgatcaatgatgggtgccaatggaggaagtacgggcagaagatggccaagggcaacccgtgcccccgcgcatactaccgctgcaccatggccgccggctgccccgtccgcaagcaggtccagagatgcgccgaggacaggacggtggtgatcacgacgtacgaggggcaccacaaccacccgcttcccccggcggcgatgccgatggcgtcgacgaccgcggcggcggcgtccatgctgctgtccgggtcgatgccgagcgcggacggcggcagcctgatggcggggtccaacttcctggcgcgcgccgtgctgccgtgctcctccaacgtcgccaccatctcggcgtcggcgccgttccccaccgtgacgctggacctcacgcagccgccaccgggagccgcctccgcctccgcctccgcgttcgcgcagccgccggcgtcggcgccggcgcaggcacgggcgacggggacggagccctcccagctccaggccgcgctcgccgacgccgcgggccggccgatgccgctgacgacgcagctgttcgggcagaagctgtacgacccctcctccaaggcccccgccgcgcaggcggacgcggcgggcgacacagtcagcgcggcggccgtgatcgcgtccgaccccaacttcaccgcgatgctcgcggcggcgatcaagtcgtacataggcagcagcggcagcggcagcaatggcgccggcgggagcagcgggacgaccgtgctgccgccggcgggggcgagcagcgccggcgacagcagcagagacgacaaggtcggggagcaagggagctga

SEQ ID NO: 19615 - protein, 596 aa, Sorghum bicolor
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8734079
  misc_feature (328)..(388): Pfam ID: WRKY Pfam Description: WRKY DNA -binding domain
MGYEYGDAAEAADHHHLPRRVAAGEMDFFKKERKDAAAAAALAAFVPSSSDEHGIKEDDLTINMGLHHVSGRKSSIRSEESSVDDGVSSNGVDHRETKAELALAKSELGRLNEENKQLKDMLSRMTIKFNAFQVQMPVYTTLMQQQQQRTNNHQALLRGAPGHELMNVDPETKDHQEGSGGSHLLPRQFISSLGTAPDDPLRSVGSDAMHGGGNSSGSSTSNAEPPPPQPLDYCPGNGLMVSSKEMMPLPAFEHGHQQPQQHLAHEMGSSSRADEPPQPHHLAAAQQGWLSNKVHKFLPSKGPEPVPEAATMRKARVSVRARSEAPMINDGCQWRKYGQKMAKGNPCPRAYYRCTMAAGCPVRKQVQRCAEDRTVVITTYEGHHNHPLPPAAMPMASTTAAAASMLLSGSMPSADGGSLMAGSNFLARAVLPCSSNVATISASAPFPTVTLDLTQPPPGAASASASAFAQPPASAPAQARATGTEPSQLQAALADAAGRPMPLTTQLFGQKLYDPSSKAPAAQADAAGDTVSAAAVIASDPNFTAMLAAAIKSYIGSSGSGSNGAGGSSGTTVLPPAGASSAGDSSRDDKVGEQGS

SEQ ID NO: 19616 - DNA, 1563 bp, Sorghum bicolor
  misc_feature: Ceres ANNOT ID no. 8734097
  misc_feature: Encodes the peptide sequence at SEQ ID NO 19617
atgaacggaggcgccgccccaccgtcggcggcgagcgcggccgcggccgccgcgacgccgcctcaccggcggctgccggacttcctccagagcgtgaacctcaagtacgtcaagctggggtaccactacctcatcacccacctgctgacgctgatgctgcttccgctgatggccgtgatcctcctcgaggccgggcgcaccgaccccgacgacttgcggcagctgtggctccacctccagtacaacctcgtgtccgtgctcgtcctctccgccgtgctcgtgttcggcgccaccgtgtacgtgctcacccgcccccgccccgtctacctggtcgacttcgcctgctacaagccgcccgcacacctccaggtgcggttcgaggagttcatgcgccactccaagctgtgcggcttctccgaggacgcgctggagttccagcgcaagatcctggagcgttccgggctcagcgaggagacgtacgtccccgaggccatgcacgcgatcccgccgcagcccacgatggccaacgcccgcgccgaggccgagaccgtcatgttcggcgcgctcgacaacctcttcaagtccaccggcgtcaagcccaaggacgtcggggtgctggtggtgaactgcagcctcttcaaccccacgccgtcgctgtcggccatgatcgtgaacaagtacaagctccgcgggaacatccgcagcttcaacctcggcggcatgggttgcagcgccggcgtgatcgccgtggacctggcccgcgacatgctgcaggtgcaccgcggcacctacgccgtggtggtgagcacggagaacatcacccagaactggtacttcgggaaccgcaagtcgatgctgatcccgaactgcctgttccgcgtgggcggctcggcggtgctgctgtcgaaccgcggcgcggaccggcggcgcgccaagtactcgctgaggcacgtggtgcgcacgcacaagggcgcggacgacaaggctttcaactgcgtgtaccaggagcaggacggcgagggcaagaccggcgtgtcgctgtccaaggacctgatggccatcgcgggcggcgcgctcaagactaacatcacgacgctgggcccgctggtgctgcccttcagcgagcagctgctcttcttcgcgacgctggtggcgaagaagctgctgagcgccaagatgaagccctacatcccggacttcaagctggcgttcgagcacttctgcatccacgcgggcgggcgcgcggtgatcgacgagctggagaagaacctgcagctgagccccgcccacgtggaggcgtcccggatgacgctccaccggttcggcaacacctccagcagctccatctggtacgagctcgcctacatggaggccaaaggccgcgtccgccgcggccaccgcatctggcagatcgccttcggcagcgggttcaagtgcaacagcgccgtgtggcacgccctgcgcaacgtcaagccgtcgcccgacaacccctgggaggactgcattgaccgctacccggtggagctcgtcgacggcttccccacgcacaagccgcagcaatag

SEQ ID NO: 19617 - protein, 520 aa, Sorghum bicolor
  misc_feature: The sequence is a functional homolog of SEQ ID NO 2 in US patent 7038112
  misc_feature: Ceres ANNOT ID no. 8734097
  misc_feature (23)..(509): SWISSPROT Homolog: EC 2.3.1.119 Icosanoyl-CoA synthase
  misc_feature (100)..(388): Pfam ID: FAE1_CUT1_RppA Pfam Description: FAE1/Type III polyketide synthase-like protein
  misc_feature (402)..(486): Pfam ID: ACP_syn_III_C Pfam Description: 3-Oxoacyl-[acyl-carrier-protein (ACP)] synthase III C terminal
MNGGAAPPSAASAAAAAATPPHRRLPDFLQSVNLKYVKLGYHYLITHLLTLMLLPLMAVILLEAGRTDPDDLRQLWLHLQYNLVSVLVLSAVLVFGATVYVLTRPRPVYLVDFACYKPPAHLQVRFEEFMRHSKLCGFSEDALEFQRKILERSGLSEETYVPEAMHAIPPQPTMANARAEAETVMFGALDNLFKSTGVKPKDVGVLVVNCSLFNPTPSLSAMIVNKYKLRGNIRSFNLGGMGCSAGVIAVDLARDMLQVHRGTYAVVVSTENITQNWYFGNRKSMLIPNCLFRVGGSAVLLSNRGADRRRAKYSLRHVVRTHKGADDKAFNCVYQEQDGEGKTGVSLSKDLMAIAGGALKTNITTLGPLVLPFSEQLLFFATLVAKKLLSAKMKPYIPDFKLAFEHFCIHAGGRAVIDELEKNLQLSPAHVEASRMTLHRFGNTSSSSIWYELAYMEAKGRVRRGHRIWQIAFGSGFKCNSAVWHALRNVKPSPDNPWEDCIDRYPVELVDGFPTHKPQQ

SEQ ID NO: 19618 - DNA, 627 bp, Sorghum bicolor
  misc_feature: Ceres ANNOT ID no. 8734111
  misc_feature: Encodes the peptide sequence at SEQ ID NO 19619
atggtgaagcacaacaacgttatccccaacgggcacttcaaaaagcactggcagaactatgtcaagacatggttcaaccagcctgcccgcaagcaaaggcgacgcattgctcgtcaaaagaaggctgtgaagatattccctcgcccaactgctggccctcttcgccccattgtgcaatgccagactctcaagtacaacatgaagtcaagggctggcagaggctttacccttgaggagctgaaggctgcaggcattccaaagaagcttgctccgaccattggcatttctgtagatcaccgccgcaagaacaaatcccttgaggggctgcaggctaatgtccagaggcttaagacatacaaggccaagctggttatcttcccaaggcgtgctcgcaaggtcaaggctggcgactccactgcggaggagcttgccactgccacccaggtccagggtgactacatgcctattactcgtggtgagaagcgttcagttgaggttgtgaaggttactgaggagatgaagtcatttgcggcctacggcaaactccgtcttgagcggatgaacaagaaacacctcggtgcacgccagaagaaggcggctgaggcagagaaggaagagaagaagtga

SEQ ID NO: 19619 - protein, 208 aa, Sorghum bicolor
  misc_feature: Useful for making plants with modulated nitrogen use efficiency
  misc_feature: Functional homolog of the protein sequence given in SEQ ID NO 14483
  misc_feature: Useful for making plants with modulated phosphate use efficiency
  misc_feature: Functional homolog of the protein sequence given in SEQ ID NO 14484
  misc_feature: Ceres ANNOT ID no. 8734111
  misc_feature (6)..(185): Pfam ID: Ribosomal_L13e Pfam Description: Ribosomal protein L13e
MVKHNNVIPNGHFKKHWQNYVKTWFNQPARKQRRRIARQKKAVKIFPRPTAGPLRPIVQCQTLKYNMKSRAGRGFTLEELKAAGIPKKLAPTIGISVDHRRKNKSLEGLQANVQRLKTYKAKLVIFPRRARKVKAGDSTAEELATATQVQGDYMPITRGEKRSVEVVKVTEEMKSFAAYGKLRLERMNKKHLGARQKKAAEAEKEEKK

SEQ ID NO: 19620 - DNA, 2337 bp, Sorghum bicolor
  misc_feature: Ceres ANNOT ID no. 8734122
  misc_feature: Encodes the peptide sequence at SEQ ID NO 19621
atgaccaagtttgataaaatgcatttgtttaagcaaattcttgatcttgtggataagtgtcatgcacagggttttactttacagcatttgcgaccgtcatattttacgaccctttcttcaaatcaagttaaatatattggttcttataccacacaagacttgccaacatcaatcaaacaagaggttgctagagaagatcttgtgaatagaaaaagggcttttggccatagaattgatcaccaagattctaatggctatggaaatttgatgctgaagtatcagaaggttggcgggcaaggctcagttgctatcaggcgaccagcaaatacattttggactgaccaaatatgtgacaatcaaaatgaagatgtcgatccaggtgtttcgaggcaagaaaattttagttacactgccagagagcgttttaagttcgtcgaaccatatggaaataatacatctggtgctcaacatgtatctagttctggcacccaacaaccagcatttgaattgaggaatcttgaggaaagctggtacaaaagcccggaggagcttagtcaatttaaaggcacattcccttcaaatatctacagccttggggttcttctatttgagctcttttgctgttctgagacatgggaggtgcactgtgctgcaatgtcaaatcttcgccaacgcatcctgcctcgaaattttctttcagaaagtcccaaggaggccggcttctgcctttggttactacatccagatccttgttcaagaccaaaagcaaaagagattcttggatgtgacttgataaatgagggtcgggatttgtccttgttagatcaggcaccagtttccatcagtgaagatgacactgaatctagtttgctgtttaacttcctttctcaactgaaagaagaaaaggagatgctggctgccaaattatcagcagagcttggaagcttagaaacagatatcacagaggttgagagaagacactcagcaagaatgagattgagtttagaggacacggatgtactgccaagttctggtgttttgtcaggagcttctgtgagtgccgttcaaggtgcattgctgtcaggtttgctaccgacatcgtgcaagtcaagtgtatatgaggagagggtaatgagaaatttggtgcagcttgaaaatgcatattactccatgaggtcctctgtggacaccagtgaaactaatgcaatcaaacgtccagataacgaggctttgagggttcgtgaaaatttccatcaacttcacagtgattttgatgctaagggtgagaaaacagaccgtcttggatgcttttttgatggtttatgcaaatatgcccggcacagtaggtttgaggtccgaggaattctgaagaatgcagatatacttaactctccgaatgtcatctgttcattgagttttgatagggatgaagaatattttgctgctgctggagtttcaaagaaaataaaaatatttgaatttgatgcactcttaaatgatcgtgttgatattcattacccactggtagagatgcctagcaagtccaagcttagctgtgtcagttggaacaactatataaagaactacctggcatcaacagactatgatggcactgttcagctatgggatgccagctctggtcaaggattcacacagtttacagagcaccggaaaagggcttggtctgtgagtttttcagaagttgatcctactatgttggcaagtggtagtgatgattgttgcgtcaaagtatggagtattaatcagagaaattgtattgatacaatcagaaatgtggcgaatgtatgctgtgtacaattctctccatactcctcccgcatgctagcttttggttcagctgattacaagatatactgttatgatctgaggaacacaaggataccttggtgtactatttcgggacatggaaaagctgtcagttatgtaaggttcttggatccagaaacacttatctctgcatcaaccgacaacacattgaagatatgggatcttaaccggactaattgcagcggattatctaccgattcttgcagcctgactctgaatggtcataccaacgagaagaattttgtagggctatctgttcatgatggatacataacttgtggctctgaaaccaatgaagtgttttcttactacaaaactttccccatgccaataacttctcataggtttggttctattgacccgataactggacaagtaacaaatgaagacaaccaacaatttgtgtccagtgtttgctggagagggaagtcaaacatggtagtggctgccaactccagtggtagcatcaaagtgcttgagcttgtgtga

SEQ ID NO: 19621 - protein, 778 aa, Sorghum bicolor
  misc_feature: Useful for making plants with modulated low light sensitivity
  misc_feature: Functional homolog of the protein sequence given in SEQ ID NO 14722
  misc_feature: Useful for making plants with modulated light quality sensitivity
  misc_feature: Functional homolog of the protein sequence given in SEQ ID NO 14723
  misc_feature: Ceres ANNOT ID no. 8734122
  misc_feature (481)..(682): SWISSPROT Homolog: EC 2.3.1.48 Histone acetyltransferase
  misc_feature (169)..(309): SWISSPROT Homolog: EC 2.7.11.1 Non-specific serine/threonine protein kinase
  misc_feature (547)..(586): Pfam ID: WD40 Pfam Description: WD domain, G-beta repeat
  misc_feature (633)..(670): Pfam ID: WD40 Pfam Description: WD domain, G-beta repeat
MTKFDKMHLFKQILDLVDKCHAQGFTLQHLRPSYFTTLSSNQVKYIGSYTTQDLPTSIKQEVAREDLVNRKRAFGHRIDHQDSNGYGNLMLKYQKVGGQGSVAIRRPANTFWTDQICDNQNEDVDPGVSRQENFSYTARERFKFVEPYGNNTSGAQHVSSSGTQQPAFELRNLEESWYKSPEELSQFKGTFPSNIYSLGVLLFELFCCSETWEVHCAAMSNLRQRILPRNFLSESPKEAGFCLWLLHPDPCSRPKAKEILGCDLINEGRDLSLLDQAPVSISEDDTESSLLFNFLSQLKEEKEMLAAKLSAELGSLETDITEVERRHSARMRLSLEDTDVLPSSGVLSGASVSAVQGALLSGLLPTSCKSSVYEERVMRNLVQLENAYYSMRSSVDTSETNAIKRPDNEALRVRENFHQLHSDFDAKGEKTDRLGCFFDGLCKYARHSRFEVRGILKNADILNSPNVICSLSFDRDEEYFAAAGVSKKIKIFEFDALLNDRVDIHYPLVEMPSKSKLSCVSWNNYIKNYLASTDYDGTVQLWDASSGQGFTQFTEHRKRAWSVSFSEVDPTMLASGSDDCCVKVWSINQRNCIDTIRNVANVCCVQFSPYSSRMLAFGSADYKIYCYDLRNTRIPWCTISGHGKAVSYVRFLDPETLISASTDNTLKIWDLNRTNCSGLSTDSCSLTLNGHTNEKNFVGLSVHDGYITCGSETNEVFSYYKTFPMPITSHRFGSIDPITGQVTNEDNQQFVSSVCWRGKSNMVVAANSSGSIKVLELV

SEQ ID NO: 19622 - DNA, 555 bp, Sorghum bicolor
  misc_feature: Ceres ANNOT ID no. 8734151
  misc_feature: Encodes the peptide sequence at SEQ ID NO 19623
atgtcggaagcggaggccgcctgcggcggcggcggcggggggaaggagcaggaccgcttcctgccgatcgccaacatcgggcgcatcatgcgccgggcggtgccggagaacggcaagatcgccaaggactccaaggagtccatccaggagtgcgtctccgagttcatcagcttcatcactagcgaagcgagtgacaagtgcatgaaggagaggcgaaagaccatcaacggcgacgacatcatatggtccttgggcacgctcggcttcgaggaatacgttgagcccctcaagatctacctcaagaattaccgggagggtgatacaaaaggttcgaaatcttctgatcagaatggaaagaaacagattttactcaatggtgaacctgcatcatcgttggcgctatgttgcatgaatgaaatcgccaaatcggcggtactttacagatatcctgtttctacagtgaaggactgtacgcagttgaagtctgttgtcgactctgagaaggtgcaagtattagttgagagtcgtgcaacccaaaatcctgccatgcaatag

SEQ ID NO: 19623 - protein, 184 aa, Sorghum bicolor
  misc_feature: The sequence is a functional homolog of SEQ ID NO 1165 in the 10/412,699 US patent application
  misc_feature: The sequence is a functional homolog of SEQ ID NO 30 in the 10/675,852 US patent application
  misc_feature: The sequence is a functional homolog of SEQ ID NO 781 in the 10/374,780 US patent application
  misc_feature: The sequence is a functional homolog of SEQ ID NO 808 in the 10/666,642 US patent application
  misc_feature: The sequence is a functional homolog of SEQ ID NO 2139 in the 10/666,642 US patent application
  misc_feature: The sequence is a functional homolog of SEQ ID NO 334 in the 11/435,388 US patent application
  misc_feature: The sequence is a functional homolog of SEQ ID NO 336 in the 10/714,887 US patent application
  misc_feature: The sequence is a functional homolog of SEQ ID NO 90 in the 10/675,852 US patent application
  misc_feature: The sequence is a functional homolog of SEQ ID NO 1440 in the 10/666,642 US patent application
  misc_feature: The sequence is a functional homolog of SEQ ID NO 1856 in the 10/412,699 US patent application
  misc_feature: The sequence is a functional homolog of SEQ ID NO 2102 in the 10/374,780 US patent application
  misc_feature: The sequence is a functional homolog of SEQ ID NO 290 in the 10/225,066 US patent application
  misc_feature: The sequence is a functional homolog of SEQ ID NO 8 in the 10/675,852 US patent application
  misc_feature: The sequence is a functional homolog of SEQ ID NO 793 in the 10/374,780 US patent application
  misc_feature: The sequence is a functional homolog of SEQ ID NO 308 in the 11/435,388 US patent application
  misc_feature: The sequence is a functional homolog of SEQ ID NO 310 in the 10/714,887 US patent application
  misc_feature: Useful for making plants with modulated biomass
  misc_feature: Functional homolog of the protein sequence given in SEQ ID NO 13228
  misc_feature: The sequence is a functional homolog of SEQ ID NO 46 in the 10/675,852 US patent application
  misc_feature: The sequence is a functional homolog of SEQ ID NO 56 in the 10/675,852 US patent application
  misc_feature: The sequence is a functional homolog of SEQ ID NO 785 in the 10/374,780 US patent application
  misc_feature: The sequence is a functional homolog of SEQ ID NO 786 in the 10/374,780 US patent application
  misc_feature: The sequence is a functional homolog of SEQ ID NO 12 in the 10/675,852 US patent application
  misc_feature: The sequence is a functional homolog of SEQ ID NO 791 in the 10/374,780 US patent application
  misc_feature: The sequence is a functional homolog of SEQ ID NO 14 in the 10/675,852 US patent application
  misc_feature: The sequence is a functional homolog of SEQ ID NO 36 in the 10/675,852 US patent application
  misc_feature: The sequence is a functional homolog of SEQ ID NO 2149 in the 10/666,642 US patent application
  misc_feature: The sequence is a functional homolog of SEQ ID NO 362 in the 11/435,388 US patent application
  misc_feature: The sequence is a functional homolog of SEQ ID NO 364 in the 10/714,887 US patent application
  misc_feature: The sequence is a functional homolog of SEQ ID NO 40 in the 10/675,852 US patent application
  misc_feature: The sequence is a functional homolog of SEQ ID NO 58 in the 10/675,852 US patent application
  misc_feature: The sequence is a functional homolog of SEQ ID NO 78 in the 10/675,852 US patent application
  misc_feature: The sequence is a functional homolog of SEQ ID NO 806 in the 10/374,780 US patent application
  misc_feature: The sequence is a functional homolog of SEQ ID NO 60 in the 10/675,852 US patent application
  misc_feature: The sequence is a functional homolog of SEQ ID NO 26 in the 10/675,852 US patent application
  misc_feature: The sequence is a functional homolog of SEQ ID NO 802 in the 10/374,780 US patent application
  misc_feature: The sequence is a functional homolog of SEQ ID NO 2137 in the 10/666,642 US patent application
  misc_feature: The sequence is a functional homolog of SEQ ID NO 332 in the 11/435,388 US patent application
  misc_feature: The sequence is a functional homolog of SEQ ID NO 334 in the 10/714,887 US patent application
  misc_feature: The sequence is a functional homolog of SEQ ID NO 54 in the 10/675,852 US patent application
  misc_feature: The sequence is a functional homolog of SEQ ID NO 74 in the 10/675,852 US patent application
  misc_feature: The sequence is a functional homolog of SEQ ID NO 790 in the 10/374,780 US patent application
  misc_feature: The sequence is a functional homolog of SEQ ID NO 787 in the 10/374,780 US patent application
  misc_feature: The sequence is a functional homolog of SEQ ID NO 1168 in the 10/412,699 US patent application
  misc_feature: The sequence is a functional homolog of SEQ ID NO 32 in the 10/675,852 US patent application
  misc_feature: The sequence is a functional homolog of SEQ ID NO 784 in the 10/374,780 US patent application
  misc_feature: The sequence is a functional homolog of SEQ ID NO 811 in the 10/666,642 US patent application
  misc_feature: The sequence is a functional homolog of SEQ ID NO 2135 in the 10/666,642 US patent application
  misc_feature: The sequence is a functional homolog of SEQ ID NO 28 in the 10/675,852 US patent application
  misc_feature: The sequence is a functional homolog of SEQ ID NO 330 in the 11/435,388 US patent application
  misc_feature: The sequence is a functional homolog of SEQ ID NO 332 in the 10/714,887 US patent application
  misc_feature: The sequence is a functional homolog of SEQ ID NO 792 in the 10/374,780 US patent application
  misc_feature: The sequence is a functional homolog of SEQ ID NO 88 in the 10/675,852 US patent application
  misc_feature: The sequence is a functional homolog of SEQ ID NO 10 in the 10/675,852 US patent application
  misc_feature: The sequence is a functional homolog of SEQ ID NO 1502 in the 10/666,642 US patent application
  misc_feature: The sequence is a functional homolog of SEQ ID NO 1910 in the 10/412,699 US patent application
  misc_feature: The sequence is a functional homolog of SEQ ID NO 2172 in the 10/374,780 US patent application
  misc_feature: The sequence is a functional homolog of SEQ ID NO 320 in the 11/435,388 US patent application
  misc_feature: The sequence is a functional homolog of SEQ ID NO 322 in the 10/714,887 US patent application
  misc_feature: The sequence is a functional homolog of SEQ ID NO 2171 in the 10/666,642 US patent application
  misc_feature: The sequence is a functional homolog of SEQ ID NO 2173 in the 10/666,642 US patent application
  misc_feature: The sequence is a functional homolog of SEQ ID NO 2185 in the 10/666,642 US patent application
  misc_feature: The sequence is a functional homolog of SEQ ID NO 24 in the 10/675,852 US patent application
  misc_feature: The sequence is a functional homolog of SEQ ID NO 394 in the 11/435,388 US patent application
  misc_feature: The sequence is a functional homolog of SEQ ID NO 396 in the 10/714,887 US patent application
  misc_feature: The sequence is a functional homolog of SEQ ID NO 396 in the 11/435,388 US patent application
  misc_feature: The sequence is a functional homolog of SEQ ID NO 398 in the 10/714,887 US patent application
  misc_feature: The sequence is a functional homolog of SEQ ID NO 408 in the 11/435,388 US patent application
  misc_feature: The sequence is a functional homolog of SEQ ID NO 410 in the 10/714,887 US patent application
  misc_feature: The sequence is a functional homolog of SEQ ID NO 84 in the 10/675,852 US patent application
  misc_feature: The sequence is a functional homolog of SEQ ID NO 64 in the 10/675,852 US patent application
  misc_feature: Useful for making plants with modulated drought sensitivity
  misc_feature: Functional homolog of the protein sequence given in SEQ ID NO 13743
  misc_feature: Useful for making plants with altered alkaloid content
  misc_feature: Useful for making plants with altered terpenoid content
  misc_feature: Functional homolog of the protein sequence given in SEQ ID NO 13247
  misc_feature: The sequence is a functional homolog of SEQ ID NO 42 in the 10/675,852 US patent application
  misc_feature: The sequence is a functional homolog of SEQ ID NO 38 in the 10/675,852 US patent application
  misc_feature: The sequence is a functional homolog of SEQ ID NO 44 in the 10/675,852 US patent application
  misc_feature: The sequence is a functional homolog of SEQ ID NO 310 in the 11/435,388 US patent application
  misc_feature: The sequence is a functional homolog of SEQ ID NO 312 in the 10/714,887 US patent application
  misc_feature: The sequence is a functional homolog of SEQ ID NO 72 in the 10/675,852 US patent application
  misc_feature: The sequence is a functional homolog of SEQ ID NO 106 in the 10/666,642 US patent application
  misc_feature: The sequence is a functional homolog of SEQ ID NO 1784 in the 10/412,699 US patent application
  misc_feature: The sequence is a functional homolog of SEQ ID NO 2010 in the 10/374,780 US patent application
  misc_feature: The sequence is a functional homolog of SEQ ID NO 292 in the 11/435,388 US patent application
  misc_feature: The sequence is a functional homolog of SEQ ID NO 294 in the 10/714,887 US patent application
  misc_feature: The sequence is a functional homolog of SEQ ID NO 6 in the 10/675,852 US patent application
  misc_feature: The sequence is a functional homolog of SEQ ID NO 719 in the 11/479,226 US patent application
  misc_feature: The sequence is a functional homolog of SEQ ID NO 66 in the 10/675,852 US patent application
  misc_feature: The sequence is a functional homolog of SEQ ID NO 22 in the 10/675,852 US patent application
  misc_feature: The sequence is a functional homolog of SEQ ID NO 2175 in the 10/666,642 US patent application
  misc_feature: The sequence is a functional homolog of SEQ ID NO 398 in the 11/435,388 US patent application
  misc_feature: The sequence is a functional homolog of SEQ ID NO 400 in the 10/714,887 US patent application
  misc_feature: The sequence is a functional homolog of SEQ ID NO 80 in the 10/675,852 US patent application
  misc_feature: The sequence is a functional homolog of SEQ ID NO 801 in the 10/374,780 US patent application
  misc_feature: The sequence is a functional homolog of SEQ ID NO 18 in the 10/675,852 US patent application
  misc_feature: The sequence is a functional homolog of SEQ ID NO 2183 in the 10/666,642 US patent application
  misc_feature: The sequence is a functional homolog of SEQ ID NO 406 in the 11/435,388 US patent application
  misc_feature: The sequence is a functional homolog of SEQ ID NO 408 in the 10/714,887 US patent application
  misc_feature: The sequence is a functional homolog of SEQ ID NO 798 in the 10/374,780 US patent application
  misc_feature: The sequence is a functional homolog of SEQ ID NO 2153 in the 10/666,642 US patent application
  misc_feature: The sequence is a functional homolog of SEQ ID NO 366 in the 11/435,388 US patent application
  misc_feature: The sequence is a functional homolog of SEQ ID NO 368 in the 10/714,887 US patent application
  misc_feature: The sequence is a functional homolog of SEQ ID NO 50 in the 10/675,852 US patent application
  misc_feature: The sequence is a functional homolog of SEQ ID NO 805 in the 10/374,780 US patent application
  misc_feature: The sequence is a functional homolog of SEQ ID NO 2151 in the 10/666,642 US patent application
  misc_feature: The sequence is a functional homolog of SEQ ID NO 364 in the 11/435,388 US patent application
  misc_feature: The sequence is a functional homolog of SEQ ID NO 366 in the 10/714,887 US patent application
  misc_feature: The sequence is a functional homolog of SEQ ID NO 48 in the 10/675,852 US patent application
  misc_feature: The sequence is a functional homolog of SEQ ID NO 804 in the 10/374,780 US patent application
  misc_feature: The sequence is a functional homolog of SEQ ID NO 134 in the 10/225,068 US patent application
  misc_feature: The sequence is a functional homolog of SEQ ID NO 1398 in the 10/666,642 US patent application
  misc_feature: The sequence is a functional homolog of SEQ ID NO 14 in the 10/286,264 US patent application
  misc_feature: The sequence is a functional homolog of SEQ ID NO 290 in the 11/435,388 US patent application
  misc_feature: The sequence is a functional homolog of SEQ ID NO 292 in the 10/714,887 US patent application
  misc_feature: The sequence is a functional homolog of SEQ ID NO 306 in the 10/412,699 US patent application
  misc_feature: The sequence is a functional homolog of SEQ ID NO 4 in the 10/675,852 US patent application
  misc_feature: The sequence is a functional homolog of SEQ ID NO 708 in the 11/479,226 US patent application
  misc_feature: The sequence is a functional homolog of SEQ ID NO 90 in the 10/374,780 US patent application
  misc_feature: The sequence is a functional homolog of SEQ ID NO 16 in the 10/675,852 US patent application
  misc_feature: The sequence is a functional homolog of SEQ ID NO 2179 in the 10/666,642 US patent application
  misc_feature: The sequence is a functional homolog of SEQ ID NO 402 in the 11/435,388 US patent application
  misc_feature: The sequence is a functional homolog of SEQ ID NO 404 in the 10/714,887 US patent application
  misc_feature: The sequence is a functional homolog of SEQ ID NO 797 in the 10/374,780 US patent application
  misc_feature: The sequence is a functional homolog of SEQ ID NO 82 in the 10/675,852 US patent application
  misc_feature: The sequence is a functional homolog of SEQ ID NO 803 in the 10/374,780 US patent application
  misc_feature: The sequence is a functional homolog of SEQ ID NO 2143 in the 10/666,642 US patent application
  misc_feature: The sequence is a functional homolog of SEQ ID NO 338 in the 11/435,388 US patent application
  misc_feature: The sequence is a functional homolog of SEQ ID NO 340 in the 10/714,887 US patent application
  misc_feature: The sequence is a functional homolog of SEQ ID NO 76 in the 10/675,852 US patent application
  misc_feature: The sequence is a functional homolog of SEQ ID NO 796 in the 10/374,780 US patent application
  misc_feature: The sequence is a functional homolog of SEQ ID NO 1164 in the 10/412,699 US patent application
  misc_feature: The sequence is a functional homolog of SEQ ID NO 29 in the 10/675,852 US patent application
  misc_feature: The sequence is a functional homolog of SEQ ID NO 780 in the 10/374,780 US patent application
  misc_feature: The sequence is a functional homolog of SEQ ID NO 807 in the 10/666,642 US patent application
  misc_feature: The sequence is a functional homolog of SEQ ID NO 20 in the 10/675,852 US patent application
  misc_feature: The sequence is a functional homolog of SEQ ID NO 2181 in the 10/666,642 US patent application
  misc_feature: The sequence is a functional homolog of SEQ ID NO 404 in the 11/435,388 US patent application
  misc_feature: The sequence is a functional homolog of SEQ ID NO 406 in the 10/714,887 US patent application
  misc_feature: The sequence is a functional homolog of SEQ ID NO 800 in the 10/374,780 US patent application
  misc_feature: The sequence is a functional homolog of SEQ ID NO 2187 in the 10/666,642 US patent application
  misc_feature: The sequence is a functional homolog of SEQ ID NO 410 in the 11/435,388 US patent application
  misc_feature: The sequence is a functional homolog of SEQ ID NO 412 in the 10/714,887 US patent application
  misc_feature: The sequence is a functional homolog of SEQ ID NO 86 in the 10/675,852 US patent application
  misc_feature: The sequence is a functional homolog of SEQ ID NO 1166 in the 10/412,699 US patent application
  misc_feature: The sequence is a functional homolog of SEQ ID NO 31 in the 10/675,852 US patent application
  misc_feature: The sequence is a functional homolog of SEQ ID NO 782 in the 10/374,780 US patent application
  misc_feature: The sequence is a functional homolog of SEQ ID NO 809 in the 10/666,642 US patent application
  misc_feature: The sequence is a functional homolog of SEQ ID NO 2155 in the 10/666,642 US patent application
  misc_feature: The sequence is a functional homolog of SEQ ID NO 368 in the 11/435,388 US patent application
  misc_feature: The sequence is a functional homolog of SEQ ID NO 370 in the 10/714,887 US patent application
  misc_feature: The sequence is a functional homolog of SEQ ID NO 94 in the 10/675,852 US patent application
  misc_feature: The sequence is a functional homolog of SEQ ID NO 34 in the 10/675,852 US patent application
  misc_feature: The sequence is a functional homolog of SEQ ID NO 807 in the 10/374,780 US patent application
  misc_feature: The sequence is a functional homolog of SEQ ID NO 416 in the 11/435,388 US patent application
  misc_feature: The sequence is a functional homolog of SEQ ID NO 418 in the 10/714,887 US patent application
  misc_feature: The sequence is a functional homolog of SEQ ID NO 789 in the 10/374,780 US patent application
  misc_feature: The sequence is a functional homolog of SEQ ID NO 418 in the 11/435,388 US patent application
  misc_feature: The sequence is a functional homolog of SEQ ID NO 420 in the 10/714,887 US patent application
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
  misc_feature: The sequence is a functional homolog of SEQ ID NO 2177 in the 10/666,642 US patent application
  misc_feature: The sequence is a functional homolog of SEQ ID NO 400 in the 11/435,388 US patent application
  misc_feature: The sequence is a functional homolog of SEQ ID NO 402 in the 10/714,887 US patent application
  misc_feature: The sequence is a functional homolog of SEQ ID NO 52 in the 10/675,852 US patent application
  misc_feature: The sequence is a functional homolog of SEQ ID NO 799 in the 10/374,780 US patent application
  misc_feature: The sequence is a functional homolog of SEQ ID NO 306 in the 11/435,388 US patent application
  misc_feature: The sequence is a functional homolog of SEQ ID NO 308 in the 10/714,887 US patent application
  misc_feature: The sequence is a functional homolog of SEQ ID NO 70 in the 10/675,852 US patent application
  misc_feature: The sequence is a functional homolog of SEQ ID NO 795 in the 10/374,780 US patent application
  misc_feature: The sequence is a functional homolog of SEQ ID NO 134 in US patent 7294759
  misc_feature: The sequence is a functional homolog of SEQ ID NO 2 in US patent 7220894
  misc_feature: The sequence is a functional homolog of SEQ ID NO 22 in US patent 7166765
  misc_feature: The sequence is a functional homolog of SEQ ID NO 2382 in the 10/374,780 US patent application
  misc_feature: The sequence is a functional homolog of SEQ ID NO 540 in the 10/225,066 US patent application
  misc_feature: The sequence is a functional homolog of SEQ ID NO 72 in the 10/286,264 US patent application
  misc_feature: The sequence is a functional homolog of SEQ ID NO 414 in the 11/435,388 US patent application
  misc_feature: The sequence is a functional homolog of SEQ ID NO 416 in the 10/714,887 US patent application
  misc_feature: Ceres ANNOT ID no. 8734151
  misc_feature (15)..(120): SWISSPROT Homolog: EC 2.7.7.7 DNA-directed DNA polymerase
  misc_feature (19)..(84): Pfam ID: CBFD_NFYB_HMF Pfam Description: Histone-like transcription factor (CBF/NF-Y) and archaeal histone
MSEAEAACGGGGGGKEQDRFLPIANIGRIMRRAVPENGKIAKDSKESIQECVSEFISFITSEASDKCMKERRKTINGDDIIWSLGTLGFEEYVEPLKIYLKNYREGDTKGSKSSDQNGKKQILLNGEPASSLALCCMNEIAKSAVLYRYPVSTVKDCTQLKSVVDSEKVQVLVESRATQNPAMQ

SEQ ID NO: 19624 - DNA, 282 bp, Sorghum bicolor
  misc_feature: Ceres ANNOT ID no. 8734152
  misc_feature: Encodes the peptide sequence at SEQ ID NO 19625
atgtcgacgagggaggatgggaaccccaagccggtgaccgtgaagatcatcgagacggtgtacgtggaggccgacaccgccgacgacttcaagtccgtcgtccagaggctcaccggcaaggacgccgccgtcgccgccgagctggaggagagcaacaggcctgctgcaccaccacaagccgctcaacaaggttctcttggtgatcgcaagacttctgctggcgcctccagcaaaaggagaacggaaaataatttcatgatgtatgaaaccaatgcaaattag

SEQ ID NO: 19625 - protein, 93 aa, Sorghum bicolor
  misc_feature: The sequence is a functional homolog of SEQ ID NO 1165 in the 10/412,699 US patent application
  misc_feature: The sequence is a functional homolog of SEQ ID NO 30 in the 10/675,852 US patent application
  misc_feature: The sequence is a functional homolog of SEQ ID NO 781 in the 10/374,780 US patent application
  misc_feature: The sequence is a functional homolog of SEQ ID NO 808 in the 10/666,642 US patent application
  misc_feature: Ceres ANNOT ID no. 8734152
  misc_feature (15)..(46): Pfam ID: VQ Pfam Description: VQ motif
MSTREDGNPKPVTVKIIETVYVEADTADDFKSVVQRLTGKDAAVAAELEESNRPAAPPQAAQQGSLGDRKTSAGASSKRRTENNFMMYETNAN

SEQ ID NO: 19626 - DNA, 1542 bp, Sorghum bicolor
  misc_feature: Ceres ANNOT ID no. 8734166
  misc_feature: Encodes the peptide sequence at SEQ ID NO 19627
atggccgacgagccaagaacgacggcggcggcgacgccgagcagcaggatgccggacttcaagcagtcggtgaagctcaagtacgtgaagcttgggtaccaccacctgatcagccacggcgcgtacctgctgctggcgccgctgccggggctggtggcggcgcacctgtccaccttcacgctgcgtgacctggcggacctgtggcagagcctgcagtacaacctggtgtccgtgctcgtctgcaccacggtgctggtggtggtggccacggcctacgcgctgacgcggccgcggcccgtgtacctggtggacttcgcgtgctacaagcccgacgacgagcgcaagtgcagccgcgcgcggttcatgaactgcaccgagtcgctgggcaccttcacgccggagaacatcgagttccagcgccggatcatcgagcggtcggggctcggcgaggacacgtacctcccggaggcggtgctcaacatcccgcccaacccgtccatggccaacgcgcggaaggaggccgagatggtcatgttcggcgcgctggacgagctgttcgccaagacgggcgtgcggcccaaggacgtgggcgtgctggtggtgaactgcagcctcttcaacccgacgccgtcgctgtccgccatggtcgtcaaccactacaagctccggggcaacatcgcgagctacaacctcggcgggatgggctgcagcgcggggctcatcgccgtcgacctcgccagggacctgctgcagtgccaccgggacacgtacgccgtggtgatcagcatggagaacatcaccctcaactggtacttcggcaacgaccgctccatgctggtgtccaactgcctgttccgcatgggcggcgccgcgctcctgctgtcgaaccgcggctcggcgcggcgacggtccaagtaccagctggtgcacacggtgcgcacgcacagggccgccgacgaccgctgcttcggctgcgtgtggcagcgggaggacggggaggggaaagtgggcgtgtcgctgtccaaggagctcatggccgtggccggggacgcgctcaagaccaacatcacgacgctcggcccgctcgtgctgcccatgtcggagcagctgctcttcttcgccacgctcgtcgcgcgcaaggtgctgaagcgcaaggtgaagccctacatcccggacttcaagctggcgttcgagcacttctgcatccacgcgggcgggcgggcggtgctggacgagctggagaagaacctcaagctcacggactggcacatggagccgtccaggatgacgctgcaccggttcggcaacacctccagcagctcgctctggtacgagctcgcctacgccgaggccaagggacggatcaagaagggcgaccgcacctggcagatcgccttcggctccgggttcaagtgcaacagcgccgtgtggaaggcgctccggtcggtgaacccagccaaggagaaaggcatgaggaacaacccctggagggacgacatcgacaggtaccccgtcgccgtccccaaggtgtcagctatctga

SEQ ID NO: 19627 - protein, 513 aa, Sorghum bicolor
  misc_feature: The sequence is a functional homolog of SEQ ID NO 2 in US patent 7038112
  misc_feature: Ceres ANNOT ID no. 8734166
  misc_feature (17)..(513): SWISSPROT Homolog: EC 2.3.1.119 Icosanoyl-CoA synthase
  misc_feature (92)..(381): Pfam ID: FAE1_CUT1_RppA Pfam Description: FAE1/Type III polyketide synthase-like protein
  misc_feature (395)..(479): Pfam ID: ACP_syn_III_C Pfam Description: 3-Oxoacyl-[acyl-carrier-protein (ACP)] synthase III C terminal
MADEPRTTAAATPSSRMPDFKQSVKLKYVKLGYHHLISHGAYLLLAPLPGLVAAHLSTFTLRDLADLWQSLQYNLVSVLVCTTVLVVVATAYALTRPRPVYLVDFACYKPDDERKCSRARFMNCTESLGTFTPENIEFQRRIIERSGLGEDTYLPEAVLNIPPNPSMANARKEAEMVMFGALDELFAKTGVRPKDVGVLVVNCSLFNPTPSLSAMVVNHYKLRGNIASYNLGGMGCSAGLIAVDLARDLLQCHRDTYAVVISMENITLNWYFGNDRSMLVSNCLFRMGGAALLLSNRGSARRRSKYQLVHTVRTHRAADDRCFGCVWQREDGEGKVGVSLSKELMAVAGDALKTNITTLGPLVLPMSEQLLFFATLVARKVLKRKVKPYIPDFKLAFEHFCIHAGGRAVLDELEKNLKLTDWHMEPSRMTLHRFGNTSSSSLWYELAYAEAKGRIKKGDRTWQIAFGSGFKCNSAVWKALRSVNPAKEKGMRNNPWRDDIDRYPVAVPKVSAI

SEQ ID NO: 19628 - DNA, 1779 bp, Sorghum bicolor
  misc_feature: Ceres ANNOT ID no. 8734179
  misc_feature: Encodes the peptide sequence at SEQ ID NO 19629
atgggcggccgcgcccggtccctcctccgctggctccgtcaccgctcccgctcccgccgcgtctcatcctcttcctcctcctcctccttccacctgacctccaccaccactaacaacaacgacagcaccgccaccagcggagacctccgcgctcgctcgctcccgcaccagttccacgccgaggaggaggaggaggagcgagaggtcggagaagagatcgccgccgagcccgcgtctgagtccgaggggtgcattgtcttgggggatccggagccgggtgctggaccgcgcgcaccggtgccgccactcatggatccgagcaaaaaggaatctgaattcttcaccgagtatggtgaggcaagtcggtatcaggtcagtgaagtcattggcaaagggagctacggtgttgtggctgctgctgtcgacacccagactggtgagcgtgtggctatcaagaagatcgttgatgtctttgatcatgtctccgatgcaactcgcatccttagggagatcaagttgctccggttgctacgtcacccagacttagttgagatcaagcacattatgcttcctccttcgaggagggaatttagggatatctacgtgatctttgagttgatggagtcggatctccatcaagtaataaaagcaaacgatgatctcacagcagagcatcaccagttcttcttgtaccagctgctccgtgggatgaagtacattcatgcagcaagtgtcttccatcgggatcttaagcccaagaacattctagccaatgctgactgcaagctgaagatttgtgattttggccttgcccgtgtttcattcaatgacaccccatcagccatattctggacggattacgtggccactagatggtatcgagctccggaattatgtggctcctttttttcaaagtacactcctgccattgatatttggagcgtagggtgtatatttgctgaattgctcacagggaagccactctttccagggaagaatgttgtgcatcagttggatcttatgactgatctacttggtacaccttcagcagagtctatctccaagataaggaatgagaaagctcgacgatacatgagcaatatgaggaaaaagccccgggttccctttactaaaaagtttccagggatagatcctatggctctccatttgcttgaacgtcttcttgcttttgatcctaaggaacggccaagtgcagctgaggccctgacagatccatactttaatggattagcaaataatgaacgtgaacccatagcacaacctatctcaaaacttgaatttgagtttgagaagcggaaactggccaaagatgatgtccgagaattaatttaccgagagattttggagtaccatcctcaaatgctagaagaatacctacgtggaggagacaacaaccagatgaccttcatgtatccaagtggggtggatcgctttaggcgccaatttgctcatttggaagaaggtaccgccaaaggtgaaaaacccagtccacagctgcgacagaatgtttctttgccaagggaaagagtaatcggcaataaacatggagatggcaatgcaggtgataagctagcccatgcctcagtgacggatggcatcagccaaccggtcttgagtgcgaggagtttgctgaagagtgaaagcatcagtgcttccaagtgtataggtgaaaaaccaaagcatgtgagtacaccaaccacatcagttcataatttcttcattagaatacatgcttatccatattttcttttgggctaa

SEQ ID NO: 19629 - protein, 592 aa, Sorghum bicolor
  misc_feature: Useful for making plants with altered cell wall content and/or composition
  misc_feature: Functional homolog of the protein sequence given in SEQ ID NO 14430
  misc_feature: Ceres ANNOT ID no. 8734179
  misc_feature (94)..(567): SWISSPROT Homolog: EC 2.7.11.24 Mitogen-activated protein kinase
  misc_feature (123)..(414): Pfam ID: Pkinase Pfam Description: Protein kinase domain
MGGRARSLLRWLRHRSRSRRVSSSSSSSSFHLTSTTTNNNDSTATSGDLRARSLPHQFHAEEEEEEREVGEEIAAEPASESEGCIVLGDPEPGAGPRAPVPPLMDPSKKESEFFTEYGEASRYQVSEVIGKGSYGVVAAAVDTQTGERVAIKKIVDVFDHVSDATRILREIKLLRLLRHPDLVEIKHIMLPPSRREFRDIYVIFELMESDLHQVIKANDDLTAEHHQFFLYQLLRGMKYIHAASVFHRDLKPKNILANADCKLKICDFGLARVSFNDTPSAIFWTDYVATRWYRAPELCGSFFSKYTPAIDIWSVGCIFAELLTGKPLFPGKNVVHQLDLMTDLLGTPSAESISKIRNEKARRYMSNMRKKPRVPFTKKFPGIDPMALHLLERLLAFDPKERPSAAEALTDPYFNGLANNEREPIAQPISKLEFEFEKRKLAKDDVRELIYREILEYHPQMLEEYLRGGDNNQMTFMYPSGVDRFRRQFAHLEEGTAKGEKPSPQLRQNVSLPRERVIGNKHGDGNAGDKLAHASVTDGISQPVLSARSLLKSESISASKCIGEKPKHVSTPTTSVHNFFIRIHAYPYFLLG

SEQ ID NO: 19630 - DNA, 267 bp, Sorghum bicolor
  misc_feature: Ceres ANNOT ID no. 8734209
  misc_feature: Encodes the peptide sequence at SEQ ID NO 19631
atggcgtcgatgcagtcgatgacgagcgcagcggcgcgcgcgcagtggacgccgaagcagaacaagctgttcgagcaggcgctggccgtttacgacaaggacacgccggaccggtggcacaacatcgcccgcgccgtcggcggcggcaagtccgccgaggacgtcaggcgctactacgacctgctggaggaggacgtcggccacatcgagtccggcaaggtgcccttcccggcctaccgctgcgccaccggctacggggccgcctga

SEQ ID NO: 19631 - protein, 88 aa, Sorghum bicolor
  misc_feature: Useful for making plants with altered lignin content
  misc_feature: Functional homolog of the protein sequence given in SEQ ID NO 13095
  misc_feature: Useful for making plants with modulated low light sensitivity
  misc_feature: Functional homolog of the protein sequence given in SEQ ID NO 12938
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
  misc_feature: Useful for making plants with modulated nitrogen use efficiency
  misc_feature: Useful for making plants with modulated flowering time
  misc_feature: Functional homolog of the protein sequence given in SEQ ID NO 13566
  misc_feature: The sequence is a functional homolog of SEQ ID NO 976 in the 11/435,388 US patent application
  misc_feature: The sequence is a functional homolog of SEQ ID NO 1973 in the 11/479,226 US patent application
  misc_feature: The sequence is a functional homolog of SEQ ID NO 880 in the 11/435,388 US patent application
  misc_feature: The sequence is a functional homolog of SEQ ID NO 510 in the 10/666,642 US patent application
  misc_feature: The sequence is a functional homolog of SEQ ID NO 1404 in the 11/479,226 US patent application
  misc_feature: The sequence is a functional homolog of SEQ ID NO 662 in the 10/412,699 US patent application
  misc_feature: The sequence is a functional homolog of SEQ ID NO 944 in the 11/435,388 US patent application
  misc_feature: The sequence is a functional homolog of SEQ ID NO 1000 in the 10/225,066 US patent application
  misc_feature: The sequence is a functional homolog of SEQ ID NO 1885 in the 11/479,226 US patent application
  misc_feature: The sequence is a functional homolog of SEQ ID NO 274 in the 10/714,887 US patent application
  misc_feature: The sequence is a functional homolog of SEQ ID NO 274 in the 11/435,388 US patent application
  misc_feature: The sequence is a functional homolog of SEQ ID NO 306 in the 10/374,780 US patent application
  misc_feature: The sequence is a functional homolog of SEQ ID NO 50 in the 10/286,264 US patent application
  misc_feature: The sequence is a functional homolog of SEQ ID NO 928 in the 10/412,699 US patent application
  misc_feature: The sequence is a functional homolog of SEQ ID NO 1930 in the 10/412,699 US patent application
  misc_feature: The sequence is a functional homolog of SEQ ID NO 246 in the 10/714,887 US patent application
  misc_feature: The sequence is a functional homolog of SEQ ID NO 246 in the 11/435,388 US patent application
  misc_feature: The sequence is a functional homolog of SEQ ID NO 452 in the 10/374,780 US patent application
  misc_feature: The sequence is a functional homolog of SEQ ID NO 88 in the 10/225,068 US patent application
  misc_feature: The sequence is a functional homolog of SEQ ID NO 984 in the 10/225,066 US patent application
  misc_feature: Useful for making plants with altered alkaloid content
  misc_feature: Functional homolog of the protein sequence given in SEQ ID NO 13278
  misc_feature: The sequence is a functional homolog of SEQ ID NO 1897 in the 11/479,226 US patent application
  misc_feature: The sequence is a functional homolog of SEQ ID NO 120 in the 11/375,241 US patent application
  misc_feature: The sequence is a functional homolog of SEQ ID NO 2680 in the 10/374,780 US patent application
  misc_feature: The sequence is a functional homolog of SEQ ID NO 654 in the 10/225,066 US patent application
  misc_feature: Ceres ANNOT ID no. 8734209
  misc_feature (13)..(63): Pfam ID: Myb_DNA-binding Pfam Description: Myb-like DNA-binding domain
MASMQSMTSAAARAQWTPKQNKLFEQALAVYDKDTPDRWHNIARAVGGGKSAEDVRRYYDLLEEDVGHIESGKVPFPAYRCATGYGAA

SEQ ID NO: 19632 - DNA, 312 bp, Sorghum bicolor
  misc_feature: Ceres ANNOT ID no. 8734211
  misc_feature: Encodes the peptide sequence at SEQ ID NO 19633
atggcttccggcgggtcgtcgtcgtcgtcgtcccgggcgtggacgcagcggcagaacaagcagttcgagtgcgcgctggcggtgtatgaccgggagacaccggaccggtggcacaacatcgcccgctacatgggcggcaccaagtccgccgacgaggtgcgccgccacttcgagcagctcgtccacgacgtcacccagatcgaggccggccgcgtccccttcccccgctacggctacggcagcgcgccgcccgccggcggcggcggccttgacgacaccagtgatgagctttattattggaaaggtagctag

SEQ ID NO: 19633 - protein, 103 aa, Sorghum bicolor
  misc_feature: Useful for making plants with altered lignin content
  misc_feature: Functional homolog of the protein sequence given in SEQ ID NO 13095
  misc_feature: Useful for making plants with modulated low light sensitivity
  misc_feature: Functional homolog of the protein sequence given in SEQ ID NO 12938
  misc_feature: Useful for making plants with modulated flowering time
  misc_feature: Functional homolog of the protein sequence given in SEQ ID NO 13566
  misc_feature: The sequence is a functional homolog of SEQ ID NO 976 in the 11/435,388 US patent application
  misc_feature: The sequence is a functional homolog of SEQ ID NO 2720 in the 10/374,780 US patent application
  misc_feature: The sequence is a functional homolog of SEQ ID NO 360 in the 10/225,066 US patent application
  misc_feature: The sequence is a functional homolog of SEQ ID NO 876 in the 11/435,388 US patent application
  misc_feature: Useful for making plants with modulated nitrogen use efficiency
  misc_feature: The sequence is a functional homolog of SEQ ID NO 1404 in the 11/479,226 US patent application
  misc_feature: The sequence is a functional homolog of SEQ ID NO 662 in the 10/412,699 US patent application
  misc_feature: The sequence is a functional homolog of SEQ ID NO 944 in the 11/435,388 US patent application
  misc_feature: The sequence is a functional homolog of SEQ ID NO 510 in the 10/666,642 US patent application
  misc_feature: The sequence is a functional homolog of SEQ ID NO 120 in the 11/375,241 US patent application
  misc_feature: The sequence is a functional homolog of SEQ ID NO 2680 in the 10/374,780 US patent application
  misc_feature: The sequence is a functional homolog of SEQ ID NO 654 in the 10/225,066 US patent application
  misc_feature: Ceres ANNOT ID no. 8734211
  misc_feature (11)..(61): Pfam ID: Myb_DNA-binding Pfam Description: Myb-like DNA-binding domain
MASGGSSSSSSRAWTQRQNKQFECALAVYDRETPDRWHNIARYMGGTKSADEVRRHFEQLVHDVTQIEAGRVPFPRYGYGSAPPAGGGGLDDTSDELYYWKGS

SEQ ID NO: 19634 - DNA, 1953 bp, Sorghum bicolor
  misc_feature: Ceres ANNOT ID no. 8734203
  misc_feature: Encodes the peptide sequence at SEQ ID NO 19635
atggccaacgagctccacacagatgacggcacgaccatggtgcgagtgcgggacgaccatcgggagatgagagagaggcatgcggtggggaggatggaggaatcgaggagagagagcatcaggaagaggaaaaaaccatgcagttcattcctcctctaccagttcattaatcaagcaatttctaaaagctcacgagtattgatgatcactgcacatactcgaacttctattgcacgaggccctcaaagaaaatgcatggtcctcgaaatattttatctgactgcaatcagactccggtcacacaggaagcggaagcggcggcgggcgaagcgcgcgacgcagcgcagcgtaacaccaggccgccgggcgctccacggatcatcctctcctcttcttgccggagatccaccaccggggcggccattttccccttcctcaatcaagccggagagtggcggggaggatgcgggcaggacgtcctccgcgtccgacctgcggaagccgctcctgaacaccgggagctggtaccgcatgccgccgccgggcggcatgatgggctcgcggcagtcgagcctcatggagcgcctaggctcctctgccttctccctccgagacgttgctatctcggcgacgctctgcacgctcattgtggctctaggtcctatccagttcggtttcacctgcggttactcctctcccacgcaggacgccatcattgctgacctcggcctctcactctccgagttctctctgttcggatcgttatcaaatgtaggggcgatggtaggtgccatctccagtgggcaacttgcagagtatatcggccgcaaggggtctctcatgattgctgcaattccaaacataattgggtggcttgcgatatcatttgcaaaagattcctcattcttgtttatgggccggctgctagaaggatttggagtgggtgtaatatcttatacagtaccggtttatattgcagaaatcgctcctcaggatcagaggggagctcttggttctgtcaatcagctctccgtcacagttggtatattgcttgcctacctgtttggcatgtttgttccctggagaattcttgctgttctaggcattttaccttgttcaatcctgattcctggactgttctttgtccctgaatccccaaggtggctggcaaaaatggggaagatggaggattttgaatattcactgcaagttctgcgaggatttcagacggacattacagcagaagtaaatgaaataaagagatcagtagcatcatcaaggaggaggacaaccgccataaggtttgctgatatcaagcagaagagatacagtgttccccttgcgataggaatcggtctccttgtcctgcagcagctaagtggtgtcaatggcattctattttatgctgggagcatcttcaaagctgctggtattacaaacagtaatctagcaacctttggtttgggggctgttcaggtgattgctactggagtgacaacctggttgactgacaaagctggtcgaaggcttcttctcattatttctaccacaggaatggtcattactcttgtcattgtttctgtgtcattttttgtgaaggacaacataactgccggttctcacttatactctgcaatgagtatgctttcactggctggacttgtggcatttgtgattgcattttctcttggcttgggagcaattccatgggtcattatgtctgagattcttcctgttaacattaagagccttgctggaagtgttgcaacccttgcgaactggctaacagcatgggccattacaatgactgcaagcctaatgttaaactggagcaatggaggaacctttgctatctatgccgctgtgtctgccatggccctcattttcgtgtgtttgtgggtgccggagaccaagggaagaacattagaggaaatcgcattctcattccgctga

SEQ ID NO: 19635 - protein, 650 aa, Sorghum bicolor
  misc_feature: Useful for biocontainment applications
  misc_feature: Functional homolog of the protein sequence given in SEQ ID NO 13576
  misc_feature: Ceres ANNOT ID no. 8734203
  misc_feature (213)..(649): Pfam ID: Sugar_tr Pfam Description: Sugar (and other) transporter
MANELHTDDGTTMVRVRDDHREMRERHAVGRMEESRRESIRKRKKPCSSFLLYQFINQAISKSSRVLMITAHTRTSIARGPQRKCMVLEIFYLTAIRLRSHRKRKRRRAKRATQRSVTPGRRALHGSSSPLLAGDPPPGRPFSPSSIKPESGGEDAGRTSSASDLRKPLLNTGSWYRMPPPGGMMGSRQSSLMERLGSSAFSLRDVAISATLCTLIVALGPIQFGFTCGYSSPTQDAIIADLGLSLSEFSLFGSLSNVGAMVGAISSGQLAEYIGRKGSLMIAAIPNIIGWLAISFAKDSSFLFMGRLLEGFGVGVISYTVPVYIAEIAPQDQRGALGSVNQLSVTVGILLAYLFGMFVPWRILAVLGILPCSILIPGLFFVPESPRWLAKMGKMEDFEYSLQVLRGFQTDITAEVNEIKRSVASSRRRTTAIRFADIKQKRYSVPLAIGIGLLVLQQLSGVNGILFYAGSIFKAAGITNSNLATFGLGAVQVIATGVTTWLTDKAGRRLLLIISTTGMVITLVIVSVSFFVKDNITAGSHLYSAMSMLSLAGLVAFVIAFSLGLGAIPWVIMSEILPVNIKSLAGSVATLANWLTAWAITMTASLMLNWSNGGTFAIYAAVSAMALIFVCLWVPETKGRTLEEIAFSFR

SEQ ID NO: 19636 - DNA, 1770 bp, Sorghum bicolor
  misc_feature: Ceres ANNOT ID no. 8734236
  misc_feature: Encodes the peptide sequence at SEQ ID NO 19637
atgcagcaggaccagcggaacaagacttctgcagaggccgacttcttcacagagtacggggatgcaaaccggtacaagatccaagaagtcattggtaagggaagctatggggttgtctgctctgccattgatcttcacacccggcagagagtggcgatcaagaagatacacaatatctttgagcatgtctccgatgccgcgaggatcctccgtgagatcaaacttctgaggctcctaaggcaccctgatattgttgagatcaagcacattatgttacctccatcgagaaaggacttcaaggatatttatgttgtttttgagcttatggagtccgatctccaccaagttataaaggccaacgatgacttgaccaaggagcattaccagttctttctctaccagttacttcgggccctcaaatacatccatactgctaatgtttatcaccgtgacctgaagcccaagaatattttagcaaactctaactgcaaattgaaaatatgtgactttggactagcccgggtcgcattcaatgataccccaacaacagtcttctggacggattatgttgcaacaaggtggtacagagctccagagctctgtggatccttcttctccaagtatacaccagctattgacatttggagcattggatgcatatttgctgaggtgttgacagggaagcctttatttcctggtaaaaatgttgttcatcagctagatttgatgactgatcttctaggcacaccatcaacggatacaatttctcgggttcggaatgagaaagcaagaaggtacttgagcagcatgagaaagaaggatcctgttccattttctcagaagtttcctagtgcagatcctttggcacttaaactattagaaaagctattagcgtttgatccaaaggaccgtccaacagcagaagaggcattgcgtgatccatacttcaaaggtctttccaggattgaaagagaaccatcctgtcagccaatcagaaaagtggaatttgactttgagcacaaaagaatgtcaaaggaagagataagagagttgatattccgtgagatactggaatatcaccctcaattgctgaatagctacattaatggcacagagaggacaacctttctctacccaagcgctgtcgatcaatttaagaagcagttttctcatcttgaagaaagtggtggtaacgtcccatcagttccaacagacaggaaacacgcatccctgcccaggactactgttgttcactcgaatccaattcctgccaaggaacaacctcttgctgcctcatcaaaggttagaccagtctctgatgattcatgtaagaatccttgggagaaaggaagtggtcctggaaatgttcccagggcatctctggctccacaagggctgcaaacacaagcagtgatgaattcagggtatcctcctcatcaacagatcccacaagcatatggttaccgccaaatgcctgcaagattggacagtacgaacccatcacaggccatgggaggttacacacagcagtcgcaggcttatgctttttcaaacagcaaaggctcgcctgatgtggctgtgaacatgagagcacccccgttccatcttccatctggaccgaagaataacccattagataggatagcatctgacactgacatatacacaagatcccttaacggcattgttgctgccgccgcggcatcagtaggcgctggcactcaccgaaacgttggcgttgtgccatctggcatgtcaaggatgtattag

SEQ ID NO: 19637 - protein, 589 aa, Sorghum bicolor
  misc_feature: Useful for making plants with altered cell wall content and/or composition
  misc_feature: Functional homolog of the protein sequence given in SEQ ID NO 14430
  misc_feature: Ceres ANNOT ID no. 8734236
  misc_feature (7)..(516): SWISSPROT Homolog: EC 2.7.11.24 Mitogen-activated protein kinase
  misc_feature (25)..(316): Pfam ID: Pkinase Pfam Description: Protein kinase domain
MQQDQRNKTSAEADFFTEYGDANRYKIQEVIGKGSYGVVCSAIDLHTRQRVAIKKIHNIFEHVSDAARILREIKLLRLLRHPDIVEIKHIMLPPSRKDFKDIYVVFELMESDLHQVIKANDDLTKEHYQFFLYQLLRALKYIHTANVYHRDLKPKNILANSNCKLKICDFGLARVAFNDTPTTVFWTDYVATRWYRAPELCGSFFSKYTPAIDIWSIGCIFAEVLTGKPLFPGKNVVHQLDLMTDLLGTPSTDTISRVRNEKARRYLSSMRKKDPVPFSQKFPSADPLALKLLEKLLAFDPKDRPTAEEALRDPYFKGLSRIEREPSCQPIRKVEFDFEHKRMSKEEIRELIFREILEYHPQLLNSYINGTERTTFLYPSAVDQFKKQFSHLEESGGNVPSVPTDRKHASLPRTTVVHSNPIPAKEQPLAASSKVRPVSDDSCKNPWEKGSGPGNVPRASLAPQGLQTQAVMNSGYPPHQQIPQAYGYRQMPARLDSTNPSQAMGGYTQQSQAYAFSNSKGSPDVAVNMRAPPFHLPSGPKNNPLDRIASDTDIYTRSLNGIVAAAAASVGAGTHRNVGVVPSGMSRMY

SEQ ID NO: 19638 - DNA, 1119 bp, Sorghum bicolor
  misc_feature: Ceres ANNOT ID no. 8734252
  misc_feature: Encodes the peptide sequence at SEQ ID NO 19639
atgtctggaggagcaacaggagttggaggaggcagcggctacgggggcttctaccacggggacgatcctgccacctccgaccagctcatcacagccttcgacaacgacggcggcggcggcttcttcttccagcagacggtctcgccgccgtgcgccggggaagtggacggcggcacggcgccgtacgcgagcatcgcggactacctgcagggattcctggaccccgcgggcctggccgcgcacttcggcagcgacgacgcgccgccgccgtgccggttgggcggcggcgccgacgacgagtacgacgctgtggtggcggtgaagcaagaaatggttgtccagctgagtgacagccgccgtgacgccgacgccgatggtcagatggccggcgcggcggccgtcacgccggccaactcatcggtgctgtcgtcatccagctgcgaggcgggagcggatgccaacgacgacgacgaggagccgtcgcgccggcggtgcggcaagaaaggtaggatcgagggagaggaggagcaggagggagaaggagaagctgacgatgatgcagccgatcggaactgcaagagcagcaaggagaataagaaaaggagaggcgagaagaaggcgcgggagccccgtgtggcgttcatgaccaagagcgaggtcgaccacctcgaggacggctaccgctggcgcaagtacggccagaaggccgtcaagaacagcacatacccaaggagctactaccggtgcacgacggcgcggtgcggggtgaagaagcgggtggagcggtcgcagcaggacccgtccacggtgatcaccacgtacgaggggcagcacacgcacccgagccccatcgacctcctcaggagaggaggaggcgccgccgccctcatgcgctccgccgccgttgccggcggctttcgccgccccgacgacctgctcaagatcgacgattacgctggcacgccgatcggcttcctgccgcttctccctcccggtggcatcggtgctggtggtggtggccgcctgctgcatcaccgagctcgttcttcgcagctggccgccgtggacgcgtatggcggcatgctggagctggacttcatcccttccattccgcgatga

SEQ ID NO: 19639 - protein, 372 aa, Sorghum bicolor
  misc_feature: The sequence is a functional homolog of SEQ ID NO 86 in the 10/412,699 US patent application
  misc_feature: The sequence is a functional homolog of SEQ ID NO 1640 in the 11/479,226 US patent application
  misc_feature: The sequence is a functional homolog of SEQ ID NO 2 in the 10/225,066 US patent application
  misc_feature: The sequence is a functional homolog of SEQ ID NO 254 in the 10/374,780 US patent application
  misc_feature: The sequence is a functional homolog of SEQ ID NO 30 in the 10/714,887 US patent application
  misc_feature: The sequence is a functional homolog of SEQ ID NO 30 in the 11/435,388 US patent application
  misc_feature: The sequence is a functional homolog of SEQ ID NO 808 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: The sequence is a functional homolog of SEQ ID NO 134 in the 10/714,887 US patent application
  misc_feature: The sequence is a functional homolog of SEQ ID NO 134 in the 11/435,388 US patent application
  misc_feature: The sequence is a functional homolog of SEQ ID NO 1533 in the 10/374,780 US patent application
  misc_feature: The sequence is a functional homolog of SEQ ID NO 1617 in the 10/412,699 US patent application
  misc_feature: The sequence is a functional homolog of SEQ ID NO 156 in the 10/714,887 US patent application
  misc_feature: The sequence is a functional homolog of SEQ ID NO 156 in the 11/435,388 US patent application
  misc_feature: The sequence is a functional homolog of SEQ ID NO 154 in the 10/714,887 US patent application
  misc_feature: The sequence is a functional homolog of SEQ ID NO 154 in the 11/435,388 US patent application
  misc_feature: Ceres ANNOT ID no. 8734252
  misc_feature (223)..(282): Pfam ID: WRKY Pfam Description: WRKY DNA -binding domain
MSGGATGVGGGSGYGGFYHGDDPATSDQLITAFDNDGGGGFFFQQTVSPPCAGEVDGGTAPYASIADYLQGFLDPAGLAAHFGSDDAPPPCRLGGGADDEYDAVVAVKQEMVVQLSDSRRDADADGQMAGAAAVTPANSSVLSSSSCEAGADANDDDEEPSRRRCGKKGRIEGEEEQEGEGEADDDAADRNCKSSKENKKRRGEKKAREPRVAFMTKSEVDHLEDGYRWRKYGQKAVKNSTYPRSYYRCTTARCGVKKRVERSQQDPSTVITTYEGQHTHPSPIDLLRRGGGAAALMRSAAVAGGFRRPDDLLKIDDYAGTPIGFLPLLPPGGIGAGGGGRLLHHRARSSQLAAVDAYGGMLELDFIPSIPR

SEQ ID NO: 19640 - DNA, 1626 bp, Sorghum bicolor
  misc_feature: Ceres ANNOT ID no. 8734276
  misc_feature: Encodes the peptide sequence at SEQ ID NO 19641
atgggtggccgcgcctcccgccaccgcgcgcagcagcaggaccagtcctcccaccacgcctcctcccgtcctccgccgccgccgccgcccaagcagcagcagcagcaccaccaccaccccaataagcccaagcagcagcagcccccacctccgcgtcctccgccgccacaccatgctcctccccccgcccccgcccccacccagggcggggcgaccaacatcggccgcgtgctggggcggccgatggaggacgtgcgggcatcctacacgttcgggcgtgagctaggccggggccagttcggcgtgacctacctagccacgcacaagcccacgggccgccgctacgcgtgcaagtccatcgccacccgcaagctcgcgcacctggacgacgtggaggacgtgcggcgggaggtgcagatcatgcaccacctcacgggccaccgcagcatcgtcgagctccggggcgcctacgaggaccgccactccgtcaacctcgtcatggagctctgtgagggcggggagctcttcgaccgcatcatcgcccgcgggcactactccgagcgcgccgccgcgtcgctctgcagggagatcgtctccgttgttcatagctgccactccatgggggtcatgcatcgggacctcaagcctgagaacttcctcttccttagtaagagggaggactcgccgctcaaggccacggattttgggctctccgtcttcttcaagcccggcgagcagttcagggatcttgtcgggagcgcctactacgtcgccccggaggtgctcaagcggcgatacggagctgaggcggacatatggagtgccggagttatcctctacatcctgctatccggcgttcctcctttctgggccgagaacgaggatggcatatttgatgctgttttgcgaggtcatattgacttcgcatctgatccctggccttccatatcgaatagcgcaaaagatttggtcaagaagatgctgcgccaagatcccaaggagcggcttactgctgctgaaattttgaaccatccatggattagggaggatggagaggcgccagacaagccaatagacattacagtaataagcagaatgaagcagttccgggcaatgaacaagcttaagaaggttgccttgaaggtcgttgcagagaacttgtcagaggaagagattgtgggcttgaaagaaatgttcaaatccctggatactgataacagtgggacaataacgctggaagaactgagagctggtttaccaaagctcggcaccaaaatctctgaatcagaaataagacagttgatggaagcggctgatgttgatggaaatggtaccattgattatgttgaattcatatcagcaacaatgcacatgaatagactagagaaagaggatcacatttttaaagcattcgagtatttcgataaggaccatagcgggcacattacagttgatgagttggaagaagctctgaagaagtatgatatgggtgatgaagcaacaattaaagaaattattgctgaagtagatacagatcatgatgggagaatcaactaccaggagtttgttgccatgatgaagaataatagctctgatattgttcccaatcggaggcgcatgttttaa

SEQ ID NO: 19641 - protein, 541 aa, Sorghum bicolor
  misc_feature: The sequence is a functional homolog of SEQ ID NO 2 in US patent 7084323
  misc_feature: Ceres ANNOT ID no. 8734276
  misc_feature (77)..(527): SWISSPROT Homolog: EC 2.7.11.1 Non-specific serine/threonine protein kinase
  misc_feature (89)..(347): Pfam ID: Pkinase Pfam Description: Protein kinase domain
  misc_feature (501)..(529): Pfam ID: efhand Pfam Description: EF hand
  misc_feature (394)..(422): Pfam ID: efhand Pfam Description: EF hand
  misc_feature (466)..(494): Pfam ID: efhand Pfam Description: EF hand
  misc_feature (430)..(458): Pfam ID: efhand Pfam Description: EF hand
MGGRASRHRAQQQDQSSHHASSRPPPPPPPKQQQQHHHHPNKPKQQQPPPPRPPPPHHAPPPAPAPTQGGATNIGRVLGRPMEDVRASYTFGRELGRGQFGVTYLATHKPTGRRYACKSIATRKLAHLDDVEDVRREVQIMHHLTGHRSIVELRGAYEDRHSVNLVMELCEGGELFDRIIARGHYSERAAASLCREIVSVVHSCHSMGVMHRDLKPENFLFLSKREDSPLKATDFGLSVFFKPGEQFRDLVGSAYYVAPEVLKRRYGAEADIWSAGVILYILLSGVPPFWAENEDGIFDAVLRGHIDFASDPWPSISNSAKDLVKKMLRQDPKERLTAAEILNHPWIREDGEAPDKPIDITVISRMKQFRAMNKLKKVALKVVAENLSEEEIVGLKEMFKSLDTDNSGTITLEELRAGLPKLGTKISESEIRQLMEAADVDGNGTIDYVEFISATMHMNRLEKEDHIFKAFEYFDKDHSGHITVDELEEALKKYDMGDEATIKEIIAEVDTDHDGRINYQEFVAMMKNNSSDIVPNRRRMF

SEQ ID NO: 19642 - DNA, 1320 bp, Sorghum bicolor
  misc_feature: Ceres ANNOT ID no. 8734301
  misc_feature: Encodes the peptide sequence at SEQ ID NO 19643
atgccgccggcgctgcgcctgctcgtcgcgacggcgctgctgctgctgtcgtcgtcggcgggggcgcaggattcgtgttggtcggggccggcgccgctgcgcggggcgtggatgtccgtggccagcttcggcgcgcgcggggacgggcagacgctcaacacgggcgcgttcgcgcgcgccgtggcgcgcatcgagcgccgccgcggcgcgcggggtggcacgctgctgtacgtgccgcccggggtgtggctcacgggccccttcaacctcacctcccacatgacgctcttcctcgcccgcggcgccgtcatccgcgccacccaggacacgtcgagctggccgctcatcgacccgctgccgtcgtacgggagagggcgcgagctgcctggcgggaggtacatgagcttgatccacggcaatggtctccaagacgtcttcatcacaggtgagaacggcaccattgacggccaaggcagcttgtggtgggacatgtggaagaagcgcacgctgcccttcacgaggccgcacctgctggagctcatgtactccaccgacgtcgtcgtctccaacgtcgtcttccaggactcgccgttctggaacatccacccggtttactgcagcaatgtagtaatagcgaacgtgactgtgttggcaccacatgactccccaaacactgatggcatcgatctagattcaagcagcaatgtctgcattgaggactcctacatttccgcgggcgatgacctgatttccatcaagagtggctgggacgagtacggcattgcttttggccgtccaagctctggcatcaccatccgaaggataaccgggtccgggccatttgctggctttgcagttggaagcgagacatctggtggcgtggagaatgttcttgtcgagcacctgaatctcttcggcatgggtgttgggatccatatcaagaccaactcaggaaggggaggattcatccggaacatcaccgtctctgaagtgaccttgaatggagctcggtatggtttgaggatcgccggtgacgttgggggccaccctgatgcgtcctacaacccaagtgtgcttcctgttgtcaacagcgtgacgattaagaatgttttgggtcagaacatccggcaggctgggctgataaggggcatcagaaactcggttttcagtaacatatgcctctcaaatgtaaagctctatgggagtgcatccatcgggccatggaaatgccgagctgttagtggtgccgcacttgatgtgcagccatcaccatgtacagagctggctagtacatctgagacaggtttctgtacaagttag

SEQ ID NO: 19643 - protein, 439 aa, Sorghum bicolor
  misc_feature: Useful for making plants with altered carbohydrate content
  misc_feature: Functional homolog of the protein sequence given in SEQ ID NO 14427
  misc_feature: Useful for making plants with altered cell wall content and/or composition
  misc_feature: Functional homolog of the protein sequence given in SEQ ID NO 14428
  misc_feature: Ceres ANNOT ID no. 8734301
  misc_feature (199)..(384): SWISSPROT Homolog: EC 3.2.1.15 Polygalacturonase
  misc_feature (70)..(426): Pfam ID: Glyco_hydro_28 Pfam Description: Glycosyl hydrolases family 28
MPPALRLLVATALLLLSSSAGAQDSCWSGPAPLRGAWMSVASFGARGDGQTLNTGAFARAVARIERRRGARGGTLLYVPPGVWLTGPFNLTSHMTLFLARGAVIRATQDTSSWPLIDPLPSYGRGRELPGGRYMSLIHGNGLQDVFITGENGTIDGQGSLWWDMWKKRTLPFTRPHLLELMYSTDVVVSNVVFQDSPFWNIHPVYCSNVVIANVTVLAPHDSPNTDGIDLDSSSNVCIEDSYISAGDDLISIKSGWDEYGIAFGRPSSGITIRRITGSGPFAGFAVGSETSGGVENVLVEHLNLFGMGVGIHIKTNSGRGGFIRNITVSEVTLNGARYGLRIAGDVGGHPDASYNPSVLPVVNSVTIKNVLGQNIRQAGLIRGIRNSVFSNICLSNVKLYGSASIGPWKCRAVSGAALDVQPSPCTELASTSETGFCTS

SEQ ID NO: 19644 - DNA, 966 bp, Sorghum bicolor
  misc_feature: Ceres ANNOT ID no. 8734337
  misc_feature: Encodes the peptide sequence at SEQ ID NO 19645
atggcgcccatctgctcccttctcttcctcctctttctactgcctccttccaccgccgctgtctccaagcccaagccgcccgcgcggtaccggtaccacacgctccgcgccaccccgctctccccggaccccatcacccgagccgacgccgcgcttcctctcttctccgccgcctcaggcgaagcacccatcttggagctggattcggacgacaacggcaacgcctccaccgtccgctttctcctcgcccaccgcgaggcgttcgcggcgcccaacgccacggcggcccagctcctggcgcaccgcctggcgcgcgacgccgctcgggccgaggcgatctccgtgtccgcgaggaacgtgacgcgcgccggcggcgggttctcggcgcccgtggtgtccggcctggcgcagggcagcggcgagtacttcgcttcggtgggcgtgggcacgccaccgacgcccgcgctgctggtgctggacaccggcagcgacgtggtgtggctgcagtgcgcgccgtgccggcagtgctacgcgcagtcgggccgggtgttcgacccgcgccggtcccggtcgtacgccgccgtccgctgcggcgcgccgccctgccgcggcctcgacgccgggggcggcggcggctgcgaccggcggcgcgggacgtgcctgtaccaggtggcgtacggggacgggtccgtcacggcgggggacctggccacggagacgctgtggttcgcgcggggcgcgcgggtgccgcgcgtcgccgtcgggtgcgggcacgacaacgagggcctgttcgtggccgccgcggggctgctaggcctcggccgcggccggctgtcgctgcccacccagacggcgcgccgctacggccgccgcttctcctactgcttccaaggctctgatcttgatcaccgaagtaatgcccaccgactagactcggtcaacaatcatcaacacacaagcaattga

SEQ ID NO: 19645 - protein, 321 aa, Sorghum bicolor
  misc_feature: Useful for making plants with modulated biomass
  misc_feature: Functional homolog of the protein sequence given in SEQ ID NO 13548
  misc_feature: Ceres ANNOT ID no. 8734337
  misc_feature (116)..(295): SWISSPROT Homolog: EC 3.4.23.12 Nepenthesin
MAPICSLLFLLFLLPPSTAAVSKPKPPARYRYHTLRATPLSPDPITRADAALPLFSAASGEAPILELDSDDNGNASTVRFLLAHREAFAAPNATAAQLLAHRLARDAARAEAISVSARNVTRAGGGFSAPVVSGLAQGSGEYFASVGVGTPPTPALLVLDTGSDVVWLQCAPCRQCYAQSGRVFDPRRSRSYAAVRCGAPPCRGLDAGGGGGCDRRRGTCLYQVAYGDGSVTAGDLATETLWFARGARVPRVAVGCGHDNEGLFVAAAGLLGLGRGRLSLPTQTARRYGRRFSYCFQGSDLDHRSNAHRLDSVNNHQHTSN

SEQ ID NO: 19646 - DNA, 1287 bp, Sorghum bicolor
  misc_feature: Ceres ANNOT ID no. 8734394
  misc_feature: Encodes the peptide sequence at SEQ ID NO 19647
atgggagaagccaaggagaacgacgtctacgaagaggagctcctggactacgaggaggacgatgacaagacggtcgatggctccgccgccaagcccactggagaggtcgcgaagaagggctacgtcgggatccacagttccggtttcagagacttcctgctcaagccagagctgcttcgtgctattcaggattgcggttttgaacatccttccgaagtgcaacacgagtgcatccctcaagccattcttggaatggatgtcatctgtcaagctaaatctgggatggggaaaactgctgtttttgtcctttcatccctccaacaaattgaccctgttgcgggtcaggtagcagcacttgtactgtgccacactagggaactggcttaccagatatgtcacgaatttgagaggttcagcaaatatctccctgaagttaaagttgctgtcttctatggaggtgttcacatcaggaagcataaagatttgttgaagaatgaatgccctcatattgtggtcggcacgcctggaaggatacttgctcttgccagggataaggatctctccctgaagaatgtgaggcacttcattcttgatgaatgtgacaagatgcttgaatcactagacatgcggagagacgttcaggagatcttcaaaatgactcctcatgataagcaagtcatgatgttttccgcaactctcagcaaggagattcgtcctgtatgcaagaaatttatgcaagatccgatggaaatatatgttgatgatgaggcaaagttgaccctccatggtcttgtacagcactatataaaacttagcgaggctgagaagaaccggaaactgaatgatctcttggatgctctagatttcaaccaagttgtgatatttgtgaagagtgttagcagagctgccgaactgaataagttgctttgtgagtgcaacttcccatcaatctgcattcattctggaatgacccaggaagaaaggctaaccagatataagaacttcaaggagggtcacaagagaattcttgtggctacagatttagttggcaggggcattgacattgagcgtgtcaacattgtgataaactatgacatgccagactcagctgatacatatttgcacagggttggaagggctggtcgatttggcacgaagggacttgcaattacctttgtttcctctgcttcggattctgatgttcttaaccaagtgcaagaaaggtttgaggtagacataaaggaattgcctgagcaaattgacacttccacctacatgccatcataa

SEQ ID NO: 19647 - protein, 428 aa, Sorghum bicolor
  misc_feature: Useful for biocontainment applications
  misc_feature: Useful for making plants with modulated biomass
  misc_feature: Useful for making plants with modulated cold sensitivity
  misc_feature: Functional homolog of the protein sequence given in SEQ ID NO 14420
  misc_feature: Ceres ANNOT ID no. 8734394
  misc_feature: Down-regulated in shoot tissues in response to salicylic acid treatment
  misc_feature (71)..(240): Pfam ID: DEAD Pfam Description: DEAD/DEAH box helicase
  misc_feature (308)..(384): Pfam ID: Helicase_C Pfam Description: Helicase conserved C-terminal domain
MGEAKENDVYEEELLDYEEDDDKTVDGSAAKPTGEVAKKGYVGIHSSGFRDFLLKPELLRAIQDCGFEHPSEVQHECIPQAILGMDVICQAKSGMGKTAVFVLSSLQQIDPVAGQVAALVLCHTRELAYQICHEFERFSKYLPEVKVAVFYGGVHIRKHKDLLKNECPHIVVGTPGRILALARDKDLSLKNVRHFILDECDKMLESLDMRRDVQEIFKMTPHDKQVMMFSATLSKEIRPVCKKFMQDPMEIYVDDEAKLTLHGLVQHYIKLSEAEKNRKLNDLLDALDFNQVVIFVKSVSRAAELNKLLCECNFPSICIHSGMTQEERLTRYKNFKEGHKRILVATDLVGRGIDIERVNIVINYDMPDSADTYLHRVGRAGRFGTKGLAITFVSSASDSDVLNQVQERFEVDIKELPEQIDTSTYMPS

SEQ ID NO: 19648 - DNA, 1839 bp, Sorghum bicolor
  misc_feature: Ceres ANNOT ID no. 8734364
  misc_feature: Down-regulated in shoot tissues in response to salicylic acid treatment
  misc_feature: Encodes the peptide sequence at SEQ ID NO 19649
atggacggggagggcccagcccagatgcctgcctgcctgcctcaacggcccagacgtcaccacgtgacgccaccacctctcctcttcttctgtgtgtgcgcgctcacacaaatcaatcaatcaatcaatcaatctccccaaaaaggaagcacgttacgctccgtccggagagggccccacgccgcgcctgaaccgaatccatccagtccatggccaacactgccaggtgggcctccccgtggctgcccagccattcctctcctcctcctcctcctcctcctcctctccccctgcatcggccagccagcccagccctttcacgctccaccgaccaccgtgcgcgcgcgggcgggcgggcgggcggggggcggcgcggcttcgctcaactccactcgcgccggcctgcctgcctgcctgcggccgcgggcggcttccgtcgccgccaggatctgcctacgagcccccgccacgcacccccactccccgacgcgcatcacgccacgggagcgccaccactaccgccgccaatggctctctgccctgaccaatcccatggacgacctcaccgcggggggcctcgagctcttcgccgcagtcgctgacttcatagacgactccgctcctccagccgccgcgatgccgccgcagcagccggagcccgactccgcgcccgggagcccctgctccgtcgccagcgactgcagcagcgtcgccaccgccgacttcgagggattcgccgacctcggctccgctctcgtgctcgacgacctcgtcgcctccgcctccacctctctccccgcctccgggcccagggcctccgcagctgcagctcccgctaggagcgtcttcgcgctcgactgcgtgccgcgttgggggctcgagtccgtgtgcggccgacgacccgagatggaggacgccgcccgcgtgctgccaaccttcttccacgtcccgctctggatgctcgccggcgacgcgcccgtcgacggcctcgaccgggcctccttccgccttcccacgcactttttcggcgtctacgacggccacggcggccttcaggtcgccaactactgccgggagagaatccacaaggtactggcggaggagctcaccaaggcacaggaggccgcgtccgacgctgacttgagtgctcttgaccctaataatactcacaagcactgggagaaggcctttgtggactgcttcagccgtgttgatgcagaggtgggaggaaacgcggccacccaaggcaagcctgtggctccagacaccgtggggtcaacagcggtggctgcgcttgtctgctcatcgcatgtcatcgttgccaattgcggcgactcgcgagcagtgctctgccggggcaagcagcccctgacgctgtccgtggaccataaaccaaacagggaagatgagtatgcgaggattgaggcccaagggggcaaggtcatcaattggaatggctatcgagttctcggtgttcttgccatgtcccggtcaattggggacagatacctgaagccatatgtaatcccagtccctgaggtcacaatcgttgcccgtgctaaagatgacgagtgcctaattattgcaagcgatggcctttgggatgtaatgtcaaatgaggaggtatgtgatgctgcccgcaagcgcatactgctttggcacaagaagaatgcagacgcctcatcatcagcccaaagaagcggtgattcagcagatgaagcagctcaagcagctgctgaatatttgtcaaagctggctctccagaaggggagcaaagacaacataaccgtcattgtagtcgacctcaagtcacatagaaagttcaagagcagaacatag

SEQ ID NO: 19649 - protein, 612 aa, Sorghum bicolor
  misc_feature: Useful for making plants with modulated drought sensitivity
  misc_feature: Functional homolog of the protein sequence given in SEQ ID NO 14719
  misc_feature: Ceres ANNOT ID no. 8734364
  misc_feature (282)..(612): SWISSPROT Homolog: EC 3.1.3.16 Phosphoprotein phosphatase
  misc_feature (289)..(595): Pfam ID: PP2C Pfam Description: Protein phosphatase 2C
MDGEGPAQMPACLPQRPRRHHVTPPPLLFFCVCALTQINQSINQSPQKGSTLRSVRRGPHAAPEPNPSSPWPTLPGGPPRGCPAIPLLLLLLLLLSPCIGQPAQPFHAPPTTVRARAGGRAGGGAASLNSTRAGLPACLRPRAASVAARICLRAPATHPHSPTRITPRERHHYRRQWLSALTNPMDDLTAGGLELFAAVADFIDDSAPPAAAMPPQQPEPDSAPGSPCSVASDCSSVATADFEGFADLGSALVLDDLVASASTSLPASGPRASAAAAPARSVFALDCVPRWGLESVCGRRPEMEDAARVLPTFFHVPLWMLAGDAPVDGLDRASFRLPTHFFGVYDGHGGLQVANYCRERIHKVLAEELTKAQEAASDADLSALDPNNTHKHWEKAFVDCFSRVDAEVGGNAATQGKPVAPDTVGSTAVAALVCSSHVIVANCGDSRAVLCRGKQPLTLSVDHKPNREDEYARIEAQGGKVINWNGYRVLGVLAMSRSIGDRYLKPYVIPVPEVTIVARAKDDECLIIASDGLWDVMSNEEVCDAARKRILLWHKKNADASSSAQRSGDSADEAAQAAAEYLSKLALQKGSKDNITVIVVDLKSHRKFKSRT

SEQ ID NO: 19650 - DNA, 2730 bp, Sorghum bicolor
  misc_feature: Ceres ANNOT ID no. 8734417
  misc_feature: Encodes the peptide sequence at SEQ ID NO 19651
atggggtctcatgatggtgaggatgaagagttgccaccacccccgcccgtgccaccagatgtggttcccattaaagctgaagatgttgtgggggaaccaccagcaaacaagccaataaagccaaagagattactgatggacaggcctggtataggaagaaaagggcagctagcccagctctattcaaatcactttaaagtcgccgtgaagagcacagaagacttcttctttcactattatgtgaacctgaagtatgaggatgatcaacctgttgaaggtaaagggattggcagaaaggtgattgataaactgcagcagacatatcgcgctgagctttccaacaaggattttgcatatgacggagaaaagagcctgtttacagttggtgggcttccacaaaaaaacaatgagttcactgtcgtcttggaggacgcgtctactggaaagactgctgccaatgggagccctggcggtaatgacagtcctggaggtggtgacaggaagagagtgaggaggccataccagacgaaaactttcaaagtggagataaattttgcagcaaaggttcctatgagtgctattggtcaagtcattagaggcgaagaaacggagaactccctggaggcacttcgtgttcttgatatcatactgaggcagcattccgcagaacaaggctgccttttggttaagcaatcgtttttctacaacaacccttcaaactttgttgacttgggtggtggcgtgatgggttgccgtggatttcattcaagtttccgcggcacacagagtggactttccctgaacgttgatgtctcaacaacaatgatcgtgaagcctggccctgttattgattttcttctttctaaccagaatgttaatgatcctagcagaattgattggcaaaaggccaagcgtgctctcaagggcttgaggattagaaccactcctgcaaatgcagaattcaagatttttggtctcagcgagaggatttgtaaagaacaaacgtttccgctgaggcagagaaatggtagcaacggagattgtgataccattgatataactgtctatgactactatgcgaagaaaggaattgatctaaagtactctggtgatttgccttgtataaatacagggagggcaaagcgtccaacatattttccaatcgagctatgctgccttgttccgcttcaaagatacaccaaagctttgtctacgctacaaaggtcatcccttgttgagaagtctagacagaagcctcaagaaaggatgacagttctaaacgatgcactgcaacgcagtaactatgattctgaccccatgttgagggcatgtggcgtttcagttgctccaaaatttacccaagttgaaggaaggatccttcaagccccaaagctgaaagccggcaatggtgatgatatcttctcacgaaatggacggtggaatttcaccaataggaagttttatcaaacctgctctgtggataagtgggcggttgttaatttctctgcacgttgtgatgttcggaatctcatccgtgacctgatgaggaatgcatctgcaaagggaattcaaatggaggaaccttttgatgtgtttgaagagagcccctctatgaggcgtgcacccgtgtcgagaagagtggatgatatgtttgggcagataaaatcaaaacttcctggagctcctaggttcctcatgtgccttctccctgagaggaaaaattgcgaagtctatggtccttggaagagaaagtgcctggccgagtttggtattgtcacacagtgtctagctccaacaagagtcaatgatccgtacctgcttaatttgctgatgaagattaatgcaaagcttggtggtctgaattcgttgctgcaagttgaagcatctccatcaataccccatgtgtcggaagtacccaccatcatcttgggtatggatgtgtctcatggccatccaggacaagataggccttcagttgcagccgtggttagttctcgtcaatggcctcttatctctaaatatagagcatcagtgcacacccaatccgccagactagaaatgatgtcctccttgtttaagccacggggtactgatgatgatggcctcattagggaatcactgattgacttctacactagctctggcaagcgaaaaccagaccacattatcattttcagggatggagtcagcgaaagtcagtttacccaggtcatcaacattgaactggatcagataattgaggcatgtaagtttcttgatgagaagtggtcacccaagttcactgtgattgttgctcaaaagaaccaccacaccaagttttttcagaccggatcaccagacaatgttcttcccggaactgtcgtggacaataaagtttgccatcctaagaactttgacttctacatgtgtgcacatgctgggatgattggaacaacaaggccgacccattatcatgttctgcacgatgagataggtttctctgctgacgaaatgcaggagtttgttcattcgctctcttatgtgtatcaaaggagcacaacagccatctcagtagttgctccaatctgctatgcccaccttgctgcagcccaggtgggcacgttcctgaaattcgaggagatgtcagacacgtcctccagccagggagggcatacctcggcgggcagtgctcccgtgccggagctgcctcgcctgcatgagaaagtgaggagttccatgttcttctgctga

SEQ ID NO: 19651 - protein, 909 aa, Sorghum bicolor
  misc_feature: The sequence is a functional homolog of SEQ ID NO 2 in the 11/375,241 US patent application
  misc_feature: The sequence is a functional homolog of SEQ ID NO 2562 in the 10/374,780 US patent application
  misc_feature: Ceres ANNOT ID no. 8734417
  misc_feature: Down-regulated in shoot tissues in response to salicylic acid treatment
  misc_feature (564)..(870): Pfam ID: Piwi Pfam Description: Piwi domain
  misc_feature (280)..(418): Pfam ID: PAZ Pfam Description: PAZ domain
MGSHDGEDEELPPPPPVPPDVVPIKAEDVVGEPPANKPIKPKRLLMDRPGIGRKGQLAQLYSNHFKVAVKSTEDFFFHYYVNLKYEDDQPVEGKGIGRKVIDKLQQTYRAELSNKDFAYDGEKSLFTVGGLPQKNNEFTVVLEDASTGKTAANGSPGGNDSPGGGDRKRVRRPYQTKTFKVEINFAAKVPMSAIGQVIRGEETENSLEALRVLDIILRQHSAEQGCLLVKQSFFYNNPSNFVDLGGGVMGCRGFHSSFRGTQSGLSLNVDVSTTMIVKPGPVIDFLLSNQNVNDPSRIDWQKAKRALKGLRIRTTPANAEFKIFGLSERICKEQTFPLRQRNGSNGDCDTIDITVYDYYAKKGIDLKYSGDLPCINTGRAKRPTYFPIELCCLVPLQRYTKALSTLQRSSLVEKSRQKPQERMTVLNDALQRSNYDSDPMLRACGVSVAPKFTQVEGRILQAPKLKAGNGDDIFSRNGRWNFTNRKFYQTCSVDKWAVVNFSARCDVRNLIRDLMRNASAKGIQMEEPFDVFEESPSMRRAPVSRRVDDMFGQIKSKLPGAPRFLMCLLPERKNCEVYGPWKRKCLAEFGIVTQCLAPTRVNDPYLLNLLMKINAKLGGLNSLLQVEASPSIPHVSEVPTIILGMDVSHGHPGQDRPSVAAVVSSRQWPLISKYRASVHTQSARLEMMSSLFKPRGTDDDGLIRESLIDFYTSSGKRKPDHIIIFRDGVSESQFTQVINIELDQIIEACKFLDEKWSPKFTVIVAQKNHHTKFFQTGSPDNVLPGTVVDNKVCHPKNFDFYMCAHAGMIGTTRPTHYHVLHDEIGFSADEMQEFVHSLSYVYQRSTTAISVVAPICYAHLAAAQVGTFLKFEEMSDTSSSQGGHTSAGSAPVPELPRLHEKVRSSMFFC

SEQ ID NO: 19652 - DNA, 2394 bp, Sorghum bicolor
  misc_feature: Ceres ANNOT ID no. 8734432
  misc_feature: Down-regulated in shoot tissues in response to salicylic acid treatment
  misc_feature: Encodes the peptide sequence at SEQ ID NO 19653
atgtggcaccagccaccgacatcagcagaggaagccatcttcgtccctgtacgcacgcgacgagcacaagcagccagatgccctcgcccgcgtcctccacaccaaggcagctcgaatccaggtcaggttcgccactcctgctgcttgctgttcgccatgagatctctcccgtgctttatgagaccatctcttggctcctcatctactgcaccaccacatacaactcccttcgtggccgccgggaaggaggtgcgcaagcgctcggctgtggtggctgttggagagggaggggccgtggcggagctgctcgcgctagcaccagagttgctcgtgcgggaggttggggatgaagttgacaagttgggcccacatggcggtgagaggagctatgggaccatgctgtcagagagggagagagaaaggagcaaggcaagggcagcttcgtcttttcgcaatgcatcgccacgctggcaccctgacctggcacgccacaccagcaaaaagtttcctgacgagagcaattctaagagtaagcctgggcattcgggttacccgattttttcgggtcgggtaattcaaaattcgggatcgggtacctcgggttcgggtaattcgggtttggatccgggtaattcgggtacgggtaatgggtattgggtaatttgcccaggcctatctaagagtgatattcggataggtggcattcttaataatggtaaaaatgtaaatgtcccggtggcccctgtcatgccttctacttcaatctcctctgccagcgcagcggggaaaggagggtcgaaagctatgcagccgccgccgcagcttccggcggctttgccggtagggttccgcttccgcccgacggacgaggagctggtgcggcactacctcaagcccaaaatcgcgggtcacgcgcacgcggacctgctcctcatccccgatgtcgacctctcggcgtgcgagccctgggagctgcccgctaaggccctcatcaggtccggcgaccccgagtggttcttcttcgcgcccctcgaccgcaagtaccccggcggccaccgctccaaccgctccaccgctgccgggtactggaaggccacgggcaaggaccgcctcatccgctcgcgccgagcagggaccctcatcggcgtcaagaagacgctcgtcttccacagaggcagggcgccccgaggccaccgcaccgcttggatcatgcacgagtaccgcacggccgagccccagctccagcaaggccaaaacggtagcttcgtgctctaccgcctattcaacaagaacgagggggaatccgaagcctcagatgccgctgattcaccgtccacatcatctccggcaatcgcgccagcggtgaaagctgagaatttgagccagccggcttctgccaaaatgtctcatcttcttgcaactgtcagtagcaatgagccaacatccaaccagcttccagacttacagcgtgagcataaattcgacggattccctacaatcacctctccgatgcgtccttacactgatcatccttttcttggcaatgctggcgagcaagatctttcagtgtatatagatagtatcattgctcatcaggatctggaggacttgttggccagcccttgtttggctgatatggttgagcaggccactgtaaatgttgagccccaccctacttctctacccattctagacaacagctcaaacagcaagagattggctgaaaatagccgtggaaaagttggttctgaaacgttgctcctaatcaagggtacagatgacacaggtgctgctgcttcctgttctgcaaccaaaatactacaagctgataaagacaatattaatcatcacacaggagctcagagtaacttggcttccaatgcatcagctcaagtgtcccacttttacaaccaatatcaacttcaatcggcattcattcctgaaacggaaccaccaaatagtggagccttgtgctctgcagcttccttgactccttatccccagcacttgttcaatggtatggtagcaccggctaggattgacatttcagattcagatgtctttaatggactccaaggatgggcagcggaaccttctaaggatccacaccaagggaatgcaccaagaaggatccgccttgtgcactctattcagagggcatcagtaattgagcctgtactaacttctcatttggagggtgaagatgaagcaggattatgttacagcacagacagttcatccaccaacaataacgaggattatgccaatgtgttctcccaatctatggttcgactctaccttcccataactccatttactgacgctagtattaactggattaatatggtcttgatcaggctggagaagcaatgcatattcaaggtggaggggtga

SEQ ID NO: 19653 - protein, 797 aa, Sorghum bicolor
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 891 in the 10/374,780 US patent application
  misc_feature: Useful for making plants with modulated oxidative stress sensitivity
  misc_feature: Functional homolog of the protein sequence given in SEQ ID NO 13621
  misc_feature: Ceres ANNOT ID no. 8734432
  misc_feature (279)..(410): Pfam ID: NAM Pfam Description: No apical meristem (NAM) protein
MWHQPPTSAEEAIFVPVRTRRAQAARCPRPRPPHQGSSNPGQVRHSCCLLFAMRSLPCFMRPSLGSSSTAPPHTTPFVAAGKEVRKRSAVVAVGEGGAVAELLALAPELLVREVGDEVDKLGPHGGERSYGTMLSERERERSKARAASSFRNASPRWHPDLARHTSKKFPDESNSKSKPGHSGYPIFSGRVIQNSGSGTSGSGNSGLDPGNSGTGNGYWVICPGLSKSDIRIGGILNNGKNVNVPVAPVMPSTSISSASAAGKGGSKAMQPPPQLPAALPVGFRFRPTDEELVRHYLKPKIAGHAHADLLLIPDVDLSACEPWELPAKALIRSGDPEWFFFAPLDRKYPGGHRSNRSTAAGYWKATGKDRLIRSRRAGTLIGVKKTLVFHRGRAPRGHRTAWIMHEYRTAEPQLQQGQNGSFVLYRLFNKNEGESEASDAADSPSTSSPAIAPAVKAENLSQPASAKMSHLLATVSSNEPTSNQLPDLQREHKFDGFPTITSPMRPYTDHPFLGNAGEQDLSVYIDSIIAHQDLEDLLASPCLADMVEQATVNVEPHPTSLPILDNSSNSKRLAENSRGKVGSETLLLIKGTDDTGAAASCSATKILQADKDNINHHTGAQSNLASNASAQVSHFYNQYQLQSAFIPETEPPNSGALCSAASLTPYPQHLFNGMVAPARIDISDSDVFNGLQGWAAEPSKDPHQGNAPRRIRLVHSIQRASVIEPVLTSHLEGEDEAGLCYSTDSSSTNNNEDYANVFSQSMVRLYLPITPFTDASINWINMVLIRLEKQCIFKVEG

SEQ ID NO: 19654 - DNA, 468 bp, Sorghum bicolor
  misc_feature: Ceres ANNOT ID no. 8734437
  misc_feature: Encodes the peptide sequence at SEQ ID NO 19655
atggcctccctctcctctgccaccatcaccgccccttccgccttcgccgcgccggccgcccgcgccgtggccaggaggtcgtccttcaccgtgcgcgcctctctcggcaaggccgccggcacggccgccgtggccgtggccgccagcgcccttcttgccggcggcgccatggcccaggaggtgctgctgggcgcaaacggaggcgtgctcgtcttcgagcccagcgagttcaccgtcaaggccggcgacaccatcaccttcaagaacaacgccgggtacccgcacaacgtcgtcttcgacgaggacgaggtgcccagcggcgtggacgccaccaagatctcgcaggaggagtacctcaacgcgccaggcgagacctactccgtcaccctcaccgtgccgggcacctacggcttctactgcgagccgcaccaaggagccggaatggtcggcaaggtcaccgtcaactaa

SEQ ID NO: 19655 - protein, 155 aa, Sorghum bicolor
  misc_feature: Useful for making plants with modulated nitrogen use efficiency
  misc_feature: Functional homolog of the protein sequence given in SEQ ID NO 14724
  misc_feature: Ceres ANNOT ID no. 8734437
  misc_feature (59)..(155): Pfam ID: Copper-bind Pfam Description: Copper binding proteins, plastocyanin/azurin family
MASLSSATITAPSAFAAPAARAVARRSSFTVRASLGKAAGTAAVAVAASALLAGGAMAQEVLLGANGGVLVFEPSEFTVKAGDTITFKNNAGYPHNVVFDEDEVPSGVDATKISQEEYLNAPGETYSVTLTVPGTYGFYCEPHQGAGMVGKVTVN

SEQ ID NO: 19656 - DNA, 156 bp, Sorghum bicolor
  misc_feature: Ceres ANNOT ID no. 8734447
  misc_feature: Encodes the peptide sequence at SEQ ID NO 19657
atggagctcaatttgattttccatatagtggatgttataaattacacatttttcacttctgactatgggttaaccattgctggtttctactatgtctccttttctcgtagcgatggctccattagtggattttattatgattcaaatagcacgtaa

SEQ ID NO: 19657 - protein, 51 aa, Sorghum bicolor
  misc_feature: Useful for making plants with modulated light quality sensitivity
  misc_feature: Functional homolog of the protein sequence given in SEQ ID NO 14725
  misc_feature: Useful for making plants with modulated low light sensitivity
  misc_feature: Functional homolog of the protein sequence given in SEQ ID NO 14726
  misc_feature: Ceres ANNOT ID no. 8734447
MELNLIFHIVDVINYTFFTSDYGLTIAGFYYVSFSRSDGSISGFYYDSNST

SEQ ID NO: 19658 - DNA, 513 bp, Sorghum bicolor
  misc_feature: Ceres ANNOT ID no. 8734461
  misc_feature: Encodes the peptide sequence at SEQ ID NO 19659
atgtcgacggctcccaggcgaggcaccttccgaggccgcggcgcccctccgcccggcaccggctacgtccgccgcggccccgcccctgccccggcggccacaggccccgccgacggcgccaaggccctgcgcaagcccgtcttcaccaccgtcgaccagctgcgcccccagacgcacggccacaccctcaccgcccgcgtcatctccgcccgcaccgtcctcgacaagccctccacgcacctcggccgcacccgtgtcgccgagtgcctcgtcggagacagcaccggcaccgtcctcgtcaccgcccgcaacgaacaggttgaccttctggagccagatacaacagtgatcttccgcaacgccaagattgacatgttcaagggcaccatgaggctggcagtggacaagtggggccggattgaggtgactcagcctgctgatttcaaggtgaaccaagacaacaacatgtcgctggtggagtacgagctggtggatgtggatgaagaggaatga

SEQ ID NO: 19659 - protein, 170 aa, Sorghum bicolor
  misc_feature: Useful for making plants with modulated drought sensitivity
  misc_feature: Useful for making plants with modulated water use efficiency
  misc_feature: Functional homolog of the protein sequence given in SEQ ID NO 13526
  misc_feature: Ceres ANNOT ID no. 8734461
MSTAPRRGTFRGRGAPPPGTGYVRRGPAPAPAATGPADGAKALRKPVFTTVDQLRPQTHGHTLTARVISARTVLDKPSTHLGRTRVAECLVGDSTGTVLVTARNEQVDLLEPDTTVIFRNAKIDMFKGTMRLAVDKWGRIEVTQPADFKVNQDNNMSLVEYELVDVDEEE

SEQ ID NO: 19660 - DNA, 402 bp, Sorghum bicolor
  misc_feature: Ceres ANNOT ID no. 8734482
  misc_feature: Encodes the peptide sequence at SEQ ID NO 19661
atggcgaggctttgttccaccagcagcgcctactactactactactactacgcggtggtggtgctaataattctgtttgtgtcgtcggtgggcgtggcgccggcggcggcatgcggcggtcacccgtgcccgatcccggacggcaagtgccctgtgaacgcggtgaagctgggcgtgtgcgccgacgtgctggacgggctgatccacgccgtggtgggcggcccgcccaaggagccctgctgctccctcatctccggcctggtcgacctggacgccgccgtctgcgtctgcctcgccatcaacgctaacgttctcggcatcaacctcgacgtcgccgtcgacctctccctcctcgtcaactactgcggccgccgtgtgcccgccggattcaaatgcgcctag

SEQ ID NO: 19661 - protein, 133 aa, Sorghum bicolor
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated salt sensitivity
  misc_feature: Functional homolog of the protein sequence given in SEQ ID NO 13766
  misc_feature: Ceres ANNOT ID no. 8734482
  misc_feature (50)..(132): Pfam ID: Tryp_alpha_amyl Pfam Description: Protease inhibitor/seed storage/LTP family
MARLCSTSSAYYYYYYYAVVVLIILFVSSVGVAPAAACGGHPCPIPDGKCPVNAVKLGVCADVLDGLIHAVVGGPPKEPCCSLISGLVDLDAAVCVCLAINANVLGINLDVAVDLSLLVNYCGRRVPAGFKCA

SEQ ID NO: 19662 - DNA, 270 bp, Sorghum bicolor
  misc_feature: Ceres ANNOT ID no. 8734491
  misc_feature: Encodes the peptide sequence at SEQ ID NO 19663
atgccgccggcgaggcccttgcggtgcaccacatcctcacgatccaccacagcccacgcgctggaccgcttcgaggagtaccgtgacctcgtccgcgctcgagctgcccagcgctgcggcgagggcaccatcgtggaggaatgcttcatcacggacgacaactacatgctctgctccctactaggcaacactggcgtgtgtaggagcccctactattgtgtgtccagcagcctatggaacaactttgcgggcaagcaggctataatgtga

SEQ ID NO: 19663 - protein, 89 aa, Sorghum bicolor
  misc_feature: The sequence is a functional homolog of SEQ ID NO 1317 in the 10/666,642 US patent application
  misc_feature: Ceres ANNOT ID no. 8734491
MPPARPLRCTTSSRSTTAHALDRFEEYRDLVRARAAQRCGEGTIVEECFITDDNYMLCSLLGNTGVCRSPYYCVSSSLWNNFAGKQAIM

SEQ ID NO: 19664 - DNA, 270 bp, Sorghum bicolor; identical to SEQ ID NO: 19662
  misc_feature: Ceres ANNOT ID no. 8734495
  misc_feature: Encodes the peptide sequence at SEQ ID NO 19665

SEQ ID NO: 19665 - protein, 89 aa, Sorghum bicolor; identical to SEQ ID NO: 19663
  misc_feature: The sequence is a functional homolog of SEQ ID NO 1317 in the 10/666,642 US patent application
  misc_feature: Ceres ANNOT ID no. 8734495

SEQ ID NO: 19666 - DNA, 1488 bp, Sorghum bicolor
  misc_feature: Ceres ANNOT ID no. 8734509
  misc_feature: Encodes the peptide sequence at SEQ ID NO 19667
atggcgctgcgaacgctccacctcaacgcgccgccgctcctccatattctgcgctcgctatgcctcctcgtcctggccgcgtcggcggcggtgtcggtgtcggggcgccaccacgcgcccaccccggcgcacggcaccgggcagagcatgtacctggcgccggcctgccgggcgcacacggcgtcgctcgcggacttcggcggcgtgggcgacggcaccacctccaacaccgcggcgttccgctccgcggtcgaccacctgtcgcagtactccggcgaggacgccggcggcgccatgctgtacgtgcccgccgggaagtggctcacggggcccttcaacctcaccagccacttcaccctcttcctccacagcgacgccgtcatcctcgcctcccaggacataaacgaatggccaatcattgatcccctgccttcttatggaagaggaagggataaaattggaggaagattcgctagcctcgtcggtggatcaaacctgaccgatgtagtcattactggtaacaacggcacaattgatggacagggcgcgatgtggtggtcgaaattccacaagaaccagctcaagtacacgcgcgggtacctgatcgagctgatgcactcggacaccatctacatctccaacctgacgctgctcaactcgccggcgtggaacatccatccggtctacagcagcaacatcgtggtgcaaggcatcaccatcctggcgccgacgaactcgcccaacacggacggcatcaaccctgactcttgctcgcacgtccggatcgaggactgctacatcgtgtctggcgacgactgcgtggcgatcaagagcgggtgggacgagtacggcatctcgtacgggatgccgagccagcacatcgtgatccgtcggctgacgtgcgtgtcgccgacgagcgcggtgatcgcgctggggagcgagatgtcgggcggcatccaggacgtgcgcgcggaggacatcacggcgatcaactccgagtccggcgtgcgcatcaagacggcggtgggccgcggcgcctacgtgaaggacgtgttcgtgcggcggatgacgctgaccaccatgaagtgggtgttttggatgacgggaaactacaagtcccacccggacgacaagtacgaccccaacgccatccccgtcgtcgacaacatcagctaccaggacgtggtggccacgggtgtgtacaaggaggcggcgaggctcgagggcatccagggcgcccccttcaagggcatctgcgtcgccaacgtcaccgccgacctgtccaagtccaggaagtacccatggacgtgcgccgacgtcgagggcgtgtcggtgaacgtcagcccggcgccgtgccagccgctccagggcgcgcacgacggcgcatgcccgttcccgaccgacacgctgcccatcgaccaggtcacagtgcagcagtgcgcctacgacgtccccggcggtaccggcgccagcggcggcggcaactag

SEQ ID NO: 19667 - protein, 495 aa, Sorghum bicolor
  misc_feature: Useful for making plants with altered carbohydrate content
  misc_feature: Functional homolog of the protein sequence given in SEQ ID NO 14727
  misc_feature: Useful for making plants with altered cell wall content and/or composition
  misc_feature: Functional homolog of the protein sequence given in SEQ ID NO 14728
  misc_feature: Ceres ANNOT ID no. 8734509
  misc_feature (202)..(414): SWISSPROT Homolog: EC 3.2.1.15 Polygalacturonase
  misc_feature (95)..(452): Pfam ID: Glyco_hydro_28 Pfam Description: Glycosyl hydrolases family 28
MALRTLHLNAPPLLHILRSLCLLVLAASAAVSVSGRHHAPTPAHGTGQSMYLAPACRAHTASLADFGGVGDGTTSNTAAFRSAVDHLSQYSGEDAGGAMLYVPAGKWLTGPFNLTSHFTLFLHSDAVILASQDINEWPIIDPLPSYGRGRDKIGGRFASLVGGSNLTDVVITGNNGTIDGQGAMWWSKFHKNQLKYTRGYLIELMHSDTIYISNLTLLNSPAWNIHPVYSSNIVVQGITILAPTNSPNTDGINPDSCSHVRIEDCYIVSGDDCVAIKSGWDEYGISYGMPSQHIVIRRLTCVSPTSAVIALGSEMSGGIQDVRAEDITAINSESGVRIKTAVGRGAYVKDVFVRRMTLTTMKWVFWMTGNYKSHPDDKYDPNAIPVVDNISYQDVVATGVYKEAARLEGIQGAPFKGICVANVTADLSKSRKYPWTCADVEGVSVNVSPAPCQPLQGAHDGACPFPTDTLPIDQVTVQQCAYDVPGGTGASGGGN

SEQ ID NO: 19668 - DNA, 717 bp, Sorghum bicolor
  misc_feature: Ceres ANNOT ID no. 8734525
  misc_feature: Encodes the peptide sequence at SEQ ID NO 19669
atggccctgacgctcgcgccggagctggagtcgacggcggcgggcagcaactacagccacagcagcgacagcggcagcggcaggcgcgagcacatgttcgagaaggtggtgacacagagcgacgtggggaagctgaatcggctggtggtgcccaagcagttcgcagagcggcacctgccgctgcgcggcgcggcggccaggtcgcggggcacggtgctgtgcttccacgacgcccgcagtggcgggacgtcgccggcggcgtggcggttccgctactcctactggagcagcagccagagctacgtgatgaccaaagggtggaaccgctacgtccgcgacaagcgcctcgtggccggggacaccgtcacgttctgccgcgacggcgcaaggctcttcatcgactgccgccaccggcagaggcggagtagtcgtcgtaccggggagcagggcgcggcggtgccgcatgcggtcgtcgtcccggcggcgatgctcgccgccttgccaccggtaacactacggcaccagcagccgcagggcttggttgtcttctccggccagcaccagcagcaggcagatcaggatgcagttgtcgtggaagacgaagaagaagaggaggaggcccagcggcagcgcgggcggtggctccggctgttcggcgtcaacctgctggagcttcgtacggaggcgccggtgctgcttgatctgcagcttatttga

SEQ ID NO: 19669 - protein, 238 aa, Sorghum bicolor
  misc_feature: The sequence is a functional homolog of SEQ ID NO 38 in the 10/838,616 US patent application
  misc_feature: The sequence is a functional homolog of SEQ ID NO 740 in the 11/435,388 US patent application
  misc_feature: Ceres ANNOT ID no. 8734525
  misc_feature (32)..(141): Pfam ID: B3 Pfam Description: B3 DNA binding domain
MALTLAPELESTAAGSNYSHSSDSGSGRREHMFEKVVTQSDVGKLNRLVVPKQFAERHLPLRGAAARSRGTVLCFHDARSGGTSPAAWRFRYSYWSSSQSYVMTKGWNRYVRDKRLVAGDTVTFCRDGARLFIDCRHRQRRSSRRTGEQGAAVPHAVVVPAAMLAALPPVTLRHQQPQGLVVFSGQHQQQADQDAVVVEDEEEEEEAQRQRGRWLRLFGVNLLELRTEAPVLLDLQLI

SEQ ID NO: 19670 - DNA, 831 bp, Sorghum bicolor
  misc_feature: Ceres ANNOT ID no. 8734526
  misc_feature: Encodes the peptide sequence at SEQ ID NO 19671
atggcgtcgtcgtccagggctccggcgatgatggtggtcgtcgcggccgtgatcatggcggcggcacacctcgcgagcggcagcggctatgacagtgctgcggcggcgcctttcaccaagtcggactggcaagacggcagcgccaccttctacggccaagactccggccttggcgcagacttcggcggcgcgtgcggctacggcgccaacgacatcctgtcgctctactcgacgcgcacggcggcgctgagcacgccgctgttcgcgagcggcgccgggtgcgggcagtgctacgagctgcggtgcgtcagctcccggtggtgcaacccgggttcgccgtccgtcgtcgtcaccggcaccaacctctgcccgcccaactggaacctccccagcgacaacggcggctggtgcaacccgccgcggaggcacttcgacatggcgccgccgtccttcctcatcctcgcgcagcgcgtggcgggcatcgtccccgtgcagttccgccgcgtcccgtgccagcgctccggcggggtcaggttctacgtgcagggcaactactactggctcctgctctacgtcatgaacgtcggcggcagcggcgacgtcggcgacctcgccgtcaagagggccggcgagccggactgcaactacgtgcccgcgtcgcgcaactggggcatcacgtaccaggtgttcgccgcgctcggcaacagcaagggcctcgtcgtcaggatgaccacctacagcttgccgcggaagatcatcgtcgtcgacgacgccatcaccgccgggtggtgcactggactctcctaccagggatccaacaacttctattga

SEQ ID NO: 19671 - protein, 276 aa, Sorghum bicolor
  misc_feature: Useful for making plants with altered cell wall content and/or composition
  misc_feature: Functional homolog of the protein sequence given in SEQ ID NO 14729
  misc_feature: Ceres ANNOT ID no. 8734526
  misc_feature (80)..(166): Pfam ID: DPBB_1 Pfam Description: Rare lipoprotein A (RlpA)-like double-psi beta-barrel
  misc_feature (177)..(260): Pfam ID: Pollen_allerg_1 Pfam Description: Pollen allergen
MASSSRAPAMMVVVAAVIMAAAHLASGSGYDSAAAAPFTKSDWQDGSATFYGQDSGLGADFGGACGYGANDILSLYSTRTAALSTPLFASGAGCGQCYELRCVSSRWCNPGSPSVVVTGTNLCPPNWNLPSDNGGWCNPPRRHFDMAPPSFLILAQRVAGIVPVQFRRVPCQRSGGVRFYVQGNYYWLLLYVMNVGGSGDVGDLAVKRAGEPDCNYVPASRNWGITYQVFAALGNSKGLVVRMTTYSLPRKIIVVDDAITAGWCTGLSYQGSNNFY

SEQ ID NO: 19672 - DNA, 3540 bp, Sorghum bicolor
  misc_feature: Ceres ANNOT ID no. 8734570
  misc_feature: Encodes the peptide sequence at SEQ ID NO 19673
atggcctccaacggcggcgggctccgccacagcaacagcaaccgcctctcccggatgtcctactccggcaccggcgacgacgcccgcgcgcaggccgccgtccccggcgaccgtcccatggtcaccttcgcccgccgcacccactcgggccgctacgtcagctactcccgcgacgacctcgacagcgacctcggcaacgccggcatcggcgacatgtccccggaccgcgacgaccagccgcagcagtacgcgagctaccacgtccacatcccggccacgcccgacaaccagcccatggacccggccatctcggcgcgcgtcgaggagcagtacgtctccaactcgctcttcacgggcggcttcaacagcgtcacgcgcgcgcacctcatggacaaggtcatcgactccgaggcctcacacccgcagatggccggcgccaagggatcctcctgcgccgtcaatgggtgcgacgccaaggtcatgagtgatgagcgcggcgacgacatactcccctgcgagtgcgacttcaagatctgcgccgagtgcttcgctgatgccgtcaagaacgccggcgccgtctgccctgggtgtaaggagccgtataagagcacggagctcgaggacatcgtcggcgctgccaacgccggggccggagctaggcctacgctctcgctgcccccgccgcctggcgccgccgcgtctaggatggagaggaggctatccattatgcgctcccagaaggccatgactaggagccagactggagactgggaccacaaccgctggctctttgagaccaaggggacgtatggctatggcaatgccatctggcccaaggagaatgaggtggacgccggaggcgttggtggaggcggaggtggagctgatggccagccggccgagttcaccaccaagccatggaggccgctcactcggaagctttccatccctgctgccatactcagcccatacaggcttctcattcttatccgcatggtcgtccttgctctgttccttatgtggagaattaagaacaagaatgaggatgcaatgtggctctggggcatgtctgttgtctgtgaactctggtttggcttttcatggctgcttgaccagctgccaaagctgtgccctgtgaaccgagccaccgaccttgctgtcctgaaagacaagtttgagactccaacaccgtcgaaccctactggacgatcagatttacccgggcttgacatatttgtgtctacagctgatccagagaaagaacctccattggtcacagcaaacactatcctgtccatccttgctgctgactaccctgtggagaagctttcttgctatgtttctgatgatggaggggctctcctgacttttgaagccatggctgaagctgctagctttgctaatatgtgggttcctttctgtcgcaagcacaacattgagcctcgcaatcctgacagctacttcaatcttaagaaggacccttacaagaacaaggttcgccaggattttgtcaaggacaggaggagggttaagagggagtatgatgagtttaaggtcaggatcaatgcgctgcctgactcgatacgccgacgctctgatgcgtaccatgccagggaggaaatcaaggctatgaagaggcagcgagagactgctcttgatgatgcagtagagcctgttaagatcgctaaagccacctggatggctgatggcactcattggcctggtacctggattcaaccttctgctgagcatacccgtggtgatcatgctggaataattcaggtgatgctgaaacctcccagtgatgatcccttgtatggcagcactggtgacgaaggcagacctcttgatttcactgaggtcgacatccgtttgccaatgttggtctatgtgtcccgagagaagcgccctggttatgaccacaacaagaaggctggtgcgatgaatgccctagtccgttcatctgctgtcatgtcaaatggccccttcatcctcaacctcgactgtgatcactatgtttacaactcacaagctttccgcgagggcatgtgcttcatgatggaccgtggtggtgaccgtattggttatgttcagttcccgcagcggtttgagggcattgatccatcagatcgctatgccaaccacaacactgtcttctttgatgtcaacatgcgcgcactggatggtatcatgggaccagtctatgttggcaccggctgtcttttccgccgcgttgccctctatggatttgaccctccccgctccaaggaacatggtggctgctgcagctgttgcttcccccagagacgcaagatcaaagcttcagctgctgcaccggaggagacccgggctctaaggatggcagactttgatgaggatgaaatgaacatgtcatcattccccaagaagtttggtaactcgaacttcctcatcaactccattccaattgcagaattccaagggcgtccgctagctgatcaccctggtgtcaagaatggccgtcctccgggtgctctcactgtcccccgtgaccttcttgatgcatccacagttgctgaggccatcagtgtcatctcatgctggtacgaagacaagaccgagtggggccaccgtgttggttggatctatggctcagtcacagaggatgtggtcactgggtaccggatgcacaaccgtggttggaagtctgtgtactgtgtcaccaagcgtgacgccttccgcggcaccgcacccatcaatctgactgaccgtctccaccaggtgctccgttgggctaccggttcagtggagatcttcttctcccgcaacaatgctctgctcgcaagccgcaggatgaagttcctccagaggatcgcctacctgaacgtcggcatctacccattcacgtccatcttcctgatcgtctactgcttcctgccggcactgtccctcttctcggggcagttcatcgtgaagactctcaatgtggcattcctaacctacctgctggtgatcacactgacgctgtgcctgctggcggtgctggagatcaagtggtcggggatcagcctggaagaatggtggcggaacgagcagttctggctgatcggcggcacgagcgcgcaccttgcggccgtgctgcagggcctgctgaaggtggtggcgggcatcgagatctccttcacgctgacgtccaagtccggaggcgacgacgtggacgacgagtttgcagacctgtacatcgtcaagtggacatcgctgatgatcccgcccatcgtgatcatgatggtgaacctgatcggcattgccgtgggcttcagccgcaccatctacagcgagatcccgcagtggagcaagctgctgggtggtgtcttcttcagcttctgggtgctggcgcacctgtacccgttcgccaagggcctgatggggcggagagggcgcacgcccaccatcgtcttcgtctgggcaggactcctctccatcaccatctccctgctgtgggtcgccatcaacccgccatctgggaaccagcagattggtggatccttcaccttcccctga

SEQ ID NO: 19673 - protein, 1179 aa, Sorghum bicolor
  misc_feature: Useful for making plants with altered cell wall content and/or composition
  misc_feature: Functional homolog of the protein sequence given in SEQ ID NO 14060
  misc_feature: Useful for making plants with modulated plant growth and development
  misc_feature: Functional homolog of the protein sequence given in SEQ ID NO 13629
  misc_feature: Useful for making plants with altered carbohydrate content
  misc_feature: Functional homolog of the protein sequence given in SEQ ID NO 13628
  misc_feature: The sequence is a functional homolog of SEQ ID NO 6 in US patent 7285702
  misc_feature: Useful for making plants with modulated biomass
  misc_feature: Functional homolog of the protein sequence given in SEQ ID NO 13909
  misc_feature: The sequence is a functional homolog of SEQ ID NO 2 in US patent 7049481
  misc_feature: Ceres ANNOT ID no. 8734570
  misc_feature: Up-regulated in shoot tissues in response to salicylic acid treatment
  misc_feature (841)..(1165): SWISSPROT Homolog: EC 2.4.1.12 Cellulose synthase (UDP-forming)
  misc_feature (309)..(1179): Pfam ID: Cellulose_synt Pfam Description: Cellulose synthase
MASNGGGLRHSNSNRLSRMSYSGTGDDARAQAAVPGDRPMVTFARRTHSGRYVSYSRDDLDSDLGNAGIGDMSPDRDDQPQQYASYHVHIPATPDNQPMDPAISARVEEQYVSNSLFTGGFNSVTRAHLMDKVIDSEASHPQMAGAKGSSCAVNGCDAKVMSDERGDDILPCECDFKICAECFADAVKNAGAVCPGCKEPYKSTELEDIVGAANAGAGARPTLSLPPPPGAAASRMERRLSIMRSQKAMTRSQTGDWDHNRWLFETKGTYGYGNAIWPKENEVDAGGVGGGGGGADGQPAEFTTKPWRPLTRKLSIPAAILSPYRLLILIRMVVLALFLMWRIKNKNEDAMWLWGMSVVCELWFGFSWLLDQLPKLCPVNRATDLAVLKDKFETPTPSNPTGRSDLPGLDIFVSTADPEKEPPLVTANTILSILAADYPVEKLSCYVSDDGGALLTFEAMAEAASFANMWVPFCRKHNIEPRNPDSYFNLKKDPYKNKVRQDFVKDRRRVKREYDEFKVRINALPDSIRRRSDAYHAREEIKAMKRQRETALDDAVEPVKIAKATWMADGTHWPGTWIQPSAEHTRGDHAGIIQVMLKPPSDDPLYGSTGDEGRPLDFTEVDIRLPMLVYVSREKRPGYDHNKKAGAMNALVRSSAVMSNGPFILNLDCDHYVYNSQAFREGMCFMMDRGGDRIGYVQFPQRFEGIDPSDRYANHNTVFFDVNMRALDGIMGPVYVGTGCLFRRVALYGFDPPRSKEHGGCCSCCFPQRRKIKASAAAPEETRALRMADFDEDEMNMSSFPKKFGNSNFLINSIPIAEFQGRPLADHPGVKNGRPPGALTVPRDLLDASTVAEAISVISCWYEDKTEWGHRVGWIYGSVTEDVVTGYRMHNRGWKSVYCVTKRDAFRGTAPINLTDRLHQVLRWATGSVEIFFSRNNALLASRRMKFLQRIAYLNVGIYPFTSIFLIVYCFLPALSLFSGQFIVKTLNVAFLTYLLVITLTLCLLAVLEIKWSGISLEEWWRNEQFWLIGGTSAHLAAVLQGLLKVVAGIEISFTLTSKSGGDDVDDEFADLYIVKWTSLMIPPIVIMMVNLIGIAVGFSRTIYSEIPQWSKLLGGVFFSFWVLAHLYPFAKGLMGRRGRTPTIVFVWAGLLSITISLLWVAINPPSGNQQIGGSFTFP

SEQ ID NO: 19674 - DNA, 1911 bp, Sorghum bicolor
  misc_feature: Ceres ANNOT ID no. 8734610
  misc_feature: Up-regulated in shoot tissues in response to salicylic acid treatment
  misc_feature: Encodes the peptide sequence at SEQ ID NO 19675
atggcttcgacattcggtgccacttctacagttggccttatggctgctccagcagggaagaatgtgcgccttcagaggagggctaacttcagagtaaaagcagccaaggagctgtacttcaacaaggatggctcagctatcaagaagctccagactggagtcaataagcttgcagacctagttggagttacacttggaccaaagggaaggaatgtcgttttggagagcaagtatggctctcctaagattgttaacgatggtgttacagttgcaagagaggttgagctggaggaccctgtggaaaacattggagctaaattggtcaggcaagctgcagctaagaccaatgatctagctggagatgggacaaccacctccgtggtccttgctcagggactgattgctgagggtgttaaggttgtggcagctggtgctaatcctgttcagattactcgtggtattgagaaaacagcgaaagcactagttgaagaactacgtaagttgtccaaggatgttgaagatagcgagcttgcagatgttgctgcagttagtgctggcaacaactatgaaatcggtaacatgatagcagaggccatgagcaaggttggtcggaagggtgtggttacccttgaagagggaaggagttctgagaactttctctatgttgtggagggaatgcagtttgaccgtggttatatctctccctactttgtaacagacagtgagaaaatgtctgccgagtacgagaactgcaagcttcttttggttgacaagaagatcaccaatgcaagggatcttatcaacgttttggaagaagccatcagaggtgcatacccaatcctgataattgctgaggatattgagcaggaggctcttgctactcttgttgtcaacaagcttagaggatcattgaagattgctgccatcaaagcccctggttttggagagcgcaagactcagtacttggatgatattgccatccttactggagcaactgtaatcagagatgaagttgggctgtcacttgacaaggctgacaaatcagtccttggaacagctgcaaaggttgttcttaccaaagagtcaacaacaattgttggtgacggcagcacccaggaagaagttactaaaagggttgcgcagattaaaaatctgattgaggcagcagaacaagaatatgaaaaggaaaagctcaatgagaggatagctaagcttgctggtggtgttgctgtcattcaggtgggagcacaaacagaaactgaactaaaagagaagaagttgagagttgaggatgccctaaatgcaactaaggctgctgttgaggaaggtattgttgttggtggagggtgcactcttttgcggcttgcagctaaagtcgatgccatcaaagatacactggagaatgatgagcagaaggttggagctgaaatagtaagaagggccctgagctacccacttaaattgattgctaaaaacgctggtgtcaatggcagcgttgtcactgagaaggtcctttctaacgataacttcaagtatggttacaatgctgctactggacagcacgaggacttgatggctgctggtatcattgaccccaccaaggtggtgagatgctgcttggagcatgccgcatcggtggccaagaccttcctgacatcagatgttgtggtcgtcgatatcaaggagccggaggccgcgcccctcgctaacccgatggacaactctgctttgtttgtatatagtagttcatgttgcttatttgctacttgctttcttgttaggcagctgttgaataggggattgacattgatgatgactactcttttgaggctggcatcaaaagttgattccatcatagaatctcttgagaatgataagcagaaggtaggagaagggagtcatcatgtctaa

SEQ ID NO: 19675 - protein, 636 aa, Sorghum bicolor
  misc_feature: Useful for making plants with modulated nitrogen use efficiency
  misc_feature: Functional homolog of the protein sequence given in SEQ ID NO 13023
  misc_feature: Ceres ANNOT ID no. 8734610
  misc_feature (57)..(561): Pfam ID: Cpn60_TCP1 Pfam Description: TCP-1/cpn60 chaperonin family
MASTFGATSTVGLMAAPAGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVEELRKLSKDVEDSELADVAAVSAGNNYEIGNMIAEAMSKVGRKGVVTLEEGRSSENFLYVVEGMQFDRGYISPYFVTDSEKMSAEYENCKLLLVDKKITNARDLINVLEEAIRGAYPILIIAEDIEQEALATLVVNKLRGSLKIAAIKAPGFGERKTQYLDDIAILTGATVIRDEVGLSLDKADKSVLGTAAKVVLTKESTTIVGDGSTQEEVTKRVAQIKNLIEAAEQEYEKEKLNERIAKLAGGVAVIQVGAQTETELKEKKLRVEDALNATKAAVEEGIVVGGGCTLLRLAAKVDAIKDTLENDEQKVGAEIVRRALSYPLKLIAKNAGVNGSVVTEKVLSNDNFKYGYNAATGQHEDLMAAGIIDPTKVVRCCLEHAASVAKTFLTSDVVVVDIKEPEAAPLANPMDNSALFVYSSSCCLFATCFLVRQLLNRGLTLMMTTLLRLASKVDSIIESLENDKQKVGEGSHHV

SEQ ID NO: 19676 - DNA, 2592 bp, Sorghum bicolor
  misc_feature: Ceres ANNOT ID no. 8734683
  misc_feature: Encodes the peptide sequence at SEQ ID NO 19677
atgtcgcgccgcgggacgctcccgccggcgctgctgctgctgctgctgctgctgctgctggcggcggcggcaataaccaccgtgtccgggcagggccggcccgtgaccgagagcggcgcggagacgccgcccacgccgtccagcttcacgcccaaggacagcttcctgatcgactgcggcgggacggcgcccgtcaccgccgacggcaagtcgtacaagacggacgcgcaggccaaccacctgctctccgccagcgacgccatccgcgtcgccgccgacgacaaggccggcctgccttcgccgctgtacgacaccgcgcgggtcttcaaggaggaggccgtctacagcttcccgctcaccgtcccgggctggcacttcgtccgcatctacctcttccccatcaagggcggcgacgtggacctggcgtcctccaccttcagcgtcgtcaccgacgacaacgtcctcctccacagcttcaccccggagaacaagccggtgatgaaggagtacgtgatcaacgccaccgagaaccacctcgcgctcaagttccagccgctcaagggctccgccgccttcgtcaacgccatcgaggtggtgaacgcccccgacgagctcatcaccgactcggcgctggccgtccagccgctgggcgagatcaccggcctcgtccacgacgcgtaccaggtcctgtaccggatcaacgtcggcggccccgccatcggccccgccaacgacacgctgggccggcggtgggagaccgacgcgtcctacgtgcagaccaaggcggcggtgaaggacgtgtcggtgcccaccagcaccatcaagttccccgacggcacgtcccgtctcgtggcgccgacgctggtgtacgccagcgccgccaagatggcggacgccgacgtcgggagcgccaacttcaacctgacgtggaaggtggacgtggacccgtccttcagctacctggtccgcctcttcttcgccgacatcgtcagcaaggccaccaacgacctctacttcgacgtctacatcagcgggcgcaaggccgtgtccgggctggacctgtccacggtgaccggcggcgagctggcggcgccctactacaaggacttcgtggtgaactcgtcgtcgctggagggcggggacgggaagctgagcgtccaggttggtcccatggggcaggacacggggcgcatcgacgcgctgctcaacggcatggaggtgctcaagatgagcaactccgtgggcagccttgacggcgagttcggcgtggacgggcggaaggccgacgacggcgtcggcgggcggaaggcggtggcggccgtgggtttcgccatgatgttcggcgcgttcgcggggctaggcgccatggtggtcaagtggtacaagcggccgcaggactgggagcgacgggagagcttctcgtcgtggctgctccccatccacacggggcagtccttcacgacggggagcaaaggcggcgggtacgggtcccacaagagcggcaacaccttctcctccaccatggggctgggccgcttcttctcgttcgccgagatccaggcggcgacggggaactgggacgagaagaacatcatcggcgtgggagggttcggcaacgtgtacgtcggggagatcgacgacgacggcggcaccaagaccaaggtggcggtgaagcgcgggagcgccgagtcggagcagggcatcaacgagttcaacacggagatccagatgctgtccaagctgcggcaccggcacctggtgtcgctcatcggctactgcgacgagaaccaggagatgatcctggtgtacgagtacatgcacaacggcgtgttccgggaccacatctacggcaaggaaggggtggcgccgctgccgtggaagcagcggctggagatctgcatcggcgccgccagggggctgcactacctgcacacgggcacggcgcaggggatcatccaccgggacgtcaagaccaccaacatcctgctggacgacaacttcgtggccaaggtgtcggacttcgggctgtccaaggacgggccagggatgaaccagctccacgtcagcaccgccgtgaagggaagcttcgggtacctggacccggagtacttcaggtgccagcagctgacggacaagtcggacgtctactccttcggagtggtgctgctggaggcgctgtgcgcgcggccgcccatcgacccgcagctgccgcgggagcaggtgtcgctggcggagtggggcatgcagtggaagcgcaagggactcatcgagaagatcatggaccccaagctcgccggaaccgtcaacccggagtcgctggccaagttcgccgagacggccgagaagtgcctcgccgagttcggcagcgaccgcatctccatgggggacgtgctgtggaacctcgagtacgcgctgcagctgcaggactccaacccgcccgagggagcgggggaggacgcctgcgagggcggcggaggcggcggcggcgccgtcgtccccgcggccagcgcctcgggcggcggcgtgccggacgcgtccaccaccgccgccggggagctcttccagcagctcgccgacatgcaggggaggtga

SEQ ID NO: 19677 - protein, 863 aa, Sorghum bicolor
  misc_feature: Useful for making plants with modulated biotic stress sensitivity
  misc_feature: Functional homolog of the protein sequence given in SEQ ID NO 14099
  misc_feature: Ceres ANNOT ID no. 8734683
  misc_feature (514)..(810): SWISSPROT Homolog: EC 2.7.11.1 Non-specific serine/threonine protein kinase
  misc_feature (526)..(801): Pfam ID: Pkinase Pfam Description: Protein kinase domain
MSRRGTLPPALLLLLLLLLLAAAAITTVSGQGRPVTESGAETPPTPSSFTPKDSFLIDCGGTAPVTADGKSYKTDAQANHLLSASDAIRVAADDKAGLPSPLYDTARVFKEEAVYSFPLTVPGWHFVRIYLFPIKGGDVDLASSTFSVVTDDNVLLHSFTPENKPVMKEYVINATENHLALKFQPLKGSAAFVNAIEVVNAPDELITDSALAVQPLGEITGLVHDAYQVLYRINVGGPAIGPANDTLGRRWETDASYVQTKAAVKDVSVPTSTIKFPDGTSRLVAPTLVYASAAKMADADVGSANFNLTWKVDVDPSFSYLVRLFFADIVSKATNDLYFDVYISGRKAVSGLDLSTVTGGELAAPYYKDFVVNSSSLEGGDGKLSVQVGPMGQDTGRIDALLNGMEVLKMSNSVGSLDGEFGVDGRKADDGVGGRKAVAAVGFAMMFGAFAGLGAMVVKWYKRPQDWERRESFSSWLLPIHTGQSFTTGSKGGGYGSHKSGNTFSSTMGLGRFFSFAEIQAATGNWDEKNIIGVGGFGNVYVGEIDDDGGTKTKVAVKRGSAESEQGINEFNTEIQMLSKLRHRHLVSLIGYCDENQEMILVYEYMHNGVFRDHIYGKEGVAPLPWKQRLEICIGAARGLHYLHTGTAQGIIHRDVKTTNILLDDNFVAKVSDFGLSKDGPGMNQLHVSTAVKGSFGYLDPEYFRCQQLTDKSDVYSFGVVLLEALCARPPIDPQLPREQVSLAEWGMQWKRKGLIEKIMDPKLAGTVNPESLAKFAETAEKCLAEFGSDRISMGDVLWNLEYALQLQDSNPPEGAGEDACEGGGGGGGAVVPAASASGGGVPDASTTAAGELFQQLADMQGR

SEQ ID NO: 19678 - DNA, 750 bp, Sorghum bicolor
  misc_feature: Ceres ANNOT ID no. 8734689
  misc_feature: Encodes the peptide sequence at SEQ ID NO 19679
atggagtacggcgtcgccgacgactacgggtacgggtacggcgggtacgacgaccagcaggatctgccgtcgtcgtcgtccgtggacggtgacgagtacgcgacggtgctgtcggcgccgccgaagcgccccgcgggtcggaccaagttccgggagacgcgtcacccggtgtaccgcggcgtgcggcggcgcgggcccgcggggcggtgggtgtgcgaggtccgggagcccaacaagaagtcccgcatctggctcggcaccttcgccaccgccgaggccgccgcgcgcgcgcacgacgtcgccgcgctcgcgctccgcggccgagccgcctgcctcaacttcgccgactccgcgcgcctgctccgcgtcgaccccgccacgctcgccacccccgacgacatccgacgcgccgccatccagctcgccgaggactcctcttcctccacgccggacgcctccgccgccgccgctgccgtggccgtggcgtcatctgcctccgtcggccaggccacgccctcgtcgtccgcgtaccaggccggggacgacgccacgggggctgcaatgtatggcgccgagtacgcggcggcggcaatgtatggcgctggcatggacttcgaccactcgtattactacgacgggatggtgggcgggaacgagtggcagagcgccggcagcagcgggtggcatagcaacgtggacgccggcgacgacgaaggcgccggcgacatgtcgctctggagctattactga

SEQ ID NO: 19679 - protein, 249 aa, Sorghum bicolor
  misc_feature: The sequence is a functional homolog of SEQ ID NO 1224 in the 10/374,780 US patent application
  misc_feature: The sequence is a functional homolog of SEQ ID NO 1413 in the 10/412,699 US patent application
  misc_feature: The sequence is a functional homolog of SEQ ID NO 710 in the 11/435,388 US patent application
  misc_feature: The sequence is a functional homolog of SEQ ID NO 1229 in the 10/374,780 US patent application
  misc_feature: Useful for making plants with modulated salt sensitivity
  misc_feature: Functional homolog of the protein sequence given in SEQ ID NO 14730
  misc_feature: Useful for making plants with modulated nitrogen use efficiency
  misc_feature: Functional homolog of the protein sequence given in SEQ ID NO 14731
  misc_feature: Useful for making plants with modulated low light sensitivity
  misc_feature: Functional homolog of the protein sequence given in SEQ ID NO 13485
  misc_feature: The sequence is a functional homolog of SEQ ID NO 1223 in the 10/374,780 US patent application
  misc_feature: The sequence is a functional homolog of SEQ ID NO 1412 in the 10/412,699 US patent application
  misc_feature: The sequence is a functional homolog of SEQ ID NO 716 in the 11/435,388 US patent application
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: The sequence is a functional homolog of SEQ ID NO 1720 in the 10/412,699 US patent application
  misc_feature: The sequence is a functional homolog of SEQ ID NO 1956 in the 10/374,780 US patent application
  misc_feature: The sequence is a functional homolog of SEQ ID NO 196 in the 11/375,241 US patent application
  misc_feature: The sequence is a functional homolog of SEQ ID NO 2239 in the 10/666,642 US patent application
  misc_feature: The sequence is a functional homolog of SEQ ID NO 422 in the 10/714,887 US patent application
  misc_feature: The sequence is a functional homolog of SEQ ID NO 44 in the 10/412,699 US patent application
  misc_feature: The sequence is a functional homolog of SEQ ID NO 55 in the 10/838,616 US patent application
  misc_feature: The sequence is a functional homolog of SEQ ID NO 574 in the 11/435,388 US patent application
  misc_feature: The sequence is a functional homolog of SEQ ID NO 70 in the 10/669,824 US patent application
  misc_feature: The sequence is a functional homolog of SEQ ID NO 70 in the 10/870,198 US patent application
  misc_feature: The sequence is a functional homolog of SEQ ID NO 96 in the 10/675,852 US patent application
  misc_feature: Useful for making plants with modulated water use efficiency
  misc_feature: Functional homolog of the protein sequence given in SEQ ID NO 13860
  misc_feature: The sequence is a functional homolog of SEQ ID NO 1225 in the 10/374,780 US patent application
  misc_feature: The sequence is a functional homolog of SEQ ID NO 1248 in the 10/374,780 US patent application
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 2 in US patent 7253000
  misc_feature: The sequence is a functional homolog of SEQ ID NO 1246 in the 10/374,780 US patent application
  misc_feature: The sequence is a functional homolog of SEQ ID NO 748 in the 11/435,388 US patent application
  misc_feature: The sequence is a functional homolog of SEQ ID NO 1226 in the 10/374,780 US patent application
  misc_feature: Ceres ANNOT ID no. 8734689
  misc_feature (56)..(108): Pfam ID: AP2 Pfam Description: AP2 domain
MEYGVADDYGYGYGGYDDQQDLPSSSSVDGDEYATVLSAPPKRPAGRTKFRETRHPVYRGVRRRGPAGRWVCEVREPNKKSRIWLGTFATAEAAARAHDVAALALRGRAACLNFADSARLLRVDPATLATPDDIRRAAIQLAEDSSSSTPDASAAAAAVAVASSASVGQATPSSSAYQAGDDATGAAMYGAEYAAAAMYGAGMDFDHSYYYDGMVGGNEWQSAGSSGWHSNVDAGDDEGAGDMSLWSYY

SEQ ID NO: 19680 - DNA, 1527 bp, Sorghum bicolor
  misc_feature: Ceres ANNOT ID no. 8734697
  misc_feature: Encodes the peptide sequence at SEQ ID NO 19681
atggccgccgccgggtgcggcggcggcggcgtcggcgacgccaagtacaactcgtacaaggcgccggggctgcggggcgccttcctggaggcggcgcacgtctcgtgcctcgaggaccggtacgcgctgggcccgcagcttgggtggggccagttcggcgtgatccggtcctgctccgacctcgtcaccggcgaggcgctggcctgcaagtccatcgccaagggccgcctgctgtcccccgacgacgtgcgcggggtcaagctcgagatcgaggtcatggcgcgcctcgcgggccaccccaacgtcgtcgacctcaaggccgtgtacgaggaccacgactccgtgcacctcgtcatggagctctgcgcgggcggggagctcttccaccgactcgaggagcgcggatgcttctccgagcacgaggccgcagtgctgttccggtacctcatggaggtcgtcgcgcattgtcacagcaaagggatcgtgcaccgggacctcaagcccgagaacatcctcctcgtcagcaagtcgccctcgtcgccgatcaagctcgctgactttggactcgctacctacatccagcctggtcgaagcttgagcggcatggtaggcagcccgttctacattgcgccagaggtgctctccggtggatacaatgaggccgccgatgtctggagtgcgggggtgatactctacatcctcctgagtggcatcccgccattttgggggaaaaccaagtccaagattttcgagtgcatcagatcgatggagctgcgattcccttctgatccatgggatagggtttctgattcggccaaggaactagtcaccgggatgttaaggcgtgaccctagacaacgactcacggccaagcaggttctagagcatccgtggatgcaagaacacgcggaccaatcacaagattcctgcagccattgccacgagatcggcctccggcgggaggaccctggctcatgctccttctccatgccactagcgtcacggagcagggacatgagcttcaacacaggcggcgcgatcgcctgccagggcacgccagaggacgaggcgtgctgctcgcccacgttcgccaccgcctgcaggtcgtccttctcggcgtttgtcaccgacccagccccgtcgtcctgcctggcctccacctccggtggctctgggttctcattcggtggggcctgtgaaccgccctgtggaggtttcccattgcctgtgccttccatgccgagcttctcgttcttcagcgcgcaagactgcagcgagcctgaaccgtcggtggcggcggcagccgagaaagctccctgcgacgcgacggtggctgcctcgtccctgaggacggcaaaaggggccacgtcgcggggtgtcgtcggcgtcaacggcaggcggaaccacacgatcggcgccggcgggcgggagcacctggacgtggcggtgtcggagtccgtcatacgctgggcgtcgtgcaccaacttctccacgacgcactcgctccgggcctccctcgtgtgctag

SEQ ID NO: 19681 - protein, 508 aa, Sorghum bicolor
  misc_feature: The sequence is a functional homolog of SEQ ID NO 2 in US patent 7084323
  misc_feature: Ceres ANNOT ID no. 8734697
  misc_feature (23)..(300): SWISSPROT Homolog: EC 2.7.11.1 Non-specific serine/threonine protein kinase
  misc_feature (41)..(299): Pfam ID: Pkinase Pfam Description: Protein kinase domain
MAAAGCGGGGVGDAKYNSYKAPGLRGAFLEAAHVSCLEDRYALGPQLGWGQFGVIRSCSDLVTGEALACKSIAKGRLLSPDDVRGVKLEIEVMARLAGHPNVVDLKAVYEDHDSVHLVMELCAGGELFHRLEERGCFSEHEAAVLFRYLMEVVAHCHSKGIVHRDLKPENILLVSKSPSSPIKLADFGLATYIQPGRSLSGMVGSPFYIAPEVLSGGYNEAADVWSAGVILYILLSGIPPFWGKTKSKIFECIRSMELRFPSDPWDRVSDSAKELVTGMLRRDPRQRLTAKQVLEHPWMQEHADQSQDSCSHCHEIGLRREDPGSCSFSMPLASRSRDMSFNTGGAIACQGTPEDEACCSPTFATACRSSFSAFVTDPAPSSCLASTSGGSGFSFGGACEPPCGGFPLPVPSMPSFSFFSAQDCSEPEPSVAAAAEKAPCDATVAASSLRTAKGATSRGVVGVNGRRNHTIGAGGREHLDVAVSESVIRWASCTNFSTTHSLRASLVC

SEQ ID NO: 19682 - DNA, 1047 bp, Sorghum bicolor
  misc_feature: Ceres ANNOT ID no. 8734781
  misc_feature: Encodes the peptide sequence at SEQ ID NO 19683
atggagaagaagacggtggtgctgtatccgggcgtcggcgtcggccacctcgcgccgatgctcgagctggccaaggcgttcctccgccacggtggagaccaggtcgacgtcgccatcgcggtcttcgagccgcccgtctacgccaacggcttcgcctccacggtcgcgcgcgccaaggcctccaacgcctccgtcgccttgcacgtgcttcccccgccaccgccgccgccggcggcctccgacgacgccgagcctgatgtccccttggcccggatgctccgcttcctccgcgccacgaatgcgccgctccgcgacttccttcgcgcgatcgtcctcgacatgttctgcgccgacgcgctcgacgtcgccgccgagcttggcctgcccgcctacttcttcttcccctcgggcaccgccggcctcgcctgcttcctcggcctccccgccatgcgcgccagagtgggcaccagcttcgcggcgctcgggaactccgccgtcctgtcgttcccgggcgctcctccgttcacggttgcggacctggcgcaggggctggcggacgacggcgaggcgtgcaagggcatcatcggcgtggctgcccggatgccggaagcccgcggcatcctcatcaactccttcgagtcgctggagccgcgcgcgatgtgggcgctcagggacgggctgtgcgtgccggaccgccccacgccgccggtctactgcgtcgggccaagaatgggacaagaagtccgccgtgctcctcttgagatcaaagtctgccccgtcacctaccaccgccaccaccggagccgaggaaccgacatcgacatccattgcggccgagaggctccgcctggcgcccgggtccccgccgctgggcgacctcacggggagcaccgatgccgccgccgcggcacgggtggaaagcgaacgggcgagctcatagggcagcaggccataaaagctccagtgctcccgtacctggcagtggcaccaagtcttccaagaaatcacaattttggcttccaagaaatcacacagatgatagactag

SEQ ID NO: 19683 - protein, 348 aa, Sorghum bicolor
  misc_feature: Useful for making plants with altered carbohydrate content
  misc_feature: Functional homolog of the protein sequence given in SEQ ID NO 14447
  misc_feature: Ceres ANNOT ID no. 8734781
  misc_feature (6)..(242): SWISSPROT Homolog: EC 2.4.1.218 Hydroquinone glucosyltransferase
MEKKTVVLYPGVGVGHLAPMLELAKAFLRHGGDQVDVAIAVFEPPVYANGFASTVARAKASNASVALHVLPPPPPPPAASDDAEPDVPLARMLRFLRATNAPLRDFLRAIVLDMFCADALDVAAELGLPAYFFFPSGTAGLACFLGLPAMRARVGTSFAALGNSAVLSFPGAPPFTVADLAQGLADDGEACKGIIGVAARMPEARGILINSFESLEPRAMWALRDGLCVPDRPTPPVYCVGPRMGQEVRRAPLEIKVCPVTYHRHHRSRGTDIDIHCGREAPPGARVPAAGRPHGEHRCRRRGTGGKRTGELIGQQAIKAPVLPYLAVAPSLPRNHNFGFQEITQMID

SEQ ID NO: 19684 - DNA, 1659 bp, Sorghum bicolor
  misc_feature: Ceres ANNOT ID no. 8734777
  misc_feature: Encodes the peptide sequence at SEQ ID NO 19685
atggcgctccacctcatgctcgccgccgcggccgcattcgccgtcctcgcaccgccagcagcgagtagcggccccacccccgcaccgccggcgctagggatcaactacgggcaggtggctgacaacctgccgccgccacaggcggccctactcctcctccgcgcgctgaacgccacgcgagtgaaactctacgacgcggacgcgcgcgtgctccgcgccttcgccggctccggggtcgacttcaccgtcggcgtgcccgaccgcctggtgccgcgcatggccaccgacccatccgcggccgcgtcgtgggtgcggagcaacctcctgccccacctcccggccacgtccatcaccgccgtgacggtcggcaacgaggtgctgtcggggacgaacgccgccatgctgcggtcgctgctcccggccatggagtcgctgcacgcggcgctggcggcgtgcaacctcacctcccgtgtctccgtcaccacggcgcactccctcgccgtgctgtcctcctcgttcccgccgtcgtcggccgcgttccggcgggaggtggtcccctacatggccccgctgctggggttcctggcgcgcaccggcgcgccgttcctggtgaacgcgtacccgtacttcgcgtacaaggcggacccggaccgggtggacctcggctacgcgctgttcgaggcgaattccgccggcgtagctgacgccgccacggggctgcggtatgataacatgctgcacgcgatggtggacgccgcgcgcgccgccatctgcagggcgaactacggcaaggcgctggagatccgcgtgtcggagaccgggtggccgtcgcagggagacgacgacgaggccggcgccacgccggagaacgccgcaaggtataatgggaacctcatgcgcctcgtcgcgcaggggaagggcacgccggcggcgccgggggagccgctgcaggtctacgtgttcgcgctcttcaacgaggaccagaagcccggaccggcgtccgagcgacattacgggctgttcaaacccgacggcaccccggcttacgatgtcggcgtcaaggcgccgaccatcacactgcccaaggggaacggcagcagcgggagcgggaataatggcaccggcggattggtggtggcgcaagggcccggcggcgccgacggcgtcgggcccggcaccggatactacactgtgtctgccgcagcaatgaacaagccctcctttgcaagcaatgcttttgtcggcactacatacagctttggatttgttatctattgctcactggcagctgcctattctgtgttcacaatcacaggtgaagagcaggcggcggcggtgcatggaaagcttggtggcggcggctgccgtcctggccatggtgtccggaccctctgcaaaatagtgccacatcgcctaatcaagcacggggaactagcggggaacaataaagatagatggagggacaaccttgaaacatacttacctggacgggggtctatggtgatcatgaagagccatggcctaggtaccattaatccgatagtatatttgctaagacaggagcagatcattctaaaggattcagctaaaataaatgaaaaagaacaagataaaatcgtcttcaaaactgcttataacaggatcaggaattgtccttga

SEQ ID NO: 19685 - protein, 552 aa, Sorghum bicolor
  misc_feature: Useful for making plants with altered carbohydrate content
  misc_feature: Functional homolog of the protein sequence given in SEQ ID NO 14155
  misc_feature: Useful for making plants with altered cell wall content and/or composition
  misc_feature: Functional homolog of the protein sequence given in SEQ ID NO 14732
  misc_feature: Ceres ANNOT ID no. 8734777
  misc_feature (34)..(353): SWISSPROT Homolog: EC 3.2.1.39 Glucan endo-1,3-beta-D-glucosidase
  misc_feature (32)..(353): Pfam ID: Glyco_hydro_17 Pfam Description: Glycosyl hydrolases family 17
MALHLMLAAAAAFAVLAPPAASSGPTPAPPALGINYGQVADNLPPPQAALLLLRALNATRVKLYDADARVLRAFAGSGVDFTVGVPDRLVPRMATDPSAAASWVRSNLLPHLPATSITAVTVGNEVLSGTNAAMLRSLLPAMESLHAALAACNLTSRVSVTTAHSLAVLSSSFPPSSAAFRREVVPYMAPLLGFLARTGAPFLVNAYPYFAYKADPDRVDLGYALFEANSAGVADAATGLRYDNMLHAMVDAARAAICRANYGKALEIRVSETGWPSQGDDDEAGATPENAARYNGNLMRLVAQGKGTPAAPGEPLQVYVFALFNEDQKPGPASERHYGLFKPDGTPAYDVGVKAPTITLPKGNGSSGSGNNGTGGLVVAQGPGGADGVGPGTGYYTVSAAAMNKPSFASNAFVGTTYSFGFVIYCSLAAAYSVFTITGEEQAAAVHGKLGGGGCRPGHGVRTLCKIVPHRLIKHGELAGNNKDRWRDNLETYLPGRGSMVIMKSHGLGTINPIVYLLRQEQIILKDSAKINEKEQDKIVFKTAYNRIRNCP

SEQ ID NO: 19686 - DNA, 1287 bp, Sorghum bicolor
  misc_feature: Ceres ANNOT ID no. 8734776
  misc_feature: Encodes the peptide sequence at SEQ ID NO 19687
atgagcatctcggtgaacgggcagtcggtggtgccgccggggttccggttccacccgacggaggaggagcttctgacctactacctcaagaagaaggtggcgtcggagcgcatcgacctggacgtcatccgcgacgtcgacctgaacaagctcgagccatgggacatccaagagaagtgccgcatcggttctggcccccagaacgactggtacttcttcagccacaaggacaagaagtacccgacggggacgcgcaccaaccgcgccaccgccgccggcttctggaaggccaccggccgcgacaaggccatctacgcgtccggcgcccgccgcatcggcatgcgcaagacgctcgtcttctacaagggtcgtgccccgcacggccagaagtccgactggatcatgcacgagtaccgcctcgagccggcgctcgacgtcgacgccgccgccggtagtgcctccgcccaccacgccgccgccggggccgccgccgatcatcacccctactacacctcgtcgtcgccgcctgctcttcctaccgcaatccgtggcgcggccggagaccaacaagcggcgcaggagcaggaagggtgggtgatctgcagggtgttcaagaagaagaacctcgttcaccacggccagagcagcggcggcggcgtgacagcagcaggatccaagatggcgtctgcggcggcgcccatggagggcagcccgagccactgctcgtcggtgaccgtcatcagtgaccacaccatgaacaagcaccaggcgcaggcgatgctgcagcactccgccagcgacgacgacgcgctcgaccacatcctgcagtacatgggcggcggcggcggcaagcagccggacaccaagccggtgctgctggaccatcaccaccaccaccacctagctgcagcagctactacgacgaccaccgcgtgctctgccggcggcgcgggtctctacgggaagttcatgaagctcccgcccctcgagcacgccggcggcggcggcgggctgctgccgagccctgcaggggcgtgcgactacggcgccgccgacgcctcggggatcgccgactgggacgcgctggaccggctcgccgcgtacgagctcaacggcctctccgacgcgtccaagaacatgtccgccttcttcgacgaacccagcgccaccgccgccttctcctcctcctcctcgtccgtgcacgcggccgccgtcgacggcgacctgtggagcctggcgaggtcggtgtcggcgttgcacgcggacttgacgatgaacaacgtctag

SEQ ID NO: 19687 - protein, 428 aa, Sorghum bicolor
  misc_feature: Useful for making plants with altered carbohydrate content
  misc_feature: Functional homolog of the protein sequence given in SEQ ID NO 13622
  misc_feature: Ceres ANNOT ID no. 8734776
  misc_feature (11)..(141): Pfam ID: NAM Pfam Description: No apical meristem (NAM) protein
MSISVNGQSVVPPGFRFHPTEEELLTYYLKKKVASERIDLDVIRDVDLNKLEPWDIQEKCRIGSGPQNDWYFFSHKDKKYPTGTRTNRATAAGFWKATGRDKAIYASGARRIGMRKTLVFYKGRAPHGQKSDWIMHEYRLEPALDVDAAAGSASAHHAAAGAAADHHPYYTSSSPPALPTAIRGAAGDQQAAQEQEGWVICRVFKKKNLVHHGQSSGGGVTAAGSKMASAAAPMEGSPSHCSSVTVISDHTMNKHQAQAMLQHSASDDDALDHILQYMGGGGGKQPDTKPVLLDHHHHHHLAAAATTTTTACSAGGAGLYGKFMKLPPLEHAGGGGGLLPSPAGACDYGAADASGIADWDALDRLAAYELNGLSDASKNMSAFFDEPSATAAFSSSSSSVHAAAVDGDLWSLARSVSALHADLTMNNV

SEQ ID NO: 19688 - DNA, 1026 bp, Sorghum bicolor
  misc_feature: Ceres ANNOT ID no. 8734789
  misc_feature: Encodes the peptide sequence at SEQ ID NO 19689
atgcagcatctgggcgtgctcctcgtcttggctgcactcaccgcgtcgccgctcgctgcggcgtggcgcccgtggccgccgcgcgccaacgggacgacggcggggctgggcgcttcaaagaagttcgagggctcgtcggagttcgtgaagctagagtaccacatgggtcccgtcctggcgtccgccatcacggtgcacccgatctggtatggcgcctggcccgccgcgcagaagcgcacgatccgcgcgttcctccgctccctcgcgccaccgcccgactcgtcggcccgcatccctcctccgtcggtctccgcctggtggcgcacggtgcggctctacacggaccagacctccgccaacgtgtcggcggccgtgaccctgggcgcggagaagtgcgacgcgcgcatgtcccgcggcgcgcgtctctcccggatggacatccagtccgtggtccgcgacgcggtcacggcgcgcacccgcccgctccccgtcgactccagcggcggcgtgtacctggtgctcacctccccggacgtctccgtggaggacttctgcgggcaggtgtgcggcttccactacttcacgtttccgtcggtggtcggctacacgctgccctacgcgtgggtcgggaactcggcgcggcggtgccccgaggtgtgcgcgtacccgttcgcgatcccgtcgtatgtccccgggcggaaggcggaggcgccgccgaacggggacgtcggcgtggacgggatggtcagcgtcatcgcgcacgagctggccgagctcgcgtccaacccgctcgccaacgcgtggtacgctgggagtgacccctcgttcccgaccgagatcgctgacctctgcgaggggatctacggcaccggcggcggtggcgcgtacaccgggcagctcctcacggatgcgcgctccggcgcggcgtataacgttaatggcgtcggtggccggaggttcctcgtgcagtgggtttggaaccccgtgctcagctactgctccggccccaacgcgctcgaccagtag

SEQ ID NO: 19689 - protein, 341 aa, Sorghum bicolor
  misc_feature: Useful for biocontainment applications
  misc_feature: Functional homolog of the protein sequence given in SEQ ID NO 14166
  misc_feature: Ceres ANNOT ID no. 8734789
  misc_feature (51)..(337): Pfam ID: Phi_1 Pfam Description: Phosphate-induced protein 1 conserved region
MQHLGVLLVLAALTASPLAAAWRPWPPRANGTTAGLGASKKFEGSSEFVKLEYHMGPVLASAITVHPIWYGAWPAAQKRTIRAFLRSLAPPPDSSARIPPPSVSAWWRTVRLYTDQTSANVSAAVTLGAEKCDARMSRGARLSRMDIQSVVRDAVTARTRPLPVDSSGGVYLVLTSPDVSVEDFCGQVCGFHYFTFPSVVGYTLPYAWVGNSARRCPEVCAYPFAIPSYVPGRKAEAPPNGDVGVDGMVSVIAHELAELASNPLANAWYAGSDPSFPTEIADLCEGIYGTGGGGAYTGQLLTDARSGAAYNVNGVGGRRFLVQWVWNPVLSYCSGPNALDQ

SEQ ID NO: 19690 - DNA, 2223 bp, Sorghum bicolor
  misc_feature: Ceres ANNOT ID no. 8734797
  misc_feature: Encodes the peptide sequence at SEQ ID NO 19691
atggctacgcactcggtcgccgccgcgcacgccaccatcgccgcgcgcgcggcgccggctgccggggcgtcggccccggccgagcgccttggcttccgcctcagctcgctcgccggccgcggcctgcgttccccgctcccggcccgccgcgcgccgtccgcggccgcgtcccgccgccagcgcgtcgtgcgcgccgccgccgtcgagacgctcgaggggaaggccgccacgggcgagctgctcgagaagtcggtcaacacgatccggttcctggccatcgacgccgtcgagaaggccaactccggtcacccgggcctccccatgggctgcgcgcccatgggccacatcctctacgacgaggtcatgcgctacaaccccaagaacccctactggttcaaccgtgaccgcttcgttctctccgccggccacggctgcatgctccagtacgccctgctccacctcgccggatacgacagtgttaaggaggaggatttgaagcagttcaggcaatggggaagcaagacaccgggccaccctgagaactttgagactccaggagttgaagttaccactggaccccttggtcagggtatcgccaatgctgttgggttggcgcttgctgagaagcacctggctgctcgcttcaacaagcctgacagtgagattgtcgaccactacacgtatgttattttgggagatggttgccaaatggagggtattgccaatgaagcttgctccttggctggacactggggtcttggcaagctgattgctttctacgatgacaaccacatttccatcgatggagatacagagattgcattcacagaggacgtgagcacccgctttgaggctcttgggtggcacacgatctgggttaagaatgggaacaacggctatgatgacatccgtgcagccattaaggaggcgaaggcagttactgacaagcccaccttaatcaaggtgactaccacaatcggttttggatcgcccaacaaggccaactcatacagtgtgcatggaagtgcattgggtgccaaagaggttgaagcaaccaggcagaaccttggatggccctatgagccgttctttgttccagaggacgtcaagagccactggagccgccacacacctgaaggtgctgcacttgaggctgattggaatgctaagtttgcagagtacgagaagaagtatgcagacgatgcagcaaccttgaaaagtatcatcacaggagagttccctactggctgggctgatgcgcttcctaaatacactccagagagcccaggagatgccaccaggaacctctcccagcagtgcttgaatgcacttgctaatgttgtgcctggtcttattggaggtagtgctgatcttgcgtcctccaacatgactctgcttaagatgtttggtgacttccagaaggatacggctgaagagcgcaatgtccggtttggagtcagagaacacggaatgggcgccatttgcaatggcattgctctgcacagtccagggtttgttccatactgtgctacattctttgtcttcactgattacatgagaggtgccatgaggatctcagctctgtctgaggctggagttatctatgttatgacccacgactctattggtcttggagaagatggtccgacccatcagcccattgagcacttggtgagtttccgtgcaatgccgaacatattgatgctccgccctgctgatggcaatgagaccgccggagcatacaaagttgcagttctcaacaggaagaggccatctattctcgctctttccaggcaaaagcttcctcacctgcctggtacctcaattgagggagtcgagaagggtggatataccatctctgacaactcaactggcaacaagcctgacctcattgtgttgggtactggctctgaactggagattgcggaaaaggctgccgatgagttgaggaaggaggggaagacagtccgtgtcgtctcatttgtttcttgggaacttttcgatgaacagtcagatgaatacaaggagagtgtcctgcctgcagccgtcaccgcaagaatcagcattgaggccgggtctactctcggctggcagaagtatgtcggagcccagggcaaggccattggcatcgacaaattcggtgcgagtgctcctgccggaacgatctacaaggagtatggcatcactgtggagagcgtcattgcggcggccaagagcttttaa

SEQ ID NO: 19691 - protein, 740 aa, Sorghum bicolor
  misc_feature: Useful for making plants with modulated biomass
  misc_feature: Functional homolog of the protein sequence given in SEQ ID NO 13642
  misc_feature: Ceres ANNOT ID no. 8734797
  misc_feature (69)..(740): SWISSPROT Homolog: EC 2.2.1.1 Transketolase
  misc_feature (80)..(414): Pfam ID: Transketolase_N Pfam Description: Transketolase, thiamine diphosphate binding domain
  misc_feature (429)..(604): Pfam ID: Transket_pyr Pfam Description: Transketolase, pyrimidine binding domain
  misc_feature (616)..(733): Pfam ID: Transketolase_C Pfam Description: Transketolase, C-terminal domain
MATHSVAAAHATIAARAAPAAGASAPAERLGFRLSSLAGRGLRSPLPARRAPSAAASRRQRVVRAAAVETLEGKAATGELLEKSVNTIRFLAIDAVEKANSGHPGLPMGCAPMGHILYDEVMRYNPKNPYWFNRDRFVLSAGHGCMLQYALLHLAGYDSVKEEDLKQFRQWGSKTPGHPENFETPGVEVTTGPLGQGIANAVGLALAEKHLAARFNKPDSEIVDHYTYVILGDGCQMEGIANEACSLAGHWGLGKLIAFYDDNHISIDGDTEIAFTEDVSTRFEALGWHTIWVKNGNNGYDDIRAAIKEAKAVTDKPTLIKVTTTIGFGSPNKANSYSVHGSALGAKEVEATRQNLGWPYEPFFVPEDVKSHWSRHTPEGAALEADWNAKFAEYEKKYADDAATLKSIITGEFPTGWADALPKYTPESPGDATRNLSQQCLNALANVVPGLIGGSADLASSNMTLLKMFGDFQKDTAEERNVRFGVREHGMGAICNGIALHSPGFVPYCATFFVFTDYMRGAMRISALSEAGVIYVMTHDSIGLGEDGPTHQPIEHLVSFRAMPNILMLRPADGNETAGAYKVAVLNRKRPSILALSRQKLPHLPGTSIEGVEKGGYTISDNSTGNKPDLIVLGTGSELEIAEKAADELRKEGKTVRVVSFVSWELFDEQSDEYKESVLPAAVTARISIEAGSTLGWQKYVGAQGKAIGIDKFGASAPAGTIYKEYGITVESVIAAAKSF

SEQ ID NO: 19692 - DNA, 1050 bp, Sorghum bicolor
  misc_feature: Ceres ANNOT ID no. 8734845
  misc_feature: Encodes the peptide sequence at SEQ ID NO 19693
atggatcctgcagtggcggcagcggcggcgcacggcggcgggcaccacttcgcgcagcccgtggcgccgttccaccacccgttcggcggcttaggcggacaccaccaccacctgttcccggggcagcagcacccggcgttccagcatttccaggagcagcagcgccagctggagctgctgggcgccgggggcggtgtccccggcggcgtcaacaagcaggagctcggtgtcggcggggacgacagcaacaacaccatcaacagcgccgggagcaacgggagcggcgacggcgcggtcgcgggcgcggaccagcaggcggggggcggcgacggcgaccagcagcagcagcagcacgcgttggtgatgcgccgcccgcgtggccgccccgcggggtccaagaacaagcccaagccgcccgtgatcatcacccgtgacagcgccagcgccctgcgcgcccacgtcctggaggtcgccgccggctgcgacgtcgtcgacagcatcgccgggttcgcgcgtcgccgccaggtgggcgtgtgcgtgctcagcgcctccgggagcgtcgccaacgtctgcatccgtcattccggcgctgctccgggcgccgtcgtcaccatggcgggctgcttcgacatcctctccctcagcggctccttcctcccgccgccggcgccgcccgccgccaccgggctcaccgtctacctctccggcggtcagggccaggtggtgggcggcaccgtcgccggaccgctcctcgcctccggccctgtcgtgatcgtcgccgcctgcttcggcaacgccgcctacgagcgcctccccctcgacgacgacgagccgccgcagcagcagctcctgcaacaggctcttcctcctccgcaaggcatggccggtgcctcctcctcctcgccgcccccgccgctgtcattgcccggacaacacccgctcgccgaccagctcccccacagcctcatgaacggcctccctctccccgccgacgcctacgcctgggccaacccgggaggcagcggcgccggccgcgtcgccccgtactga

SEQ ID NO: 19693 - protein, 349 aa, Sorghum bicolor
  misc_feature: The sequence is a functional homolog of SEQ ID NO 1403 in the 10/374,780 US patent application
  misc_feature: The sequence is a functional homolog of SEQ ID NO 1404 in the 10/374,780 US patent application
  misc_feature: The sequence is a functional homolog of SEQ ID NO 32 in the 10/669,824 US patent application
  misc_feature: The sequence is a functional homolog of SEQ ID NO 32 in the 10/870,198 US patent application
  misc_feature: The sequence is a functional homolog of SEQ ID NO 348 in the 11/435,388 US patent application
  misc_feature: The sequence is a functional homolog of SEQ ID NO 350 in the 10/714,887 US patent application
  misc_feature: The sequence is a functional homolog of SEQ ID NO 1415 in the 10/374,780 US patent application
  misc_feature: The sequence is a functional homolog of SEQ ID NO 24 in the 10/669,824 US patent application
  misc_feature: The sequence is a functional homolog of SEQ ID NO 24 in the 10/870,198 US patent application
  misc_feature: The sequence is a functional homolog of SEQ ID NO 386 in the 11/435,388 US patent application
  misc_feature: The sequence is a functional homolog of SEQ ID NO 388 in the 10/714,887 US patent application
  misc_feature: The sequence is a functional homolog of SEQ ID NO 1515 in the 11/479,226 US patent application
  misc_feature: The sequence is a functional homolog of SEQ ID NO 226 in the 10/374,780 US patent application
  misc_feature: The sequence is a functional homolog of SEQ ID NO 302 in the 11/435,388 US patent application
  misc_feature: The sequence is a functional homolog of SEQ ID NO 304 in the 10/714,887 US patent application
  misc_feature: The sequence is a functional homolog of SEQ ID NO 52 in the 10/669,824 US patent application
  misc_feature: The sequence is a functional homolog of SEQ ID NO 52 in the 10/870,198 US patent application
  misc_feature: The sequence is a functional homolog of SEQ ID NO 56 in the 10/225,066 US patent application
  misc_feature: The sequence is a functional homolog of SEQ ID NO 726 in the 10/412,699 US patent application
  misc_feature: The sequence is a functional homolog of SEQ ID NO 1840 in the 10/412,699 US patent application
  misc_feature: The sequence is a functional homolog of SEQ ID NO 2080 in the 10/374,780 US patent application
  misc_feature: The sequence is a functional homolog of SEQ ID NO 258 in the 10/225,066 US patent application
  misc_feature: The sequence is a functional homolog of SEQ ID NO 304 in the 11/435,388 US patent application
  misc_feature: The sequence is a functional homolog of SEQ ID NO 306 in the 10/714,887 US patent application
  misc_feature: The sequence is a functional homolog of SEQ ID NO 54 in the 10/669,824 US patent application
  misc_feature: The sequence is a functional homolog of SEQ ID NO 54 in the 10/870,198 US patent application
  misc_feature: The sequence is a functional homolog of SEQ ID NO 728 in the 10/412,699 US patent application
  misc_feature: The sequence is a functional homolog of SEQ ID NO 12 in the 10/669,824 US patent application
  misc_feature: The sequence is a functional homolog of SEQ ID NO 12 in the 10/870,198 US patent application
  misc_feature: The sequence is a functional homolog of SEQ ID NO 1405 in the 10/374,780 US patent application
  misc_feature: The sequence is a functional homolog of SEQ ID NO 34 in the 10/669,824 US patent application
  misc_feature: The sequence is a functional homolog of SEQ ID NO 34 in the 10/870,198 US patent application
  misc_feature: The sequence is a functional homolog of SEQ ID NO 354 in the 11/435,388 US patent application
  misc_feature: The sequence is a functional homolog of SEQ ID NO 356 in the 10/714,887 US patent application
  misc_feature: The sequence is a functional homolog of SEQ ID NO 1395 in the 10/374,780 US patent application
  misc_feature: The sequence is a functional homolog of SEQ ID NO 1507 in the 10/412,699 US patent application
  misc_feature: The sequence is a functional homolog of SEQ ID NO 22 in the 10/669,824 US patent application
  misc_feature: The sequence is a functional homolog of SEQ ID NO 22 in the 10/870,198 US patent application
  misc_feature: The sequence is a functional homolog of SEQ ID NO 346 in the 11/435,388 US patent application
  misc_feature: The sequence is a functional homolog of SEQ ID NO 348 in the 10/714,887 US patent application
  misc_feature: The sequence is a functional homolog of SEQ ID NO 222 in the 10/374,780 US patent application
  misc_feature: The sequence is a functional homolog of SEQ ID NO 240 in the 10/714,887 US patent application
  misc_feature: The sequence is a functional homolog of SEQ ID NO 240 in the 11/435,388 US patent application
  misc_feature: The sequence is a functional homolog of SEQ ID NO 254 in the 10/225,066 US patent application
  misc_feature: The sequence is a functional homolog of SEQ ID NO 42 in the 10/669,824 US patent application
  misc_feature: The sequence is a functional homolog of SEQ ID NO 42 in the 10/870,198 US patent application
  misc_feature: The sequence is a functional homolog of SEQ ID NO 64 in the 10/225,068 US patent application
  misc_feature: The sequence is a functional homolog of SEQ ID NO 722 in the 10/412,699 US patent application
  misc_feature: The sequence is a functional homolog of SEQ ID NO 94 in the 11/375,241 US patent application
  misc_feature: The sequence is a functional homolog of SEQ ID NO 1416 in the 10/374,780 US patent application
  misc_feature: The sequence is a functional homolog of SEQ ID NO 16 in the 10/669,824 US patent application
  misc_feature: The sequence is a functional homolog of SEQ ID NO 16 in the 10/870,198 US patent application
  misc_feature: The sequence is a functional homolog of SEQ ID NO 388 in the 11/435,388 US patent application
  misc_feature: The sequence is a functional homolog of SEQ ID NO 390 in the 10/714,887 US patent application
  misc_feature: The sequence is a functional homolog of SEQ ID NO 1417 in the 10/374,780 US patent application
  misc_feature: The sequence is a functional homolog of SEQ ID NO 18 in the 10/669,824 US patent application
  misc_feature: The sequence is a functional homolog of SEQ ID NO 18 in the 10/870,198 US patent application
  misc_feature: The sequence is a functional homolog of SEQ ID NO 390 in the 11/435,388 US patent application
  misc_feature: The sequence is a functional homolog of SEQ ID NO 392 in the 10/714,887 US patent application
  misc_feature: The sequence is a functional homolog of SEQ ID NO 1409 in the 10/374,780 US patent application
  misc_feature: The sequence is a functional homolog of SEQ ID NO 40 in the 10/669,824 US patent application
  misc_feature: The sequence is a functional homolog of SEQ ID NO 40 in the 10/870,198 US patent application
  misc_feature: The sequence is a functional homolog of SEQ ID NO 412 in the 11/435,388 US patent application
  misc_feature: The sequence is a functional homolog of SEQ ID NO 414 in the 10/714,887 US patent application
  misc_feature: The sequence is a functional homolog of SEQ ID NO 1402 in the 10/374,780 US patent application
  misc_feature: The sequence is a functional homolog of SEQ ID NO 1410 in the 10/374,780 US patent application
  misc_feature: The sequence is a functional homolog of SEQ ID NO 344 in the 11/435,388 US patent application
  misc_feature: The sequence is a functional homolog of SEQ ID NO 346 in the 10/714,887 US patent application
  misc_feature: The sequence is a functional homolog of SEQ ID NO 38 in the 10/669,824 US patent application
  misc_feature: The sequence is a functional homolog of SEQ ID NO 38 in the 10/870,198 US patent application
  misc_feature: The sequence is a functional homolog of SEQ ID NO 14 in the 10/669,824 US patent application
  misc_feature: The sequence is a functional homolog of SEQ ID NO 14 in the 10/870,198 US patent application
  misc_feature: The sequence is a functional homolog of SEQ ID NO 384 in the 11/435,388 US patent application
  misc_feature: The sequence is a functional homolog of SEQ ID NO 386 in the 10/714,887 US patent application
  misc_feature: The sequence is a functional homolog of SEQ ID NO 1413 in the 10/374,780 US patent application
  misc_feature: The sequence is a functional homolog of SEQ ID NO 248 in the 10/714,887 US patent application
  misc_feature: The sequence is a functional homolog of SEQ ID NO 248 in the 11/435,388 US patent application
  misc_feature: The sequence is a functional homolog of SEQ ID NO 456 in the 10/374,780 US patent application
  misc_feature: The sequence is a functional homolog of SEQ ID NO 498 in the 10/225,066 US patent application
  misc_feature: The sequence is a functional homolog of SEQ ID NO 84 in the 10/870,198 US patent application
  misc_feature: The sequence is a functional homolog of SEQ ID NO 92 in the 10/225,068 US patent application
  misc_feature: The sequence is a functional homolog of SEQ ID NO 66 in the 10/669,824 US patent application
  misc_feature: The sequence is a functional homolog of SEQ ID NO 66 in the 10/870,198 US patent application
  misc_feature: The sequence is a functional homolog of SEQ ID NO 1411 in the 10/374,780 US patent application
  misc_feature: The sequence is a functional homolog of SEQ ID NO 36 in the 10/669,824 US patent application
  misc_feature: The sequence is a functional homolog of SEQ ID NO 36 in the 10/870,198 US patent application
  misc_feature: The sequence is a functional homolog of SEQ ID NO 392 in the 11/435,388 US patent application
  misc_feature: The sequence is a functional homolog of SEQ ID NO 394 in the 10/714,887 US patent application
  misc_feature: The sequence is a functional homolog of SEQ ID NO 150 in the 10/225,066 US patent application
  misc_feature: The sequence is a functional homolog of SEQ ID NO 1511 in the 11/479,226 US patent application
  misc_feature: The sequence is a functional homolog of SEQ ID NO 2 in the 10/669,824 US patent application
  misc_feature: The sequence is a functional homolog of SEQ ID NO 2 in the 10/870,198 US patent application
  misc_feature: The sequence is a functional homolog of SEQ ID NO 224 in the 10/374,780 US patent application
  misc_feature: The sequence is a functional homolog of SEQ ID NO 300 in the 11/435,388 US patent application
  misc_feature: The sequence is a functional homolog of SEQ ID NO 302 in the 10/714,887 US patent application
  misc_feature: The sequence is a functional homolog of SEQ ID NO 724 in the 10/412,699 US patent application
  misc_feature: The sequence is a functional homolog of SEQ ID NO 64 in the 10/669,824 US patent application
  misc_feature: The sequence is a functional homolog of SEQ ID NO 64 in the 10/870,198 US patent application
  misc_feature: The sequence is a functional homolog of SEQ ID NO 1928 in the 11/479,226 US patent application
  misc_feature: The sequence is a functional homolog of SEQ ID NO 86 in the 10/870,198 US patent application
  misc_feature: The sequence is a functional homolog of SEQ ID NO 1418 in the 10/374,780 US patent application
  misc_feature: The sequence is a functional homolog of SEQ ID NO 1908 in the 10/412,699 US patent application
  misc_feature: The sequence is a functional homolog of SEQ ID NO 2166 in the 10/374,780 US patent application
  misc_feature: The sequence is a functional homolog of SEQ ID NO 318 in the 11/435,388 US patent application
  misc_feature: The sequence is a functional homolog of SEQ ID NO 320 in the 10/714,887 US patent application
  misc_feature: The sequence is a functional homolog of SEQ ID NO 8 in the 10/669,824 US patent application
  misc_feature: The sequence is a functional homolog of SEQ ID NO 8 in the 10/870,198 US patent application
  misc_feature: The sequence is a functional homolog of SEQ ID NO 94 in the 10/225,066 US patent application
  misc_feature: The sequence is a functional homolog of SEQ ID NO 92 in the 10/669,824 US patent application
  misc_feature: Ceres ANNOT ID no. 8734845
MDPAVAAAAAHGGGHHFAQPVAPFHHPFGGLGGHHHHLFPGQQHPAFQHFQEQQRQLELLGAGGGVPGGVNKQELGVGGDDSNNTINSAGSNGSGDGAVAGADQQAGGGDGDQQQQQHALVMRRPRGRPAGSKNKPKPPVIITRDSASALRAHVLEVAAGCDVVDSIAGFARRRQVGVCVLSASGSVANVCIRHSGAAPGAVVTMAGCFDILSLSGSFLPPPAPPAATGLTVYLSGGQGQVVGGTVAGPLLASGPVVIVAACFGNAAYERLPLDDDEPPQQQLLQQALPPPQGMAGASSSSPPPPLSLPGQHPLADQLPHSLMNGLPLPADAYAWANPGGSGAGRVAPY

SEQ ID NO: 19694 - DNA, 1125 bp, Sorghum bicolor
  misc_feature: Ceres ANNOT ID no. 8734857
  misc_feature: Encodes the peptide sequence at SEQ ID NO 19695
atggctcattccaatggcgcggccgccactgccactgccgccggcgacggcgagaccaccccggtgccacgtcccctcgcaccggcgcagaaggtggcgctgatcacgggcatcacgggccaggacggtagctacctgacggagctgctcctgtccaaggggtacgaggtgcacggcctcatccgccgctcctccaacttcaacacgcagcggctggaccacatctaccacgacccgcacgcggtgccgtcgtcgccgcgtcccctgatgcagctccactacgccgacctcaccgactcctcctccctccgccgcgtgctcgacgccgtctcccccgacgaggtctacaacctcgccgcgcagtcgcacgtcgccgtctccttcgaggtccccgactacaccgccgacgtcaccgccacgggggcgctcagcctcctcgaggccgtccgcctctcgcgcaagcccatccgctactaccaggcgggctcctcggagatgttcggctccacgccgccgccgcagagcgaggacacgccgttccacccgcgctcaccctacgccgcctccaaggtcgccgcgcactggtacaccgtcaactaccgcgaggcctacggcatcttcgcctgcaacggcgtgctcttcaaccacgagtccccgcgccgcggcgagaacttcgtcacgcgcaagatcacgcgcgccgtcggccgcatcaagcttggcctgcagaccaaggtgttcctcggcaacctctcggcggccagggactgggggttcgccggagactacgtcgaggcaatgtggctcatgctgcagcaggatcagccggccgattacgtcgtcgccactgaggagtcccacaccgtcgaggagttcttgcaggctgccttcggctacgccgggctcaactggaaggatcatgtggtcattgacaagaagtacttccggcctgcagaggtcgacagcctcaagggagactccaccaaggccaggaaggtgctcaaatggaagcccaaggttgggttccagcagctcgtggagatgatggttgatcacgacattgagctcgccaagaaggagaaggtcctggtggatgctgggtaccgtgatcccaagcagcagccatag

SEQ ID NO: 19695 - protein, 374 aa, Sorghum bicolor
  misc_feature: Useful for making plants with altered carbohydrate content
  misc_feature: Functional homolog of the protein sequence given in SEQ ID NO 13802
  misc_feature: Useful for making plants with altered cell wall content and/or composition
  misc_feature: Functional homolog of the protein sequence given in SEQ ID NO 13803
  misc_feature: Ceres ANNOT ID no. 8734857
  misc_feature (30)..(374): SWISSPROT Homolog: EC 4.2.1.47 GDP-mannose 4,6-dehydratase
  misc_feature (33)..(281): Pfam ID: Epimerase Pfam Description: NAD dependent epimerase/dehydratase family
MAHSNGAAATATAAGDGETTPVPRPLAPAQKVALITGITGQDGSYLTELLLSKGYEVHGLIRRSSNFNTQRLDHIYHDPHAVPSSPRPLMQLHYADLTDSSSLRRVLDAVSPDEVYNLAAQSHVAVSFEVPDYTADVTATGALSLLEAVRLSRKPIRYYQAGSSEMFGSTPPPQSEDTPFHPRSPYAASKVAAHWYTVNYREAYGIFACNGVLFNHESPRRGENFVTRKITRAVGRIKLGLQTKVFLGNLSAARDWGFAGDYVEAMWLMLQQDQPADYVVATEESHTVEEFLQAAFGYAGLNWKDHVVIDKKYFRPAEVDSLKGDSTKARKVLKWKPKVGFQQLVEMMVDHDIELAKKEKVLVDAGYRDPKQQP

SEQ ID NO: 19696 - DNA, 957 bp, Sorghum bicolor
  misc_feature: Ceres ANNOT ID no. 8734893
  misc_feature: Encodes the peptide sequence at SEQ ID NO 19697
atgatgccccggaccagcctcgacctcggcctcagcctgggcctcagcctcacctcccagggcagcctctcatcctccaccaccaccgccggatcctcctcgccctgggccgccgcgctcagctccgtcgtcgccgacgtcgccaaggcacgcgacgccggcgcgcacatgctgtaccacgcctccgcctccgccgcggcgctggaccgtgccgcgatgcgggcctccacgtcgcccgacagcgccgccgcgctctccagcggcggcagtggggacaacaccaccggcaccaagagggagagggagacggagctcgagcgcaccggctccggtggcgtccgtagtgatgaggaggacggcgtggacggcgccggcggacgcaagaagctcaggctctccaaggaccaggccgccgtcctcgaggagtgcttcaagacgcacagcacgctcaaccccaagcagaagctggcgctggctacccgcctgggcctccggccgcggcaggtggaggtgtggttccagaaccgccgcgcccggaccaagctcaagcagacggaggtggactgcgagtacctcaagcgctggtgcgagcgcctcgccgacgagaacaagcgcctcgagaaggagctcgccgacctcagggcgctcaaggccgcgccctcgcccgccgccgcgcagcccgcctcgcccgccgccaccctcacaatgtgcccgtcctgccgccgcgtcgccgccaccgccaccgctgccgcgtcgcccactaaacaccaccaccaccagcagcagcaatgccaccccaagcctagctctagcctcacccccgccgccgccgcagccgcaggtggcgccggcagtgtcgtgcctagccactgccagttcttcccggccgccgttgaccggacgagccagagcacatggagcaccgccgcgccgctcgtcaccagagagctcttctga

SEQ ID NO: 19697 - protein, 318 aa, Sorghum bicolor
  misc_feature: The sequence is a functional homolog of SEQ ID NO 2328 in the 10/374,780 US patent application
  misc_feature: The sequence is a functional homolog of SEQ ID NO 524 in the 10/225,066 US patent application
  misc_feature: The sequence is a functional homolog of SEQ ID NO 553 in the 11/479,226 US patent application
  misc_feature: The sequence is a functional homolog of SEQ ID NO 254 in the 10/412,699 US patent application
  misc_feature: The sequence is a functional homolog of SEQ ID NO 550 in the 11/479,226 US patent application
  misc_feature: Ceres ANNOT ID no. 8734893
  misc_feature (128)..(182): Pfam ID: Homeobox Pfam Description: Homeobox domain
  misc_feature (183)..(227): Pfam ID: HALZ Pfam Description: Homeobox associated leucine zipper
MMPRTSLDLGLSLGLSLTSQGSLSSSTTTAGSSSPWAAALSSVVADVAKARDAGAHMLYHASASAAALDRAAMRASTSPDSAAALSSGGSGDNTTGTKRERETELERTGSGGVRSDEEDGVDGAGGRKKLRLSKDQAAVLEECFKTHSTLNPKQKLALATRLGLRPRQVEVWFQNRRARTKLKQTEVDCEYLKRWCERLADENKRLEKELADLRALKAAPSPAAAQPASPAATLTMCPSCRRVAATATAAASPTKHHHHQQQQCHPKPSSSLTPAAAAAAGGAGSVVPSHCQFFPAAVDRTSQSTWSTAAPLVTRELF

SEQ ID NO: 19698 - DNA, 1500 bp, Sorghum bicolor
  misc_feature: Ceres ANNOT ID no. 8734902
  misc_feature: Encodes the peptide sequence at SEQ ID NO 19699
atgaagtcgaaccggaacctgtcaagggcggaggggaggaggctggggaatgtggcactcatcgccttcatgctcggatccctcctgctgctctccctcatcagggccaagttctccccgattggtaaaacaggggacgccatcaaagcagaggagcagcaggcaatggcgaaagacagcgtcgagatggcgaacgcgcatgacgctgcagctgcagccgaggaggaaggcgaggagactcggtccaaccccaccgactccaactctggcagcggcagcggcggcggcggcgtgagcggcacggccattgtggtcggcgacgaccacaccgagagggcgagcaaaagcaagccggtgtgctacgagtcgagccggcggtcggacacctgcgaggcggccggcgacgtgcgcgtggtggggcgtgcccagacggtgctggtgagccctctggagcgggagtggaaggtgaagccttactgccggaagcacgacgcgttcgcgctgtcccacgtcaaggagtggacgctccgtccggtgggaagcgacgacgcgccgcggtgcacggtgaacagctcggcgacggcgttcgtgctgtcgacgggcgggttcacgggcaacctgttccacgactacacggacgtgctgatcccggcgttcatcacggcgcggcggtacgccggcgacgtgcagctgctggtgagcagctacaagccgtggtggaccaccaagtacctgcaggtgctgcagcagctgagccggcacgaggtggtggacgcggacgcggacgccgaggtccgctgctacccgcgcgtcgtggtaggcccgacgttccaccgcgagctaggcgtggacgcgtcctcctcgtcgccgtccatgccggagttccgcgcgatgctgcgggacgcgttcgggctagagcgcgcggcggcggcgccgagcggggaccggtgggacatccgccggcgcccgcgcctcctcatcatctcgcggaggacctcgcggcggctgctgaacgagcgcgccatggcggacatggcgacgagcctggggttcgacgtgcggacgggggacccggaggtgagcacggacgtggggcggttcgcgcggctggtgaactcggcggacgtgatggtgggcgtgcacggcgacgggctcaccaacatggtgttcctccccgccggcgccgtgctggtgcaggtggtgccgtacggcgggctggagtggctggcgcgcggcacgttccgggagcccgcggaagggatggaggtgcactacctcgagtacgtggtgcagaaggacgagacgacgctgagcgaggagtacggcgaggacgatccggtgatcagagaccccgccgccatccataagcaggggtgggacgcgctcaaggccgtgtacctcgacaagcagaacgtccggccgcacctcggcaggctcaagaacaccttcgtgcaggcgctcaagctgctgccccatggacggcaggtcgccgacgactga

SEQ ID NO: 19699 - protein, 499 aa, Sorghum bicolor
  misc_feature: Useful for making plants with altered carbohydrate content
  misc_feature: Functional homolog of the protein sequence given in SEQ ID NO 14477
  misc_feature: Ceres ANNOT ID no. 8734902
MKSNRNLSRAEGRRLGNVALIAFMLGSLLLLSLIRAKFSPIGKTGDAIKAEEQQAMAKDSVEMANAHDAAAAAEEEGEETRSNPTDSNSGSGSGGGGVSGTAIVVGDDHTERASKSKPVCYESSRRSDTCEAAGDVRVVGRAQTVLVSPLEREWKVKPYCRKHDAFALSHVKEWTLRPVGSDDAPRCTVNSSATAFVLSTGGFTGNLFHDYTDVLIPAFITARRYAGDVQLLVSSYKPWWTTKYLQVLQQLSRHEVVDADADAEVRCYPRVVVGPTFHRELGVDASSSSPSMPEFRAMLRDAFGLERAAAAPSGDRWDIRRRPRLLIISRRTSRRLLNERAMADMATSLGFDVRTGDPEVSTDVGRFARLVNSADVMVGVHGDGLTNMVFLPAGAVLVQVVPYGGLEWLARGTFREPAEGMEVHYLEYVVQKDETTLSEEYGEDDPVIRDPAAIHKQGWDALKAVYLDKQNVRPHLGRLKNTFVQALKLLPHGRQVADD

SEQ ID NO: 19700 - DNA, 453 bp, Sorghum bicolor
  misc_feature: Ceres ANNOT ID no. 8734901
  misc_feature: Encodes the peptide sequence at SEQ ID NO 19701
atgaacatccagaggaagcctggagattggaactgcaagaactgccagcacctcaacttcagccgccgtgattactgtcagcgttgccgtgacccacgccctgacttgcagttcagtgacagctatagcacgggtggtgtgctgacctccctggacatccgtccaggtgactggtactgcagctgcggctaccacaactttgccagccgcagcagctgcttcaagtgcggcaccatcgtcagggacttcccagcaggacaaggtgcagccggtgctgaggttgacttcgctcgtggacgcgacagcgccgcagttcgtgctgggtggaaagctggcgactggatctgcacaaggatggagtgctataggtgcaatggaccaagggaggcaggtatatgtcttcgtcagtatacaactaggatttcaaattttgtgtcatttttatatgtgtaa

SEQ ID NO: 19701 - protein, 150 aa, Sorghum bicolor
  misc_feature: Useful for biocontainment applications
  misc_feature: Useful for making plants with modulated biomass
  misc_feature: Functional homolog of the protein sequence given in SEQ ID NO 14521
  misc_feature: Ceres ANNOT ID no. 8734901
  misc_feature (54)..(82): Pfam ID: zf-RanBP Pfam Description: Zn-finger in Ran binding protein and others
MNIQRKPGDWNCKNCQHLNFSRRDYCQRCRDPRPDLQFSDSYSTGGVLTSLDIRPGDWYCSCGYHNFASRSSCFKCGTIVRDFPAGQGAAGAEVDFARGRDSAAVRAGWKAGDWICTRMECYRCNGPREAGICLRQYTTRISNFVSFLYV

SEQ ID NO: 19702 - DNA, 1326 bp, Sorghum bicolor
  misc_feature: Ceres ANNOT ID no. 8734952
  misc_feature: Encodes the peptide sequence at SEQ ID NO 19703
atggcggccgtaatactaaggagccgccgccgccaccacctgtccgttctcttctgcgccgtcgtcctcgccgccgcggcgcaggcatccagtagtaataataacaacgtcacctccgacgaggtttactgggcggagcgcgccgaggcggcccggtcccgcaaccgcgccgcctacgtgagcgaccccgtggcggccatgaaccgcttcaacgccgacgtgctgagggcgacgacgcggcgcgccctggcgaggtacagcgggccgtgcatggcgaccaaccccatcgaccggtgctggcgctgccgctccgactgggcggcggaccggaagcgccttgcgcggtgcgcgcgcgggttcgggcacaggaccaccggcggcgcggccggcaagctgtacgtggtgaccgacccgagcgacgacgagatgatcgtcccgcggaagggcacgctccggcacgccgtgatccaggaccggccgctgtggatcgtgttcgcgcgcgacatggtgatccggctgcggcaggagctgatcgtgaccagcgacaagaccatcgacgggcgcggcgcgcaggtgcacgtcgtgggcgcgcaggtgacgctgcagagcgtgcacgacgtgatcctccacaacctccacatccacgacgccgtggcgcactccggcggcatgatccgggactcgaagcggcacacggggatgcgcacgcggagcgacggcgacggcatctccgtgctgtcgtccagcaacgtgtggatcgaccacgtctccatgtcgaggtgcgccgacgggctcatcgacgtggtgaacgggtcgacggcgatcacggtgtccaacagccacttcacgcaccacgaccacgtgatgctgttcggcgccagcaacgacaacccgcaggacgaggtgatgcagatcacggtggcgttcaaccacttcggcagagggctggtgcagcggatgccgcggtgccggtacgggttcttccacgtggtgaacaacgactacacgcactggatcatgtacgccatcggcgggaacaagaaccccaccatcatcagccaggggaaccggttcatcgcccccgacgatcccaacgccaaggaggtgaccaagagggagtacacggcgtacaaggactacaaggagtgggtgtggaagtcgcagggagacgtcatgatgaacggcgccttcttcaacgagtccggcgggcagaacgagcgcaagtacgacgagctcgacttcatcccggccaagcacggccgctacgtcggccagctcacgcgcttcgccggaccactcaagtgcatcgtcggccagccgtgctag

SEQ ID NO: 19703 - protein, 441 aa, Sorghum bicolor
  misc_feature: Useful for making plants with altered cell wall content and/or composition
  misc_feature: Functional homolog of the protein sequence given in SEQ ID NO 13952
  misc_feature: Useful for making plants with modulated phosphate use efficiency
  misc_feature: Functional homolog of the protein sequence given in SEQ ID NO 13129
  misc_feature: Useful for making plants with altered carbohydrate content
  misc_feature: Functional homolog of the protein sequence given in SEQ ID NO 13668
  misc_feature: Ceres ANNOT ID no. 8734952
  misc_feature (40)..(441): SWISSPROT Homolog: EC 4.2.2.2 Pectate lyase
  misc_feature (174)..(358): Pfam ID: Pec_lyase_C Pfam Description: Pectate lyase
  misc_feature (36)..(83): Pfam ID: Pec_lyase_N Pfam Description: Pectate lyase, N terminus
MAAVILRSRRRHHLSVLFCAVVLAAAAQASSSNNNNVTSDEVYWAERAEAARSRNRAAYVSDPVAAMNRFNADVLRATTRRALARYSGPCMATNPIDRCWRCRSDWAADRKRLARCARGFGHRTTGGAAGKLYVVTDPSDDEMIVPRKGTLRHAVIQDRPLWIVFARDMVIRLRQELIVTSDKTIDGRGAQVHVVGAQVTLQSVHDVILHNLHIHDAVAHSGGMIRDSKRHTGMRTRSDGDGISVLSSSNVWIDHVSMSRCADGLIDVVNGSTAITVSNSHFTHHDHVMLFGASNDNPQDEVMQITVAFNHFGRGLVQRMPRCRYGFFHVVNNDYTHWIMYAIGGNKNPTIISQGNRFIAPDDPNAKEVTKREYTAYKDYKEWVWKSQGDVMMNGAFFNESGGQNERKYDELDFIPAKHGRYVGQLTRFAGPLKCIVGQPC

SEQ ID NO: 19704 - DNA, 1398 bp, Sorghum bicolor
  misc_feature: Ceres ANNOT ID no. 8734951
  misc_feature: Encodes the peptide sequence at SEQ ID NO 19705
atggcggtcaccgccgtcgtgacgaggagacccctgtccatcctcttctacatcatcctcgccgccgtggctgccaccaccgccgccgccgcggagacgccgacggacgccgccatcgacgcggcgtacgcgcagctcgtcaacgtcaccgccaaccaggagtactgggcggagcgcgccgaggtggcgcacgcgtacaaccgcgcggcgtacgagagcgaccccgtgggcgtgatggatcgcttcaacgacggcgtgcgcagggccatggagacgtcgacgccgacgcggtcccggtcccggtccctggcgcacaaggcacggggtggcccctgcacggcgaccaacccgatcgaccagtgctggcgttgccgcggcgactgggcgcgcaaccgcaagcggctcgccaggtgcggcatgggcttcggccaccggaccaccggcgggctcgccggcaggatctacgtggtgaccgaccccagcgacgagcccgccaacctcgtcgtccccaggaaaggcacgctccggtacgccgtgatccaggaccgcccgctgtggatcacgttcgcgcgcgacatggtgatcaacctctgcagggagctgctggtgaccagcgacaagaccatcgacgggcgcggcgcgcaggtgcacgtcgtgggcgcgcagatcacgctgcagaacgtgcggaacgtgatcctccacaacctccacatccacgacgccgccccgcgcggcggcggcgtgatcagggactcgaagcaccactggggcctccgcggggagagcgacggcgacggggtctccgtgatggggtccagcgacatctggatcgaccacgtgtcgatgcggagctgcgccgacgggctggtggacgtggtggacggctccaccgccgtgaccatctccaacggccacttcaccaggcacgaccacgtgatgctgttcggtgccagcgacgccgccgtcaaggacaaggcgatgcaggtcaccgtggcgttcaaccacttcggaaaggggctggtgcagcggatgccgcgctgccgccatggcttcttccacgtggtgaacaacgactacacgcactggctcatgtacgccatcggcggcagccagaaccctaccatcatcagccaggggaaccggttccgcgccgtcgacgacgggaggttcaaggaggtgaccaagagggagtacacgccgtacagcgagtacaaggactgggtgtggaagtcgcaggacgacctgttcctcaatggggccttcttcaaccagtccggcggcgagaacgagcgccggttcgacaggctcgacctcatccaggccaagggcggacagtacgccgagttgctcacgaggtacgccggcgcgctcaactgccgcgtcggcaagaagtgctag

SEQ ID NO: 19705 - protein, 465 aa, Sorghum bicolor
  misc_feature: Useful for making plants with altered cell wall content and/or composition
  misc_feature: Functional homolog of the protein sequence given in SEQ ID NO 14733
  misc_feature: Useful for making plants with modulated phosphate use efficiency
  misc_feature: Functional homolog of the protein sequence given in SEQ ID NO 13129
  misc_feature: Useful for making plants with altered carbohydrate content
  misc_feature: Functional homolog of the protein sequence given in SEQ ID NO 13668
  misc_feature: Ceres ANNOT ID no. 8734951
  misc_feature (48)..(465): SWISSPROT Homolog: EC 4.2.2.2 Pectate lyase
  misc_feature (198)..(382): Pfam ID: Pec_lyase_C Pfam Description: Pectate lyase
  misc_feature (48)..(103): Pfam ID: Pec_lyase_N Pfam Description: Pectate lyase, N terminus
MAVTAVVTRRPLSILFYIILAAVAATTAAAAETPTDAAIDAAYAQLVNVTANQEYWAERAEVAHAYNRAAYESDPVGVMDRFNDGVRRAMETSTPTRSRSRSLAHKARGGPCTATNPIDQCWRCRGDWARNRKRLARCGMGFGHRTTGGLAGRIYVVTDPSDEPANLVVPRKGTLRYAVIQDRPLWITFARDMVINLCRELLVTSDKTIDGRGAQVHVVGAQITLQNVRNVILHNLHIHDAAPRGGGVIRDSKHHWGLRGESDGDGVSVMGSSDIWIDHVSMRSCADGLVDVVDGSTAVTISNGHFTRHDHVMLFGASDAAVKDKAMQVTVAFNHFGKGLVQRMPRCRHGFFHVVNNDYTHWLMYAIGGSQNPTIISQGNRFRAVDDGRFKEVTKREYTPYSEYKDWVWKSQDDLFLNGAFFNQSGGENERRFDRLDLIQAKGGQYAELLTRYAGALNCRVGKKC

SEQ ID NO: 19706 - DNA, 315 bp, Sorghum bicolor
  misc_feature: Ceres ANNOT ID no. 8734961
  misc_feature: Encodes the peptide sequence at SEQ ID NO 19707
atggagcgtcgcgtcgtcgtgaccgtgaacccggtcctcgtggtccttgtgctccttgtgctgtcctgcctcctcgtctaccccccctccccacctccaccccaccacccgtactcctcctttcccatgccaagaagcctgcgcctggggagccacctgacggatttgaagctcacttcctctcactctcaggagacgacgattggggcggcgatgaacctgggtaggccggaggcgaggatggacttggaggtgaacgactacccaccgcccgaccatgaccatgaccatgacccaggtcacggaagagtttga

SEQ ID NO: 19707 - protein, 104 aa, Sorghum bicolor
  misc_feature: Useful for making plants with modulated flowering time
  misc_feature: Functional homolog of the protein sequence given in SEQ ID NO 14463
  misc_feature: Ceres ANNOT ID no. 8734961
MERRVVVTVNPVLVVLVLLVLSCLLVYPPSPPPPHHPYSSFPMPRSLRLGSHLTDLKLTSSHSQETTIGAAMNLGRPEARMDLEVNDYPPPDHDHDHDPGHGRV

SEQ ID NO: 19708 - DNA, 1467 bp, Sorghum bicolor
  misc_feature: Ceres ANNOT ID no. 8734964
  misc_feature: Encodes the peptide sequence at SEQ ID NO 19709
atggaaacctacagcctgcaggtgaaggatgagctccacggcggcggcatcggcatcggaggaggagggcaggggctgtactgcggcgctacgccgaggccggcggctcctgcggccaccggcggcggcggcggcggcggggacggtgctgtgaagagtaataagaggagtaggaagagggagccgccgccgccgccgccgtcgtccctggtgacgatgagcaacggcggcaaggacgaggcggtcgccggcagcggcgacaagtcggcgagtagcaacagtaacgcgtccaagaggagctcaaggttcagaggcgtaagcaggcatcggtggacgggcaggttcgaggcgcacctgtgggacaaagggacatggaacccaacgcagaagaagaaagggaagcaagtttaccttggagcgtacaacgaggaagacgcggcagcaagagcgtatgatctggcagcgctcaagtactggggacctaccacctacaccaactttccggtcgtggactacgagagagagctcaaagtgatgcagaatgtgtccaaggaagagtaccttgcctccatacgaaggaagagcaacggcttctcccgcggagtttccaagtacaggggcgtcgcacggcaccaccacaacggcagatgggaggcacggatcggccgggtgttcggcaacaagtacctgtacctgggcacgtacagcacgcaggaggaggcggcgcgcgcctacgacatcgccgccatcgagtaccgcggcatcaacgccgtcaccaacttcgacctcagcacctacatccgctggctcaagcccggcggcggcgtcgaggacagcgccgccggcaccccgacgtcgggcgtcagggcgccgggtataccgccggcgtcgctgtccctacaggctggcggcctcctgcagcacccgcacggcgccgcggccggcatgctgcaggtcgacgtcgacgacctctaccgcgggcagctggccgcggcgcgtggggctgctctgttctctggcggcatcgacgacgtgggctccgtgtacgcagctggcagcgcagggcccagcccgacggctctgtgcgccgggaggccgtctccatcgccgtcgccgtcgtcgtccaccacggcgctcagcctgctgctgcgctcgtcagtgtttcaggagctcgtggcgcggaacgccggcggcggcgccgcgcagcagcagcagctcgtggtcgcggacgacgacggggcagtatcgccggcggacgttgttgacgccaaagttgagcagccggaggcagagggcgagctgggtcgtcacggtgaccagctctacggcgcggcgagggcggacgaggacgaggacgcgttcgcctgctccatgtacgagcttgacgacagcttcgcgcgcatggagcagtcgctctggggctgcctacgatcatcggatgcacctgataatatgaacaacctctga

SEQ ID NO: 19709 - protein, 488 aa, Sorghum bicolor
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: The sequence is a functional homolog of SEQ ID NO 1314 in the 10/374,780 US patent application
  misc_feature: The sequence is a functional homolog of SEQ ID NO 1459 in the 10/412,699 US patent application
  misc_feature: The sequence is a functional homolog of SEQ ID NO 1900 in the 10/412,699 US patent application
  misc_feature: The sequence is a functional homolog of SEQ ID NO 358 in the 10/666,642 US patent application
  misc_feature: The sequence is a functional homolog of SEQ ID NO 676 in the 11/435,388 US patent application
  misc_feature: The sequence is a functional homolog of SEQ ID NO 1310 in the 10/374,780 US patent application
  misc_feature: The sequence is a functional homolog of SEQ ID NO 1312 in the 10/374,780 US patent application
  misc_feature: The sequence is a functional homolog of SEQ ID NO 1455 in the 10/412,699 US patent application
  misc_feature: The sequence is a functional homolog of SEQ ID NO 1457 in the 10/412,699 US patent application
  misc_feature: Useful for biocontainment applications
  misc_feature: Functional homolog of the protein sequence given in SEQ ID NO 13650
  misc_feature: Ceres ANNOT ID no. 8734964
  misc_feature (203)..(255): Pfam ID: AP2 Pfam Description: AP2 domain
  misc_feature (101)..(161): Pfam ID: AP2 Pfam Description: AP2 domain
METYSLQVKDELHGGGIGIGGGGQGLYCGATPRPAAPAATGGGGGGGDGAVKSNKRSRKREPPPPPPSSLVTMSNGGKDEAVAGSGDKSASSNSNASKRSSRFRGVSRHRWTGRFEAHLWDKGTWNPTQKKKGKQVYLGAYNEEDAAARAYDLAALKYWGPTTYTNFPVVDYERELKVMQNVSKEEYLASIRRKSNGFSRGVSKYRGVARHHHNGRWEARIGRVFGNKYLYLGTYSTQEEAARAYDIAAIEYRGINAVTNFDLSTYIRWLKPGGGVEDSAAGTPTSGVRAPGIPPASLSLQAGGLLQHPHGAAAGMLQVDVDDLYRGQLAAARGAALFSGGIDDVGSVYAAGSAGPSPTALCAGRPSPSPSPSSSTTALSLLLRSSVFQELVARNAGGGAAQQQQLVVADDDGAVSPADVVDAKVEQPEAEGELGRHGDQLYGAARADEDEDAFACSMYELDDSFARMEQSLWGCLRSSDAPDNMNNL

SEQ ID NO: 19710 - DNA, 1869 bp, Sorghum bicolor
  misc_feature: Ceres ANNOT ID no. 8734966
  misc_feature: Encodes the peptide sequence at SEQ ID NO 19711
atggttagaggggagaagcgttctggtagccatgaagagcagttaacaagcaagatcaaagatgatgatcatatcctggatggcaacttgtttaagtccttacacgaatcaagttcaagaaaagaggcaagctcctcaagcctaagggaaagatctgaaacggacgaagcatcaaatcaaacttcagctaatcataacaaggttgataaagataaacttgcatccacaagggcagagatgggtgaggtaagagaagagaacaagaggttaaaaactatgttgtcacgcattgtagaggactaccgatctcttcaattgcacttccatgacgttcttcaaaaaggacaagccaagaagcttgctgacccctcgaccatcatgcccaccggcatcgaggagcctgaattcgtctcactgagcctcggcacgaccacaagcatgcacaggaaggaagacaagaatagtgctgctgaaggaaaagggagagaagacttcatgagtattaaagaagaaggcctgtcacttggactgtcagcctgcaaagatggtgcaactaataacaatgtaaagatccagcccgaagtgatgaccttgagccctgaagttagttccgaggatgccaaggatgatgccatggaggcagcagatcagcagtggccgccaagcaaagcagagaagagcttgaggaacgttggcacggggcctgaggatgacataggtccactgccacaggccaagaaggcaagggtgtctgtaagagcaaggtgtgatgcaccaacgatgaatgatggatgccaatggagaaagtatgggcagaagatagccaaggggaacccatgcccccgtgcctactaccggtgtacagtgggagcaggatgccccgtcagaaaacaggtgcagaggtgcgcggacgacatgtcgatcctgatcaccacgtacgagggcacgcacaaccacccgctctccgcctccgccaccgccatggccaccaccacctccgccgcggcgtccatgctcacctcgggctcctctacctccctccgcttccccgccgcctcgccggccgccgccggcctcagcttcggcttccctccggcggcggcgcacgacccctccaaacatttcttcctcccgaacggcggcgccgcgtccatcacctccacgccgtcctacccgaccatcacgctcgacctcacctcgccggcggccacctcgcaggcattctctctgggcaacaggttctcgtcgagcttggttcacggcggcgctaggtaccatcatcccacgagcctctccttctccaactccgggcccagcgcgctgtccggcgctgcatggccggcggccggtggtgctgggtacctgagctacgggtcaccagcagcctcgttgttcaacggtggcgctgcactgagcagcatcaacggaaggcaacaaggcggggaattccccgtgctctaccagccgcagcagaaggcgtcggcggcggcgagcgggagcgcaccggagggcgtgctcaccgacacgatagcgaaggtgatcacgtcggacccgagcttccaaacggtgctggcagccgccatcacgtcgtacgtcggcacgcagggaggtaacagatcgtcggcgggaggagagggcgggagccagctgcaggggctcaagtggggacagcacctcggcctggggccgtcgccatcaagcccgggtgcggcgtgctcgtcggcgctgctggcacggtcatcgtcgacgacggcagcagcggtggtggagcagggttccaatgggcaccggtcgttcttgcaaccatcgctgggcttgtcaggttctcacagcacctccacctctcctgtggagaacagggagcactga

SEQ ID NO: 19711 - protein, 622 aa, Sorghum bicolor
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8734966
  misc_feature (261)..(321): Pfam ID: WRKY Pfam Description: WRKY DNA -binding domain
MVRGEKRSGSHEEQLTSKIKDDDHILDGNLFKSLHESSSRKEASSSSLRERSETDEASNQTSANHNKVDKDKLASTRAEMGEVREENKRLKTMLSRIVEDYRSLQLHFHDVLQKGQAKKLADPSTIMPTGIEEPEFVSLSLGTTTSMHRKEDKNSAAEGKGREDFMSIKEEGLSLGLSACKDGATNNNVKIQPEVMTLSPEVSSEDAKDDAMEAADQQWPPSKAEKSLRNVGTGPEDDIGPLPQAKKARVSVRARCDAPTMNDGCQWRKYGQKIAKGNPCPRAYYRCTVGAGCPVRKQVQRCADDMSILITTYEGTHNHPLSASATAMATTTSAAASMLTSGSSTSLRFPAASPAAAGLSFGFPPAAAHDPSKHFFLPNGGAASITSTPSYPTITLDLTSPAATSQAFSLGNRFSSSLVHGGARYHHPTSLSFSNSGPSALSGAAWPAAGGAGYLSYGSPAASLFNGGAALSSINGRQQGGEFPVLYQPQQKASAAASGSAPEGVLTDTIAKVITSDPSFQTVLAAAITSYVGTQGGNRSSAGGEGGSQLQGLKWGQHLGLGPSPSSPGAACSSALLARSSSTTAAAVVEQGSNGHRSFLQPSLGLSGSHSTSTSPVENREH

SEQ ID NO: 19712 - DNA, 1056 bp, Sorghum bicolor
  misc_feature: Ceres ANNOT ID no. 8735024
  misc_feature: Encodes the peptide sequence at SEQ ID NO 19713
atggaggaaggggcagggaggagagggatcccttcgctgctgaaatcaccggtggtggctgaaaccgaagccacttttctttctctgcagcaggagcacatcgcctctgatattacccagcttgtaggatggacgccactgatagaactgaagagaatcgctgagaaggacaatgtcaacgcccggattgttggcaagctggagtgctaccagcccctctgctctgtcaaagaccgcagcgctctgagaatgattgaagatgcagaggagaaagggctgatctcgcctggtatgacaacactggttgagccgacgagcggcaatatgggcataggtttggcgtacattgctttgactagaggttacaggttcgttgccgtcatgcctgccgagtactcacttgacaagcagatcttgctgaggtacctgggagctgatttggtgttaaccgatcctacgcttggctttcagggacaacttgacaaggtggaacagctcaagaaagaaatacccaatgtgcatgttcttgaccagtttgcaaacgcagcaaatcctgaagcacactttaaatggactggacctgagatttggaaggatacggcaggcaaagtagacatatttgtggccggttcaggcacaggaggtactgtttctggtgtcggcaaatacttgaagatgaagaacccagctgtgaaggtcatttgtgttgagcctgctgagagtccagttatttcaggaggcaagccttctagacataaaattcagggagtcggcccaggatttgtgcccaagaacttggacacctcagtcactgatgagatcattacagtaactgcagaagatgcaatggcaaacgctaggaggttggccagggaagagggcctgctagttggcatatcatctggagcaaatctggcagcttgcctgcaggtggcatcaagagaagagaataaagggaagatgattgtcactgtgtttcctagtggtggcgagagatacatgaactccgatctctttgcagctataagagaggaatgcatcgccatgaccttctga

SEQ ID NO: 19713 - protein, 351 aa, Sorghum bicolor
  misc_feature: Useful for making plants with modulated cold sensitivity
  misc_feature: Functional homolog of the protein sequence given in SEQ ID NO 13038
  misc_feature: Ceres ANNOT ID no. 8735024
  misc_feature (4)..(349): SWISSPROT Homolog: EC 2.5.1.47 Cysteine synthase
  misc_feature (38)..(328): Pfam ID: PALP Pfam Description: Pyridoxal-phosphate dependent enzyme
MEEGAGRRGIPSLLKSPVVAETEATFLSLQQEHIASDITQLVGWTPLIELKRIAEKDNVNARIVGKLECYQPLCSVKDRSALRMIEDAEEKGLISPGMTTLVEPTSGNMGIGLAYIALTRGYRFVAVMPAEYSLDKQILLRYLGADLVLTDPTLGFQGQLDKVEQLKKEIPNVHVLDQFANAANPEAHFKWTGPEIWKDTAGKVDIFVAGSGTGGTVSGVGKYLKMKNPAVKVICVEPAESPVISGGKPSRHKIQGVGPGFVPKNLDTSVTDEIITVTAEDAMANARRLAREEGLLVGISSGANLAACLQVASREENKGKMIVTVFPSGGERYMNSDLFAAIREECIAMTF

SEQ ID NO: 19714 - DNA, 348 bp, Sorghum bicolor
  misc_feature: Ceres ANNOT ID no. 8735027
  misc_feature: Encodes the peptide sequence at SEQ ID NO 19715
atggcgggagaggaagccgggaggatggggattccctctctgctctatccatcgtacgcttgcagcagcgaagaacagcaggagcacatcgtctctgatgtcacgcagctcattgggtggacacctctgatcgagctcaagggaatcgccagcaaggaaagggtagatgcccggatcatcggcaagatcgaggcgtaccagcctctctgctctgtcaaggatcgctgcgctttgaggtctgaccttttttttcctccttttttaccctactggttagggaattcagatggaactctgaccagttttagttatccattttctcgatcgtctgatttgatttttagctga

SEQ ID NO: 19715 - protein, 115 aa, Sorghum bicolor
  misc_feature: Useful for making plants with modulated cold sensitivity
  misc_feature: Functional homolog of the protein sequence given in SEQ ID NO 13038
  misc_feature: Ceres ANNOT ID no. 8735027
  misc_feature (8)..(75): SWISSPROT Homolog: EC 2.5.1.47 Cysteine synthase
MAGEEAGRMGIPSLLYPSYACSSEEQQEHIVSDVTQLIGWTPLIELKGIASKERVDARIIGKIEAYQPLCSVKDRCALRSDLFFPPFLPYWLGNSDGTLTSFSYPFSRSSDLIFS

SEQ ID NO: 19716 - DNA, 834 bp, Sorghum bicolor
  misc_feature: Ceres ANNOT ID no. 8735029
  misc_feature: Encodes the peptide sequence at SEQ ID NO 19717
atgctgggtcagggtttcagcagcacgcttaaagctggactaaagcctttggtccaaaaaaatgcaaaggggcaagatttcctttctccattaaaaatgattgaagatgcagaggagagagggttgatttcacctggtgtcaccacactcgtcgagccgacaggcggtaacatggggttgggattagtcctcattgctattcgcaagggttacatgtttgttgcagttatgtcaggtcaatactcgctcgataagcagatcctgttgcgatacatgggtgcagagttgtatttaacagatccaacccttgggttcccaggtatgaacgcgaaggttgagcagctcaaaaaagaattgcccaatgtacatgttcttgatcagttctcgaacaaagcaaatactgaagcacatagtagatggactggacctgagatttggaaggacactgctggcaaggtggacatatttgtagctggttcaggcacaggaggtaccgtatctggtgttgggaagtatctgaagatgcaaaaccccagtatcaagatcatctgtgttgagcctgcagagagtccattcagaaacaccaactatcatcaattagatggtgaaccaggcaaacacaaaatccagggaataggaccaggatttgtacctgaagtactggacagatcagaggcgatggtgaacgctaggactaggaggctggccagggaagagggccttcttgtgggcatatcttctggagcgaacttggcagcttgcttgaaggtagcagcgagagaagaaaataaggggaagatgattgtcaccatatttccaaccggaggcgagtga

SEQ ID NO: 19717 - protein, 277 aa, Sorghum bicolor
  misc_feature: Useful for making plants with modulated cold sensitivity
  misc_feature: Functional homolog of the protein sequence given in SEQ ID NO 13038
  misc_feature: Ceres ANNOT ID no. 8735029
  misc_feature (33)..(277): SWISSPROT Homolog: EC 2.5.1.47 Cysteine synthase
  misc_feature (8)..(274): Pfam ID: PALP Pfam Description: Pyridoxal-phosphate dependent enzyme
MLGQGFSSTLKAGLKPLVQKNAKGQDFLSPLKMIEDAEERGLISPGVTTLVEPTGGNMGLGLVLIAIRKGYMFVAVMSGQYSLDKQILLRYMGAELYLTDPTLGFPGMNAKVEQLKKELPNVHVLDQFSNKANTEAHSRWTGPEIWKDTAGKVDIFVAGSGTGGTVSGVGKYLKMQNPSIKIICVEPAESPFRNTNYHQLDGEPGKHKIQGIGPGFVPEVLDRSEAMVNARTRRLAREEGLLVGISSGANLAACLKVAAREENKGKMIVTIFPTGGE

SEQ ID NO: 19718 - DNA, 822 bp, Sorghum bicolor
  misc_feature: Ceres ANNOT ID no. 8735026
  misc_feature: Encodes the peptide sequence at SEQ ID NO 19719
atggcgggagaggaggccgggaggaggggggttccctctctcctcaacccgccgtccgcttccagcgaagggcagcaggaacacatcgcctctgatgtcactcagctcatcgggtggacacctctgatcgagctcaagcgaattgccgacaaggaaggggtagatgcccggatcgtcggcaaggtcgaggcgtaccagcctctctgctccgtcaaggatcgcagcgctttgagctggtttgggagttcagatggaactctgaccagttctagttatcctgttcctccattatctgattcggattttagccgaagaatagcaaactgggaagagggaacacaaagacctgagatttggaaggacactgctggcaaggtggacatatttgtagctggttcccgctccggaggtacggtgtctggttttgggaagtatctgaagacgcaggaccccagtatcaagatcatctgtgttgagcctgcagagagtccagttgtttcaggtggcgaaccaggcaaacacaaaatccagggaataggaccaggatttctacctgaagtactggacaccacagttattgatgaagctgtcacagtgaccactgatgaagcgatggtgcacgctaggaggttggccagggaagagggtcttcttgtgggcatatcttctggagcaaacttggcagcttgcttgaaggtcgcatcaagagaagaaaataaggggaagatgattgtcaccatgtttccaagtgggggcgagagatacatgaattctgacctttttgctgctgctagagaggagtgtattgccatgacattttga

SEQ ID NO: 19719 - protein, 273 aa, Sorghum bicolor
  misc_feature: Useful for making plants with modulated cold sensitivity
  misc_feature: Functional homolog of the protein sequence given in SEQ ID NO 13038
  misc_feature: Ceres ANNOT ID no. 8735026
  misc_feature (113)..(273): SWISSPROT Homolog: EC 2.5.1.47 Cysteine synthase
  misc_feature (33)..(250): Pfam ID: PALP Pfam Description: Pyridoxal-phosphate dependent enzyme
MAGEEAGRRGVPSLLNPPSASSEGQQEHIASDVTQLIGWTPLIELKRIADKEGVDARIVGKVEAYQPLCSVKDRSALSWFGSSDGTLTSSSYPVPPLSDSDFSRRIANWEEGTQRPEIWKDTAGKVDIFVAGSRSGGTVSGFGKYLKTQDPSIKIICVEPAESPVVSGGEPGKHKIQGIGPGFLPEVLDTTVIDEAVTVTTDEAMVHARRLAREEGLLVGISSGANLAACLKVASREENKGKMIVTMFPSGGERYMNSDLFAAAREECIAMTF

SEQ ID NO: 19720 - DNA, 708 bp, Sorghum bicolor
  misc_feature: Ceres ANNOT ID no. 8735057
  misc_feature: Encodes the peptide sequence at SEQ ID NO 19721
atggatggcgagcatgttggcaggaagggtattccttctctgctgaagccatcttcctcctccggccatggcggtgctggggatcaagagcacatcaaaggttacaggctcattgcagttatgccagctaaatatttgcttgacaagctgatcttgctgagattcatgggtgctgagttgtacttaaccgatccggcccttggctttgcgggcatgtttgacaaagttgaacagctccgagaacaactgccaaatgtacttgttctgaatcaagttactaagagagcaaattctgaagcccactttagactgaccggacctgagatctggaaggacacagcaggcaaggtggacatatttgtggccggttcaggcacaggtggcactgtttttggtgtcggaaagtatctgaagatacaaaagacaggcgtcaagatcatctgtggcgcgcctggcaagcataaaatccagggagtagggccaggatttatacctgaagtcctggacacctcggtcatcgacgagactgtcagagtgaccacagaggaggccaccctgttcgctggattgtttcttccgaggaggctggccaaggaagagctcttcaattccctgcctgaaggttcatacagtgatccttcgagtgcgtcttcaggtcgagaagagaacaaggatgtgcaagatgagtgtattgccatgacattttga

SEQ ID NO: 19721 - protein, 235 aa, Sorghum bicolor
  misc_feature: Useful for making plants with modulated cold sensitivity
  misc_feature: Functional homolog of the protein sequence given in SEQ ID NO 13038
  misc_feature: Ceres ANNOT ID no. 8735057
  misc_feature (2)..(224): SWISSPROT Homolog: EC 2.5.1.47 Cysteine synthase
  misc_feature (6)..(234): Pfam ID: PALP Pfam Description: Pyridoxal-phosphate dependent enzyme
MDGEHVGRKGIPSLLKPSSSSGHGGAGDQEHIKGYRLIAVMPAKYLLDKLILLRFMGAELYLTDPALGFAGMFDKVEQLREQLPNVLVLNQVTKRANSEAHFRLTGPEIWKDTAGKVDIFVAGSGTGGTVFGVGKYLKIQKTGVKIICGAPGKHKIQGVGPGFIPEVLDTSVIDETVRVTTEEATLFAGLFLPRRLAKEELFNSLPEGSYSDPSSASSGREENKDVQDECIAMTF

SEQ ID NO: 19722 - DNA, 2103 bp, Sorghum bicolor
  misc_feature: Ceres ANNOT ID no. 8735076
  misc_feature: Encodes the peptide sequence at SEQ ID NO 19723
atggctgaggacgccgcggcgggctccccgctcctggacctgccggagccgctgctgctccacatcctgggcttcctcaccgacgcgcggtcgcggcaccgcgtcgcgctggcgtgccacaggctcctcgcggcggagcgggccacgcgcgccgcgctctcgctgcgcggggacccgcggtcggacgtgttcctctacctcatcaggccgacgttctgcttcccggcgctggagcggctcgacctctcgctggtgtcgccgtggggccacccgttcctctcctccgcggcgccgtctgccgacgccgtcgcgccggccgtggcggcggaggaggtcgcggggcagaacgccctcatcgcggcgcgcctcgcctactgcttccccgccgtgtcctcgctcgccgtctactgccgcgaccccaccacgctcgccagcctcaccccgcactggaggtcccgcctccgcagtgtcaagctcgtgcgctggcaccagcgcccgcccggcctcgacgccggcgcggatctcgagcccctcctcggggactgccccgcgctcagggcgctcgacctctccgagttctactgctggacggaggacatccagcctgcgcttgcggcgcacccggcagccgccgcggcgctcaccgagctcgacctcggcctcgcgggcgccacggacgggttctacgccgccgagctgggggccatcgcgagattctgccccaatcttcgcaagctcgtggcgccctgtgtgttcaaccctcggtacgttgacttcgtcagcgacgacgcgcttctcaccatcgccaccagctgccccaagctgtcgatcctgcggctccgagaaccttttgagctggcggccaccagccaacgggaggacgcggcaatcaccgtcgcagggctggtctccttcttcgctgcactgccggagctagaggatttcacgcttgacctgcggcataatgtgctggagacagcgccggccatggaggcgcttgcccgcaggtgcccacggatcaagttcttgacgctggggggcttccaggggttgtgcaaggcatcttggctgcacctcgacggcgttgctgtgtgtggttcgctggagtcgctatgcatcaagggttgtttggatctcactgacgccagccttgctgccataggtcgtgggtgcgggaggcttgctaagttcgccatccatggctgtgatcttgtcacatcagttgggatcaggaggctagcaacggcgcttcggcccacaatcaaagaagtcagtatcttgcactgccggcttctggacacagcaacatgcctcactgctttaagtccgatccgtgatcgcattgagagtcttgaggtcagctgtgtctggaaggaagttgaacagcctgagagcgtggccaatggcacaaccggatgtgatcatgaagatgatgatctcggtgaagtgacatatgagtctgcatcgaagaaatgtaggtacatggaattggatgatctagtcagctgggagatgctacgttcactctccctctggttccctgctggtgaggtactctccccactcatctctgctgggcttgatagctgccctgttctagaggagatctcaattaaagtggagggtgattgccgtgcacgccctggcccattttttggcctgaggtatcttgcaggcttcccagtacttgctaagatgaaattggatctgagtgaggcggttgggtatgctcttactgcaccagcaggccagatggatctctctctgtgggagcgattttatttgcatggtatagattcactaatgactctgtatgagctggattattggcctccccaagacaaggaagtgaaccagcgtagcctgacactgcccgctgtgggactgctccagggctgcgttgggctcaggaagctcttcgtccatggcaccacacatgagcatttcctgaccttcttcttgaaggtgccaaatttgagggacatgcagctaagggaggactactatcccgcaccagagagtgatatgatgaacacggaaatgcgagctgagtcttggctccggttcgagaatcagctgaacatcaggctaattgaggattaa

SEQ ID NO: 19723 - protein, 700 aa, Sorghum bicolor
  misc_feature: Useful for making plants with modulated biomass
  misc_feature: Useful for making plants with modulated light quality response
  misc_feature: Functional homolog of the protein sequence given in SEQ ID NO 14734
  misc_feature: Ceres ANNOT ID no. 8735076
MAEDAAAGSPLLDLPEPLLLHILGFLTDARSRHRVALACHRLLAAERATRAALSLRGDPRSDVFLYLIRPTFCFPALERLDLSLVSPWGHPFLSSAAPSADAVAPAVAAEEVAGQNALIAARLAYCFPAVSSLAVYCRDPTTLASLTPHWRSRLRSVKLVRWHQRPPGLDAGADLEPLLGDCPALRALDLSEFYCWTEDIQPALAAHPAAAAALTELDLGLAGATDGFYAAELGAIARFCPNLRKLVAPCVFNPRYVDFVSDDALLTIATSCPKLSILRLREPFELAATSQREDAAITVAGLVSFFAALPELEDFTLDLRHNVLETAPAMEALARRCPRIKFLTLGGFQGLCKASWLHLDGVAVCGSLESLCIKGCLDLTDASLAAIGRGCGRLAKFAIHGCDLVTSVGIRRLATALRPTIKEVSILHCRLLDTATCLTALSPIRDRIESLEVSCVWKEVEQPESVANGTTGCDHEDDDLGEVTYESASKKCRYMELDDLVSWEMLRSLSLWFPAGEVLSPLISAGLDSCPVLEEISIKVEGDCRARPGPFFGLRYLAGFPVLAKMKLDLSEAVGYALTAPAGQMDLSLWERFYLHGIDSLMTLYELDYWPPQDKEVNQRSLTLPAVGLLQGCVGLRKLFVHGTTHEHFLTFFLKVPNLRDMQLREDYYPAPESDMMNTEMRAESWLRFENQLNIRLIED

SEQ ID NO: 19724 - DNA, 1209 bp, Sorghum bicolor
  misc_feature: Ceres ANNOT ID no. 8735080
  misc_feature: Encodes the peptide sequence at SEQ ID NO 19725
atggacggcggggggcagcccccggacacggagatgacggacgccggcgcgggcggcggggggcagcagccgccgccggcgcagcagcagccgcagcaggcggcaggcgggggcgggatgatggagaacatccaggcgacgctcagccacggcggccgcttcatccagtacaacatcttcggcaacgtgttcgaggtcaccgccaagtacaagccccccatcctccccatcggcaagggcgcctacggcatcgtctgctcggcgctcaactccgagacggcggagcaggtggccatcaagaagatcgccaacgccttcgacaacaagatcgatgccaagcgcaccctccgcgagatcaagctgctccgccacatggaccacgagaatattgttgcaataagggatatcatacctcctccgcagagggaggcattcaatgatgtgtatattgcttatgaattgatggatactgatctgcatcaaattattcgttcaaatcaagctttgtcagaggagcactgtcagtattttctttatcaaattcttcgtggcttgaagtatatacattcagcaaatgttcttcaccgtgacttgaagcctagcaatcttcttttgaatgcaaactgtgacctcaagatatgtgattttgggcttgctcgaaccacctcagaaactgattttatgactgaatatgttgtcacaagatggtacagagcaccagagcttttgttgaactcctctgaatatactgctgccattgatgtgtggtctgtgggttgtatatttatggaactgatggaccgaaaacccctgtttcctggaagagaccatgtccatcagctacgtctactaatggagctcattgggacaccgaatgaggctgatcttgattttgtaaatgagaatgcaagaagatatatccgccaacttccccggcatgctagacagtcctttcctgaaaaatttccacatgttcaacctttagcaattgacctggtggaaaagatgctgacttttgatcctagacagagaataactgttgaaggcgcacttgcacacccttacttggcatcacttcatgacataagtgatgagccagtctgctcaatgcccttcagctttgactttgagcagcatgcattgtctgaagaacaaatgaaggatctgatctaccaagaggctcttgcattcaaccctgattaccagtag

SEQ ID NO: 19725 - protein, 402 aa, Sorghum bicolor
  misc_feature: Useful for making plants with altered cell wall content and/or composition
  misc_feature: Functional homolog of the protein sequence given in SEQ ID NO 14430
  misc_feature: Ceres ANNOT ID no. 8735080
  misc_feature: Up-regulated in shoot tissues in response to salicylic acid treatment
  misc_feature (1)..(402): SWISSPROT Homolog: EC 2.7.11.24 Mitogen-activated protein kinase
  misc_feature (76)..(356): Pfam ID: Pkinase Pfam Description: Protein kinase domain
MDGGGQPPDTEMTDAGAGGGGQQPPPAQQQPQQAAGGGGMMENIQATLSHGGRFIQYNIFGNVFEVTAKYKPPILPIGKGAYGIVCSALNSETAEQVAIKKIANAFDNKIDAKRTLREIKLLRHMDHENIVAIRDIIPPPQREAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMELIGTPNEADLDFVNENARRYIRQLPRHARQSFPEKFPHVQPLAIDLVEKMLTFDPRQRITVEGALAHPYLASLHDISDEPVCSMPFSFDFEQHALSEEQMKDLIYQEALAFNPDYQ

SEQ ID NO: 19726 - DNA, 540 bp, Sorghum bicolor
  misc_feature: Ceres ANNOT ID no. 8735116
  misc_feature: Up-regulated in shoot tissues in response to salicylic acid treatment
  misc_feature: Encodes the peptide sequence at SEQ ID NO 19727
atggccggcagcggcagggaaagggagacgctggtggttggtagggtggtgggcgacgtgctggaccccttcgtccggaccaccaacctcagggtcagctacggcaccaggaccgtatccaacggctgcgagctcaagccgtccatggtggtgaaccagcccagggtcgaggtcgggggacccgacatgaggaccttctacaccctcgtgatggtcgacccggatgctccgagcccaagcgacccaaatcttagggagtatctgcactggcttgtcacggatattccaggaaccactggggcagcatttgggcaagaggtgatctgctacgagagccctcggccgaccatggggatccaccgcttcgtgctggtgctgttccagcagctggggcgtcagacggtgtacgccccggggtggcgccagaacttcaacaccagggacttcgccgagctctacaacctgggccctcccgtcgccgccgtctacttcaactgccagcgtgaggccggatctgggggaaggaggatgtactcatga

SEQ ID NO: 19727 - protein, 179 aa, Sorghum bicolor
  misc_feature: The sequence is a functional homolog of SEQ ID NO 2 in US patent 7196246
  misc_feature: Useful for making plants with modulated flowering time
  misc_feature: Functional homolog of the protein sequence given in SEQ ID NO 13388
  misc_feature: The sequence is a functional homolog of SEQ ID NO 2 in US patent 7208653
  misc_feature: Ceres ANNOT ID no. 8735116
  misc_feature (22)..(167): Pfam ID: PBP Pfam Description: Phosphatidylethanolamine-binding protein
MAGSGRERETLVVGRVVGDVLDPFVRTTNLRVSYGTRTVSNGCELKPSMVVNQPRVEVGGPDMRTFYTLVMVDPDAPSPSDPNLREYLHWLVTDIPGTTGAAFGQEVICYESPRPTMGIHRFVLVLFQQLGRQTVYAPGWRQNFNTRDFAELYNLGPPVAAVYFNCQREAGSGGRRMYS

SEQ ID NO: 19728 - DNA, 1539 bp, Sorghum bicolor
  misc_feature: Ceres ANNOT ID no. 8735163
  misc_feature: Encodes the peptide sequence at SEQ ID NO 19729
atggcataccctactgtcgtgctcatcccactatgcgtcccaggccacctcacatccatgctcgaagccggcaagcggctgctcgccacaagccgctgccccatgtcgctcaccgtgctcgtcacgcagatgaccatgtccgccaacctgatgtccgacgtcgccgacatcatccggcgggaagcagcagactccgccttcgacatccgcttcgtccacctccccgccgtcgagctccccaccgccgccgacggcctcgaggatttcatgatgcgcttcatacagctccacgacacatacgtcaaggaagccgtctccggcatctcgtccccggtagccgccgtcgtgatcgactacttctgcaccaccctgctggacgtcacccgcgagctcgcgctgccggtgtacgtctacttgacgtccggcgcgtcgatgctcgcgctcctgctgcggttgccggcgctggatgaggagatcgccggagatttcgaggccatgggagaagcagcagcggttgatctgcccgggatgccgccggtaccggctcgtctcatgccaactcccatcatgacgaagaatgcaaacttcacgtggctcgtgtaccacggcaaccgcttcatggaggccgctggcatcatcgtcaacacggtggccgagctggagcagtccatccttgcagccatcgccgatggcctctgcgtgcccggacgccgcgctccaaccgtctacccgatcggccccgtcgtcatgcctgtcaacaagcagccggccgccggcggcgacggcgagcagctacagcacgagtgcgtgaggtggctcgacgcacagccaccagcatccgtcgtgctgctctgctttggcagcatgggcggcagcttcccgtcgccgcaggtccgagagatcgccgacgccctcgagcacagcggccaccgcttcctgtgggtactccgtggcccgatacccgccgattccaagtacccaacggatgccgacctcgacgagctgctcccagaagggttcttggagaggaccaagggcaggggtctggtgtggcccaagtgggcgccgcagaaggacatcctcgccagccctgccgtcggcggcttcgtgacccactgcgggtggaactcgatcctcgagagcctgtggcacggcgtgccgctggtgccgtggccgctgttcgcggagcagcacctgaacgcgttcgagctcgtgtccgtgatgggcgtcgccgtggccatgaaagtggacaggaagcgcggcaacttggtcgaggcggcggagctggagcgcgtggtccggagcctgatgggtgggtcggaggaggaggggaggaaagcgcgagagaaagccacggaggccaaggacctttgccggaaagccgtggccgacggcgggtcctcggcggcgtcgctgcaagaacttgcgcgtgagattggagagcacagagaacaccaaggaagaacggaagcaacgccgccgcttcctcaacaagttcgctacgccgctgccacccttggagctgcacgccatgggtga

SEQ ID NO: 19729 - protein, 512 aa, Sorghum bicolor
  misc_feature: Useful for making plants with altered carbohydrate content
  misc_feature: Functional homolog of the protein sequence given in SEQ ID NO 14351
  misc_feature: Ceres ANNOT ID no. 8735163
  misc_feature (28)..(479): SWISSPROT Homolog: EC 2.4.1.115 Anthocyanidin 3-O-glucosyltransferase
  misc_feature (5)..(483): Pfam ID: UDPGT Pfam Description: UDP-glucoronosyl and UDP-glucosyl transferase
MAYPTVVLIPLCVPGHLTSMLEAGKRLLATSRCPMSLTVLVTQMTMSANLMSDVADIIRREAADSAFDIRFVHLPAVELPTAADGLEDFMMRFIQLHDTYVKEAVSGISSPVAAVVIDYFCTTLLDVTRELALPVYVYLTSGASMLALLLRLPALDEEIAGDFEAMGEAAAVDLPGMPPVPARLMPTPIMTKNANFTWLVYHGNRFMEAAGIIVNTVAELEQSILAAIADGLCVPGRRAPTVYPIGPVVMPVNKQPAAGGDGEQLQHECVRWLDAQPPASVVLLCFGSMGGSFPSPQVREIADALEHSGHRFLWVLRGPIPADSKYPTDADLDELLPEGFLERTKGRGLVWPKWAPQKDILASPAVGGFVTHCGWNSILESLWHGVPLVPWPLFAEQHLNAFELVSVMGVAVAMKVDRKRGNLVEAAELERVVRSLMGGSEEEGRKAREKATEAKDLCRKAVADGGSSAASLQELAREIGEHREHQGRTEATPPLPQQVRYAAATLGAARHG

SEQ ID NO: 19730 - DNA, 1470 bp, Sorghum bicolor
  misc_feature: Ceres ANNOT ID no. 8735160
  misc_feature: Encodes the peptide sequence at SEQ ID NO 19731
atggcataccctactctcgtactcatcccattctgcgttccaggccacctcacatccatgctcgaagccggcaagcggctgctcgccacaagccgctgcgccatgtcgctcaccgtgctcgtcacgcagatgaccatgtccgccaacctgatgtccgacgtcgccgacatcatccggcgggaagaagcagactccggcttcgacatccgcttcgtccacctccccgccgtcgagctccccaccgccgccgacggtctcgaggctttcatgatgcgcttcatacagctccacgacacatacgtcaaggaagccatctccggcatgtcgtcgtccccggtagccgcggtcgtcgtggacttcttctgcaccgccctcttcgatgtcacgcgcgagctcgcactgccggtgtacgtctacttcacgtccggcgcctcgatgctcgcgctcatgctgcggttgccggcgctggacggggagatcgccggagatttcgaggcgatgggagaaggagcagttgatctgcccgggatgccgccggtgccggctcgtctcatgccatctcctataatgaggaaggatccaaactacgcctggttcgtgtaccacggcaaccgcttcatggaggccgctggcatcatcgtcaacacggtggccaagctggagccgtccatcctagcagccatcgccgatggcctctgcgtgcccggacgccgcgctccaaccgtctacccgatcggccccgtcatggctttcaagccgctcgccggcgacgacgacgacgagcagctacagctacacgagtgcgtgaggtggctggacgcacagccaccagcatccgtcgtgctgctctgctttggcagcatgggcggcagcttcccgtcgccgcaggtccgggagatcgccgacgccctcgagcacagcgggcaccacttcctgtgggtactccgtggcccgctatcgcccggttcgaagtgcccgacggatgccaacgtcgacgagctgctcccagaagggttcttggagaggaccaagggcaggggtctggtgtggcccaagtgggcgccgcagaaggacatcctcgccaaccctgccgtcggcggcttcgtgacccactgcgggtggaactcgatcctcgagagcctgtggcacggcgtgccgatggcgccatggccgctgtacgcggagcagcacctgaacgcgttcgagctcgtgtccgtgatgggcgtcgccgtggccatgcaagtggacaggaagcgcggcaacttcgtcgaggcggcggagctggagcgcgtggtccggtgcctgatgggcgggtcggaggaggggcggaaggcggggaagaaggccgcggaggcgaaggccctatgccggaaagccgtggccgacggcgggtcctcggaggcgtcgctgcaaaaactagcgcgagagattttgcacaatcacaacgacaagtggtgtggagttgcttag

SEQ ID NO: 19731 - protein, 489 aa, Sorghum bicolor
  misc_feature: Useful for making plants with altered carbohydrate content
  misc_feature: Functional homolog of the protein sequence given in SEQ ID NO 14351
  misc_feature: Ceres ANNOT ID no. 8735160
  misc_feature (15)..(478): SWISSPROT Homolog: EC 2.4.1.115 Anthocyanidin 3-O-glucosyltransferase
  misc_feature (15)..(481): Pfam ID: UDPGT Pfam Description: UDP-glucoronosyl and UDP-glucosyl transferase
MAYPTLVLIPFCVPGHLTSMLEAGKRLLATSRCAMSLTVLVTQMTMSANLMSDVADIIRREEADSGFDIRFVHLPAVELPTAADGLEAFMMRFIQLHDTYVKEAISGMSSSPVAAVVVDFFCTALFDVTRELALPVYVYFTSGASMLALMLRLPALDGEIAGDFEAMGEGAVDLPGMPPVPARLMPSPIMRKDPNYAWFVYHGNRFMEAAGIIVNTVAKLEPSILAAIADGLCVPGRRAPTVYPIGPVMAFKPLAGDDDDEQLQLHECVRWLDAQPPASVVLLCFGSMGGSFPSPQVREIADALEHSGHHFLWVLRGPLSPGSKCPTDANVDELLPEGFLERTKGRGLVWPKWAPQKDILANPAVGGFVTHCGWNSILESLWHGVPMAPWPLYAEQHLNAFELVSVMGVAVAMQVDRKRGNFVEAAELERVVRCLMGGSEEGRKAGKKAAEAKALCRKAVADGGSSEASLQKLAREILHNHNDKWCGVA

SEQ ID NO: 19732 - DNA, 636 bp, Sorghum bicolor
  misc_feature: Ceres ANNOT ID no. 8735195
  misc_feature: Encodes the peptide sequence at SEQ ID NO 19733
atggggcgcggcaaggtggagctgaagcggatcgagaacaagatcagccggcaggtgacgttcgccaagcgccggaacgggctgctcaagaaggcgtacgagctgtcggtgctctgcgacgccgaggtcgccctcatcatcttctccagccgcggccgcctcttcgagttctccacctcctcatgcatgtacaagacgctggagcgataccgcagctgcaattttgcatccgaagcatcagctccactagaggctgaattaaataattatcaggagtacttgaagttaaagacaaaagttgagttcttacaaacaactcagagaaatctacttggtgaggacttgggtccacttaacgtgaaggagctagagcaacttgagaaccaaattgagatatctctcaagcatatccggtcatcaaaggaacaacaactgcaagatgctaacaaagacttaagaaggaagatacaagaaactagtgaagaaaatgtgctgcgactgtcttgccaggacattgggtgtagtggatctagtgggcatggtgatgaagccaaccaagaacgccttcaccttgctcttgatccttccctgcatatagggtatcaagcttacatggaccacatgaacaatgattaa

SEQ ID NO: 19733 - protein, 211 aa, Sorghum bicolor
  misc_feature: The sequence is a functional homolog of SEQ ID NO 4 in US patent 7057087
  misc_feature: Useful for making plants with modulated biomass
  misc_feature: Useful for making plants with modulated flowering time
  misc_feature: Functional homolog of the protein sequence given in SEQ ID NO 13569
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: The sequence is a functional homolog of SEQ ID NO 30 in the 10/666,642 US patent application
  misc_feature: The sequence is a functional homolog of SEQ ID NO 707 in the 10/666,642 US patent application
  misc_feature: The sequence is a functional homolog of SEQ ID NO 28 in the 10/666,642 US patent application
  misc_feature: The sequence is a functional homolog of SEQ ID NO 6 in US patent 7279615
  misc_feature: The sequence is a functional homolog of SEQ ID NO 1360 in the 10/666,642 US patent application
  misc_feature: The sequence is a functional homolog of SEQ ID NO 22 in the 10/666,642 US patent application
  misc_feature: Useful for making plants with altered alkaloid content
  misc_feature: Useful for making plants with altered terpenoid content
  misc_feature: Functional homolog of the protein sequence given in SEQ ID NO 13021
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 2 in US patent 7273968
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 730 in the 10/666,642 US patent application
  misc_feature: The sequence is a functional homolog of SEQ ID NO 46 in the 10/666,642 US patent application
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 1701 in the 10/412,699 US patent application
  misc_feature: The sequence is a functional homolog of SEQ ID NO 1965 in the 10/412,699 US patent application
  misc_feature: The sequence is a functional homolog of SEQ ID NO 1949 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: Useful for making plants with altered lignin content
  misc_feature: Functional homolog of the protein sequence given in SEQ ID NO 12944
  misc_feature: The sequence is a functional homolog of SEQ ID NO 1955 in the 10/412,699 US patent application
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8735195
  misc_feature (9)..(59): Pfam ID: SRF-TF Pfam Description: SRF-type transcription factor (DNA-binding and dimerisation domain)
  misc_feature (75)..(171): Pfam ID: K-box Pfam Description: K-box region
MGRGKVELKRIENKISRQVTFAKRRNGLLKKAYELSVLCDAEVALIIFSSRGRLFEFSTSSCMYKTLERYRSCNFASEASAPLEAELNNYQEYLKLKTKVEFLQTTQRNLLGEDLGPLNVKELEQLENQIEISLKHIRSSKEQQLQDANKDLRRKIQETSEENVLRLSCQDIGCSGSSGHGDEANQERLHLALDPSLHIGYQAYMDHMNND

SEQ ID NO: 19734 - DNA, 948 bp, Sorghum bicolor
  misc_feature: Ceres ANNOT ID no. 8735221
  misc_feature: Encodes the peptide sequence at SEQ ID NO 19735
atgaacgagcagcaggggctcggtggcttcggcgggggccgcgggggcgtgcagggccacgggcgggaggcgatggcgctcctgcagcaccacgaccagcggcggcggcagcagctggaggaggaggaggacgacgaggcggtgcggcgccagatgttcggcgggttggcggcgtacccggcggcgctgggccacggccaccaggtggactacggggaggacgccggcgggctcggggacagcgacgcgggcgggtcggagcccgaggcgccgccggagcggacgcgcggtggcggtgggtccggcagcaagcggagccgcgctgccgaggtgcacaacctctccgagaagaggaggaggagcaagatcaacgagaagatgaaggcgctgcagagcctgatacccaattccaacaagaccgacaaggcatccatgcttgacgaggccattgagtatctgaagcaactgcagctccaagtgcagatgctgtctatgagaaatggtgtttacttgaaccctccatatttgtctggcgcaattgagcctgcacaagcatcacaaatgtttgctgcacttggtgggggcaacatcacagcgtcaagctctggggcagtgatgccaccagtaaaccaaagttcaggagttcaccaggcatttgacccattaaatcctccacgaaaccaaccactgtcttttgtgttaccaaatgtagacaaaaccattcaagaagctccatttcacttggaatcatcgcagtcccaccttcgaacatttcgaatgcctgaatcttctgagatgatgcttccgggcgaggtagtggcaaagcaccagttaacttcaactcaagaaagagttagtctgccaggaattgatatgaaccccattaggcaagaatcatccattgtaaatgctgatcatttcgatggttgctcacatagcaaagagtga

SEQ ID NO: 19735 - protein, 315 aa, Sorghum bicolor
  misc_feature: The sequence is a functional homolog of SEQ ID NO 1246 in the 10/412,699 US patent application
  misc_feature: The sequence is a functional homolog of SEQ ID NO 967 in the 10/374,780 US patent application
  misc_feature: The sequence is a functional homolog of SEQ ID NO 1245 in the 10/412,699 US patent application
  misc_feature: The sequence is a functional homolog of SEQ ID NO 966 in the 10/374,780 US patent application
  misc_feature: Ceres ANNOT ID no. 8735221
  misc_feature (108)..(157): Pfam ID: HLH Pfam Description: Helix-loop-helix DNA-binding domain
MNEQQGLGGFGGGRGGVQGHGREAMALLQHHDQRRRQQLEEEEDDEAVRRQMFGGLAAYPAALGHGHQVDYGEDAGGLGDSDAGGSEPEAPPERTRGGGGSGSKRSRAAEVHNLSEKRRRSKINEKMKALQSLIPNSNKTDKASMLDEAIEYLKQLQLQVQMLSMRNGVYLNPPYLSGAIEPAQASQMFAALGGGNITASSSGAVMPPVNQSSGVHQAFDPLNPPRNQPLSFVLPNVDKTIQEAPFHLESSQSHLRTFRMPESSEMMLPGEVVAKHQLTSTQERVSLPGIDMNPIRQESSIVNADHFDGCSHSKE

SEQ ID NO: 19736 - DNA, 606 bp, Sorghum bicolor
  misc_feature: Ceres ANNOT ID no. 8735233
  misc_feature: Encodes the peptide sequence at SEQ ID NO 19737
atggagagggacgccactgccttctgcccgccgccgcagcccgcgccggctgccccggtttcggtgccgcccgcgacggtgctgggcgccggtggtggagcggttgcggcggcggcagggcacggccgaggcggcggcggaggtggaggaggaggaggaggagggaggcagtatcgcggcgttcggatgcgcaagtggggcaagtgggtggcggagatccgcgagccgaacaagcggtcgcggatctggctgggttcctactccaccgccgtcgccgccgcgcgcgcctacgacacggccgtgttctacctccgcggccgctccgcgcggctcaacttccccgaccagctcgacggcgcggcggtggccgataaccccgagggccacagggacggcggcgcgggggcggggctcacggccgccgccatccgcaagaaggcggccgaggtcggcgcccgcgtcgacgcgctccactgcggcgttggcgttggcctcgctggcggcggtgctgcctctccgcagccgctgtcgtcccaccatcgccgccgccccaagaaccccgacctcaaccgggagcccaccccggacacctcagacgacgagtga

SEQ ID NO: 19737 - protein, 201 aa, Sorghum bicolor
  misc_feature: The sequence is a functional homolog of SEQ ID NO 489 in the 10/374,780 US patent application
  misc_feature: The sequence is a functional homolog of SEQ ID NO 682 in the 10/666,642 US patent application
  misc_feature: The sequence is a functional homolog of SEQ ID NO 989 in the 10/412,699 US patent application
  misc_feature: The sequence is a functional homolog of SEQ ID NO 154 in the 10/225,068 US patent application
  misc_feature: The sequence is a functional homolog of SEQ ID NO 1716 in the 10/412,699 US patent application
  misc_feature: The sequence is a functional homolog of SEQ ID NO 1952 in the 10/374,780 US patent application
  misc_feature: The sequence is a functional homolog of SEQ ID NO 200 in the 11/375,241 US patent application
  misc_feature: The sequence is a functional homolog of SEQ ID NO 4 in the 10/666,642 US patent application
  misc_feature: The sequence is a functional homolog of SEQ ID NO 572 in the 11/435,388 US patent application
  misc_feature: Useful for making plants with altered alkaloid content
  misc_feature: Functional homolog of the protein sequence given in SEQ ID NO 14735
  misc_feature: The sequence is a functional homolog of SEQ ID NO 16 in the 10/412,699 US patent application
  misc_feature: The sequence is a functional homolog of SEQ ID NO 1442 in the 10/666,642 US patent application
  misc_feature: The sequence is a functional homolog of SEQ ID NO 1858 in the 10/412,699 US patent application
  misc_feature: The sequence is a functional homolog of SEQ ID NO 206 in the 11/375,241 US patent application
  misc_feature: The sequence is a functional homolog of SEQ ID NO 2104 in the 10/374,780 US patent application
  misc_feature: The sequence is a functional homolog of SEQ ID NO 292 in the 10/225,066 US patent application
  misc_feature: The sequence is a functional homolog of SEQ ID NO 654 in the 11/435,388 US patent application
  misc_feature: Ceres ANNOT ID no. 8735233
  misc_feature (56)..(107): Pfam ID: AP2 Pfam Description: AP2 domain
MERDATAFCPPPQPAPAAPVSVPPATVLGAGGGAVAAAAGHGRGGGGGGGGGGGGRQYRGVRMRKWGKWVAEIREPNKRSRIWLGSYSTAVAAARAYDTAVFYLRGRSARLNFPDQLDGAAVADNPEGHRDGGAGAGLTAAAIRKKAAEVGARVDALHCGVGVGLAGGGAASPQPLSSHHRRRPKNPDLNREPTPDTSDDE

SEQ ID NO: 19738 - DNA, 1350 bp, Sorghum bicolor
  misc_feature: Ceres ANNOT ID no. 8735270
  misc_feature: Encodes the peptide sequence at SEQ ID NO 19739
atgacttccccgaagcgggcagcggggcgggaagggtgcgggtgctgggccgccgtcgcgcggggcctccgcggggcttgcttccggccggcggcgccggcggacggtgacggcggcggctccaccaagggcagccacgttcatgacgcagcagcagagacaagatatctgaatgctagcaatcgggagtttggtgatcgttttcagacaaaatgtgatggtgaaaatggtgttgatgcatcaattgaaaagagaacaccacccaagctacttcagtttacctttcaagagttgaaatctgccacccttaacttcaggccagacagtattcttggggagggtgggttcggttatgtcttcaaggggtggattgagccaaacagcactgctcctgcaaaacctggcacaggggttactgtggcagtcaaaagtttaaagccagatgcgcttcaaggtcatagagaatgggtggcagaagttgactttctgggacagttgcatcataaacaccttgttaagttgattggatattgtattgaggatgatcaaaggttacttgtatatgaattcatggcacgaggaagtcttgaaaatcatcttttcagaagggctcttcccctaccttggtccaacagaatgaagattgctctaggtgccgcgaaaggactagccttcctccatggaggtcccaaacctgttatttacagggattttaagacatcgaatgttcttcttgatgcggagtacaacgcaaaactatctgatttcggtttagcaaaagctggtcctcagggtgataaaactcatgtatctactcgggttgttggcacctatggttatgctgcaccagagtatgtaatgacagggcatttgacatctaagagtgatgtctatagcttcggagttgtgctactcgagatgttgactgggagaagatcaatggacaagaagcggcctacaggggagcagaacctggttgcatgggcgaggccttacctaaatgatcggcgaaggctctatcagctcgtagatcctcgcttggggctgaactactctgtcaaaggggtgcaaaaggttgctcagatctgccactattgccttacccgtgatagtaagtctcgtccatcgatggaggaagttgtcaagcaactgacaccattacaagatctaaatgacatggcatctgcatcaccaaggcctcgctcaactcagcagcgcgcaaaattagctttgatgttgactgccgatacctggagatgtgacaccgccagatgtctcgctcaggtcgatcacactctgtttggctggttggcaaagcgagataaggatgtatctggttgcaacatgtaa

SEQ ID NO: 19739 - protein, 449 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8735270
  misc_feature (88)..(391): SWISSPROT Homolog: EC 2.7.11.1 Non-specific serine/threonine protein kinase
  misc_feature (105)..(384): Pfam ID: Pkinase Pfam Description: Protein kinase domain
MTSPKRAAGREGCGCWAAVARGLRGACFRPAAPADGDGGGSTKGSHVHDAAAETRYLNASNREFGDRFQTKCDGENGVDASIEKRTPPKLLQFTFQELKSATLNFRPDSILGEGGFGYVFKGWIEPNSTAPAKPGTGVTVAVKSLKPDALQGHREWVAEVDFLGQLHHKHLVKLIGYCIEDDQRLLVYEFMARGSLENHLFRRALPLPWSNRMKIALGAAKGLAFLHGGPKPVIYRDFKTSNVLLDAEYNAKLSDFGLAKAGPQGDKTHVSTRVVGTYGYAAPEYVMTGHLTSKSDVYSFGVVLLEMLTGRRSMDKKRPTGEQNLVAWARPYLNDRRRLYQLVDPRLGLNYSVKGVQKVAQICHYCLTRDSKSRPSMEEVVKQLTPLQDLNDMASASPRPRSTQQRAKLALMLTADTWRCDTARCLAQVDHTLFGWLAKRDKDVSGCNM

SEQ ID NO: 19740 - DNA, 1629 bp, Sorghum bicolor
  misc_feature: Ceres ANNOT ID no. 8735309
  misc_feature: Encodes the peptide sequence at SEQ ID NO 19741
atggcgccaagcaaagttctactcgtcgcggcgaccaagactcccgtcgtccagccatcccagggagaggaagggcagatgacgatcaccgcatccgtcaagctcgctggaggcacgctgtcagtctacggccgtgcggtcctgtccggcgtgcccgcagccgtagcgtcgtcctctgctgtagcggcgggagcagtcgacggggtcttcctcggcgccgacttcgacgagtcagcctcccgccatgtcgtctccctcggctccttaagggacgttcggttcatggcgtgtttccggagcaagctgtggtggatgtcgcagcggatgggggacaagggcggcgacgtcccacacgagacgcagttcctgctcgtggagtccaggggcgccggcggcgaggacgcggcgtacgtcgtgttcctcccgctcgtggagggcgcgttccgtgccagcctccagggcggcgcgggcgacgcgctggagctctgcgtcgagagcggggacgccggcacgcgcgcggcgtccgtcgagcgcgcgctcttcgtgggcgccgcggagtccgatcccttcgcggccatcgccggcgccgtcgcggcggccaagtccgcgctcaggacgttccgggtccgtgccgagaagaagctcccgcgcatcgtcgactacttcggctggtgcacctgggacgccttctaccaggacgtcacgcaggagggcgtcgaggccgggctccgcagcctcgtcgccggcggcgcgccgcccaagttcgtcataatagacgacggctggcagtccgtaggcacggaccaacccaactccgacgacccagcatcaggagaggccaggcagccgcgcttgcctcggctcaccggtatcagggagaacagcaagttccagagccaggacgacccggccgccggcatcagggcggtggtgcgcgcggcgaaggaagagtacggcctcaagtacgtcttcgtctggcacgctatcaccggctactggggcggtgtccgtccaggcgccgccggcatggagcagtacgtctccagcatgcagttccccaagatctcgccgggcgttgccgagaacgatcccggcatgaagaccgactggatcaccgcccaaggggtcggcctcatgcacccgcgcgccgtgtaccgtttctacgacgagcagcacgcgtacctcgccgctgccggtgtcgacggcgtcaagctcacgaggcgataccaccaggcgctcgacgcctccgtcgccaagaatttcccggagaacggcctcatcgcctgcatgagccacaacaccgacgccctctactgctcgaagcagacggcggtggtgagagcgtcagatgacttcttcccgagggaccccgcgtcgcacacggttcacatcgccgcggtggcgtacaacagcgtgttcctcggcgagttcatgctcccggactgggacatgttccactccctccacccagccggcgagtaccatggctcggcccgtgtgatcagcggcggccctgtctatgtcagtgacgcccccggcaagcacgactttgagctgctcaagaagatcgtcttgccggacggctccgtgctacgtgcgcgtctgcctggcaggcccaccaagtgttag

SEQ ID NO: 19741 - protein, 542 aa, Sorghum bicolor
  misc_feature: Useful for making plants with altered carbohydrate content
  misc_feature: Functional homolog of the protein sequence given in SEQ ID NO 14032
  misc_feature: Ceres ANNOT ID no. 8735309
  misc_feature (79)..(299): SWISSPROT Homolog: EC 2.4.1.67 Galactinol--raffinose galactosyltransferase
  misc_feature (306)..(541): SWISSPROT Homolog: EC 3.2.1.22 Alpha-galactosidase
  misc_feature (33)..(542): Pfam ID: Raffinose_syn Pfam Description: Raffinose synthase or seed imbibition protein Sip1
MAPSKVLLVAATKTPVVQPSQGEEGQMTITASVKLAGGTLSVYGRAVLSGVPAAVASSSAVAAGAVDGVFLGADFDESASRHVVSLGSLRDVRFMACFRSKLWWMSQRMGDKGGDVPHETQFLLVESRGAGGEDAAYVVFLPLVEGAFRASLQGGAGDALELCVESGDAGTRAASVERALFVGAAESDPFAAIAGAVAAAKSALRTFRVRAEKKLPRIVDYFGWCTWDAFYQDVTQEGVEAGLRSLVAGGAPPKFVIIDDGWQSVGTDQPNSDDPASGEARQPRLPRLTGIRENSKFQSQDDPAAGIRAVVRAAKEEYGLKYVFVWHAITGYWGGVRPGAAGMEQYVSSMQFPKISPGVAENDPGMKTDWITAQGVGLMHPRAVYRFYDEQHAYLAAAGVDGVKLTRRYHQALDASVAKNFPENGLIACMSHNTDALYCSKQTAVVRASDDFFPRDPASHTVHIAAVAYNSVFLGEFMLPDWDMFHSLHPAGEYHGSARVISGGPVYVSDAPGKHDFELLKKIVLPDGSVLRARLPGRPTKC

SEQ ID NO: 19742 - DNA, 663 bp, Sorghum bicolor
  misc_feature: Ceres ANNOT ID no. 8735311
  misc_feature: Encodes the peptide sequence at SEQ ID NO 19743
atggctgcattacggttctctgccgacagcctgctcaagatatggaacatgaacaagttcacgggcgtcctcggcgtatacaactgccagggcgcggcgtggagcttcgcggagaagaagaccgtgttccacttccacccggccggcgccggcgccctgacctgcgccgtcaggggcagcgacgtccacctcatctgcgaggccgcgacggatgccgaatggaacggcgactgcgccgtgtaccgccatgccagcggcgacctcgtcgtcctccccagcggcgcggcactgcccgtctccctcaaggagttggcacccgggttcaggttcgccccgatcgggctcgtcgacatgttcaacagcggcgcggcggtggaaggcctaacgtaccacctcctcgacggcgcaaagctgctcggcgtcggcgacaacgacgggcccgcttctgctactagctcggatgccaccggattggtgtgcgtggaagtgagggggtgtggcaggttcggtgcctactcctcggtcaggccaaggagatgtttgctgggctctgcctctgcgcagctggagttcacctatgattcttcctccggccttgttgttttgcaactggaggcgatgcacaccaaggagagggttcacaggattgtcgttgagttgtag

SEQ ID NO: 19743 - protein, 220 aa, Sorghum bicolor
  misc_feature: Useful for making plants with altered carbohydrate content
  misc_feature: Functional homolog of the protein sequence given in SEQ ID NO 14032
  misc_feature: Ceres ANNOT ID no. 8735311
  misc_feature (6)..(166): SWISSPROT Homolog: EC 2.4.1.67 Galactinol--raffinose galactosyltransferase
MAALRFSADSLLKIWNMNKFTGVLGVYNCQGAAWSFAEKKTVFHFHPAGAGALTCAVRGSDVHLICEAATDAEWNGDCAVYRHASGDLVVLPSGAALPVSLKELAPGFRFAPIGLVDMFNSGAAVEGLTYHLLDGAKLLGVGDNDGPASATSSDATGLVCVEVRGCGRFGAYSSVRPRRCLLGSASAQLEFTYDSSSGLVVLQLEAMHTKERVHRIVVEL

SEQ ID NO: 19744 - DNA, 2298 bp, Sorghum bicolor
  misc_feature: Ceres ANNOT ID no. 8735307
  misc_feature: Encodes the peptide sequence at SEQ ID NO 19745
atgaccatctcctcgtccgtcaagctcgccggaggcacgctgtcggtatgcgggcggacggtgctgtccggggtgccggacgcggtggtggcctcgtcggcggcggcggggggagcggtcgacggggtcttcatcggcgccgacttcgccgagcccgccgcccggcacgtcgtctccctcggggacctgaggggcgtgcggttcatggcgtgcttccggttcaagctctggtggatggcgcagcggatgggggagaaaggcggcgacgtcccgcgcgagacgcagttcctgctcgtcgagtccaagggcgccggcgacggcgccgcggcggcgtacgtcgtgttcctgcccctcgtcgagggcgcgttccgtgccagcctccagggcggcgcgggcgacgcgctggagctctgcgtcgagagcggggacgcggagacgcgcgcggcgtccttcgagcgcgcgctcttcgtgggcgccgcggagtccgaccccttcgcggccatctccggcgccgtcggtgccgccaagtccgcgctcaggacgttccgggtccgcgccgagaagaagctgccgggcatcgtcgactacttcggctggtgcacctgggacgccttctaccaggatgtcacccaggagggcgtcgaggccgggctccgcagcctcatcgccggcggcgcgccgcccaagttcgtcatcatcgacgacggctggcagtccgtcggcaccgacaagtccgccaccgacaccgacaccgacgaacctgccggagaggacaagccgccccgcctgtctcgcctcaccggcatcaaggagaacagcaagttccagaacgtggacgacccggccgccggcatcaagacggtggtgcgcgcggcgaaggaggagtacgggctcaagtacgtctacgtctggcacgccatcaccggctactggggcggcgtccgacccggcgaacccgggacggagcactaccgctccagcatgcagttccccaaggtctcgccgggcgtcatggagaacgagcccggcatgaagaccgacgtgctcaccgtgcagggactcggcctcgtgcacccgcgcgccgtgtaccgcttctacgacgagctccacgcctacctcgccgccgccggtgtcgacggcgtcaaggtagacgtgcagtgcatcctggagacgctcggcgccggccacggcggccgcgtgcagctcaccaggcagtaccaccaggcgctcgacgcctccatcgccaagaacttcccggagaacggcatcatcgcctgcatgagccacaacaccgacgccctttactgctccaagcagacggcggtggtgagggcgtcggatgatttctatccgagggaccccgtgtcgcatacgatccatatcgcctcggtggcgtacaacagcgtgttcctcggcgagttcatgctgccggactgggacatgttccactcgctccaccaggccggcgactaccacggctcggcacgcgcgatcagtggaggcccggtctacgtcagtgatgcccccgggaagcacaacttcgagctgctcaagaagattgtcttgcccgacggctccattctccgcgcgcgtctgccaggccggccgaccaaggattgcctgttcaccgacccggcacgcgacggcgtcagcctgctcaagatatggaacatgaacaagttcaccggcgtgctcggcgtgtacaactgccagggcgcggcgtggagctccgtggagaagaagaacacctttcatcataccggcaccgaggccctgacctgcggtatcaagggcagcgacgtccacctcatctccgaggccgcgacggaccctgaatggaacggcgactgtaccgtgtaccgacatgccgacagcgacctcgccgtcctcccgtacggtgcggcgttgcctgtctctctcaaggtcctggaacatgacatcctcaccgtgtcaccgatcaaggacttggcacctggtttcaggttcgccccgattgggctggtggacatgttcaatagcggcggggcggtggaaggcctgacctaccacctcctcggcggcgcaaagctgctcgacggcggcaacggttctgcttcgggctccgaggctgtcggattggcgtgcatggaggtgaagggctgtggaaggttcggtgcctactcttcagtcaggccaaggaaatgcatgctgggttcagctcagctggagttctcctatgattcttcctcagggctggtggttcttcagctggagaagatgcccaaggagagggttcacaagattgttgtcgagttgtag

SEQ ID NO: 19745 - protein, 765 aa, Sorghum bicolor
  misc_feature: Useful for making plants with altered carbohydrate content
  misc_feature: Functional homolog of the protein sequence given in SEQ ID NO 14032
  misc_feature: Ceres ANNOT ID no. 8735307
  misc_feature (284)..(714): SWISSPROT Homolog: EC 2.4.1.67 Galactinol--raffinose galactosyltransferase
  misc_feature (7)..(750): Pfam ID: Raffinose_syn Pfam Description: Raffinose synthase or seed imbibition protein Sip1
MTISSSVKLAGGTLSVCGRTVLSGVPDAVVASSAAAGGAVDGVFIGADFAEPAARHVVSLGDLRGVRFMACFRFKLWWMAQRMGEKGGDVPRETQFLLVESKGAGDGAAAAYVVFLPLVEGAFRASLQGGAGDALELCVESGDAETRAASFERALFVGAAESDPFAAISGAVGAAKSALRTFRVRAEKKLPGIVDYFGWCTWDAFYQDVTQEGVEAGLRSLIAGGAPPKFVIIDDGWQSVGTDKSATDTDTDEPAGEDKPPRLSRLTGIKENSKFQNVDDPAAGIKTVVRAAKEEYGLKYVYVWHAITGYWGGVRPGEPGTEHYRSSMQFPKVSPGVMENEPGMKTDVLTVQGLGLVHPRAVYRFYDELHAYLAAAGVDGVKVDVQCILETLGAGHGGRVQLTRQYHQALDASIAKNFPENGIIACMSHNTDALYCSKQTAVVRASDDFYPRDPVSHTIHIASVAYNSVFLGEFMLPDWDMFHSLHQAGDYHGSARAISGGPVYVSDAPGKHNFELLKKIVLPDGSILRARLPGRPTKDCLFTDPARDGVSLLKIWNMNKFTGVLGVYNCQGAAWSSVEKKNTFHHTGTEALTCGIKGSDVHLISEAATDPEWNGDCTVYRHADSDLAVLPYGAALPVSLKVLEHDILTVSPIKDLAPGFRFAPIGLVDMFNSGGAVEGLTYHLLGGAKLLDGGNGSASGSEAVGLACMEVKGCGRFGAYSSVRPRKCMLGSAQLEFSYDSSSGLVVLQLEKMPKERVHKIVVEL

SEQ ID NO: 19746 - DNA, 1062 bp, Sorghum bicolor
  misc_feature: Ceres ANNOT ID no. 8735342
  misc_feature: Encodes the peptide sequence at SEQ ID NO 19747
atggagtcgctggccagcgccatgcgtcgcgagaaccgccggtccaaggccccgtcctcctcctccgccgcctccaccctcgcctcgggcagggtccctctcgtcatggctttcctctcctgcctcgcctggctctacgtcgccggccggttgtggcaggacgcgcagacccgggcgatcctctccggcctcctcgagaagagttctggcagcgtcccgaaggtgctctcggtggaggacaagcttaggaacctcggatgcaaggcgattggaagcaaaattgttgaggcggagatggacctgaccaaggccaagagcgaggggtacctgtgggggaacaggactgcagctgtcgattccgacaagaagcagcagcttcttgccgtcattggagtttacactgggtttggctcccgtctcaagaggaatgtcttccgtggctcctggatgccgagaggtgatgctctgaagaagcttgaggaaaagggtgtagttattcgttttgttattggtcggagtgcaaatcgaggtgatagcttggaccgtaatattgacgatgaaaatcggcagacaaaggacttcttgattcttgaaagtcatgaagaggctgcagaagaattgccgagcaaagcaaagtttttcttcagtgctgcagttgaaacctgggatgcagaattctatgtcaaagttgaggataacattaatcttgacttagctgggttaatcgagatgctcgaaggccgtcgaggtagccaaggattgtatatgggttgtatgaaatcaggggttgtcataagtgaagagggtcaacaatggtatgaacctgactggtggaaatttggagattcaaaaacgtattttcgacatgcttctggttctttgtttatcctctcaaaaaatttggctcgctacatcaacataaatagtgcatcgctccagagttatgcacacgacgacatatcagtaggttcatggatgatgggactgaatgcaacttacgtcgacgatgaccggttgtgctgcagcagctccagacaagagaaagtctgttctaatgcttga

SEQ ID NO: 19747 - protein, 353 aa, Sorghum bicolor
  misc_feature: Useful for making plants with altered carbohydrate content
  misc_feature: Functional homolog of the protein sequence given in SEQ ID NO 14736
  misc_feature: Ceres ANNOT ID no. 8735342
  misc_feature (154)..(352): SWISSPROT Homolog: EC 2.4.1.134 Galactosylxylosylprotein 3-beta-galactosyltransferase
  misc_feature (140)..(337): Pfam ID: Galactosyl_T Pfam Description: Galactosyltransferase
MESLASAMRRENRRSKAPSSSSAASTLASGRVPLVMAFLSCLAWLYVAGRLWQDAQTRAILSGLLEKSSGSVPKVLSVEDKLRNLGCKAIGSKIVEAEMDLTKAKSEGYLWGNRTAAVDSDKKQQLLAVIGVYTGFGSRLKRNVFRGSWMPRGDALKKLEEKGVVIRFVIGRSANRGDSLDRNIDDENRQTKDFLILESHEEAAEELPSKAKFFFSAAVETWDAEFYVKVEDNINLDLAGLIEMLEGRRGSQGLYMGCMKSGVVISEEGQQWYEPDWWKFGDSKTYFRHASGSLFILSKNLARYININSASLQSYAHDDISVGSWMMGLNATYVDDDRLCCSSSRQEKVCSNA

SEQ ID NO: 19748 - DNA, 2292 bp, Sorghum bicolor
  misc_feature: Ceres ANNOT ID no. 8735365
  misc_feature: Encodes the peptide sequence at SEQ ID NO 19749
atggcgatcctctcgccgctcgccaccgaggtgttcatccccgtcgccgccgtcatcggcatcgtcttcgccgtcgtgcagtgggtgctcgtgtcgcgggtgaagctctccccgaccgcggccgccgcgtccggcggagggaagaacggctacggcgactacctcatcgaggaggaggaggggctcaacgaccacaacgtcgtcgtcaagtgcgccgagatccagaacgctatctccgaaggagcaacatcgtttcttttcactgagtaccaatatgttggtatcttcatgtctatcttcgccgttgtgatcttcctcttccttggttcggttgagggattcagcacgaagagccagccctgcacctatagcaaggacaagtactgcaagcctgcactgttcactgccctcttcagcactgtgtccttcttgcttggagccatcacctctctggtatctggtttccttggcatgaagattgccacatatgcgaatgccagaactaccctggaagctaggaagggtgttggcaaggcttttatcactgctttccgctctggcgctgttatgggtttcctgcttgcatcaagtgggcttgtggttctgtacatcaccattaatgtatttaagttgtattatggtgatgactgggagggtctttttgagtctatcactggctatggccttggtgggtcgtccatggctctcttcggaagagttggtggaggtatctacacgaaggctgctgatgttggtgccgatcttgttgggaaggttgagaggaacattcctgaggatgatcctaggaacccagctgtgattgctgataatgttggtgacaatgttggtgacattgctggaatgggatctgatctctttgggtcatatgctgagtcttcctgtgctgcccttgttgttgcgtctatttcatctttcggaattgaccatgacttcactgggatgtgctacccactccttgttagctctgttggtatcatcgtctgcttgatcaccaccctttttgctactgatttctttgaagtcaaggctgtgaaagaaattgagcctgcacttaagaagcagctcatcatctccaccgccctgatgactgttggtattgctgtaatcagctggttagcccttccagctaagttcaccatctacaacttcggtactcagaaggatgtctccaactggggcttgttcttctgtgttgcaattggtctgtgggctggtctgattattggttttgtcacagaatactacactagcaatgcatacagtcctgtgcaagatgtcgcggattcgtgcagaaccggtgctgccactaatgtcatttttggtctcgctcttggatacaagtcagttatcatcccgatttttgctatcgctgttagcatctatgtcagtttctccattgctgcaatgtacggcatcgctgttgccgctcttggtatgctgagcacaatcgcaactggtcttgccattgatgcttatggtcccatcagtgacaatgctggtggtattgctgagatggctggaatgagccacagaatccgtgagagaactgatgctcttgatgctgctggcaacacaactgccgctattggaaaggggtttgccattggttcagctgctcttgtgtccctggcgctttttggcgccttcgtcagcagagctggagtgacggttgtcgatgtcctctcccccaaggttttcattggtttgattgttggagccatgcttccctactggttctctgccatgaccatgaagagtgttggaagtgctgccctgaagatggtggaggaggtccgcaggcagttcaacaccattcctgggttgatggagggaactgccaagcctgactatgcaacctgtgtgaagatctccaccgatgcttccatcaaggagatgattcccccgggtgctctggtcatgctcactcccctcattgttggaaccctcttcggtgttgagactctctctggcgttcttgctggtgccctggtttctggagtgcagattgccatctctgcttccaacaccggtggtgcatgggacaatgccaagaagtacattgaggctggtgccagcgagcatgcaaggacccttggccccaagggatctgactgccacaaggctgctgtgatcggtgacaccattggtgaccccctgaaggacacctcgggcccgtccctcaacatcctcatcaagctcatggccgtggagtcccttgtgtttgcccccttcttcgccacccaaggtggcattctgttcaagtacctgtaa

SEQ ID NO: 19749 - protein, 763 aa, Sorghum bicolor
  misc_feature: Useful for making plants with modulated water use efficiency
  misc_feature: Functional homolog of the protein sequence given in SEQ ID NO 13830
  misc_feature: Ceres ANNOT ID no. 8735365
  misc_feature (1)..(763): SWISSPROT Homolog: EC 3.6.1.1 Inorganic diphosphatase
  misc_feature (6)..(749): Pfam ID: H_PPase Pfam Description: Inorganic H+ pyrophosphatase
MAILSPLATEVFIPVAAVIGIVFAVVQWVLVSRVKLSPTAAAASGGGKNGYGDYLIEEEEGLNDHNVVVKCAEIQNAISEGATSFLFTEYQYVGIFMSIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGIDHDFTGMCYPLLVSSVGIIVCLITTLFATDFFEVKAVKEIEPALKKQLIISTALMTVGIAVISWLALPAKFTIYNFGTQKDVSNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVTVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATQGGILFKYL

SEQ ID NO: 19750 - DNA, 1152 bp, Sorghum bicolor
  misc_feature: Ceres ANNOT ID no. 8735341
  misc_feature: Encodes the peptide sequence at SEQ ID NO 19751
atggggacgctggccagcgccatgcggcgcgagaaccaccgccggtccaaggccccgtcctccgccctcgcctcgggcacggtccctctcgtcatgaccttcctctcctgcctcgcctggctctacgtcgccggccgattgtggcaggacgcgcagacccgggcgatcctgtccgccggcctccacgagaagagctctggcagcgtgtcgaaggtgctctcggtggaggacaagcttattaggaacctcggatgcaaagcgattggagggaaagttgttgaggcggagatggacctggccagggccaagactgaggggtacctgtgggagaacaggactgcagctgtcgactccggcaagaagcagaagcttcttgctgtcattggtgtttacactgggtttggctctcatcgcaagaggaacgtcttccgtggctcctggatgccaagaggcgatgctctgaagaagcttgaggaaaagggtgtagttattcgttttgttattggtcggagtgcaaatcgaggtgatagcttggaccgtaatattgacgatgaaaatcagcagacaaaggacttcttgcttcttgaaagtcatgaagaggttacagaagaattaccgagtaaagcaaagtttttcttcagtgctgcagtcgacacctgggaagcagaattctatgtcaaagttgaggataacattaatcttgacttagctgggttaattgagatgctcgaaggccgtcgaggtagccaaggattgtatatgggttgtatgaaatcaggggttgtcataagtgagaagtaccgacaatggtatgaacctgattggtggaaattcggagattcaaacacttattttcgacatgcttctggttctttgtttatcctctcaaaaaatttggcacgctacatcaacataaatagtgcgtcactgcagagttatgcacatgacgacatatcagtaggttcatggatgatggggctgaatgcaacttacgtggacgacgaccggttgtgctgtagcagttccagacaaggtaaaacaatgaatcagcttctggcagttccaaggaaacttccttgttttttttgggttgctaatgccatgtttttgaaccatcattcccagagaaagtctgttcaaatgcttgagtag

SEQ ID NO: 19751 - protein, 383 aa, Sorghum bicolor
  misc_feature: Useful for making plants with altered carbohydrate content
  misc_feature: Functional homolog of the protein sequence given in SEQ ID NO 14736
  misc_feature: Ceres ANNOT ID no. 8735341
  misc_feature (136)..(336): SWISSPROT Homolog: EC 2.4.1.134 Galactosylxylosylprotein 3-beta-galactosyltransferase
  misc_feature (138)..(335): Pfam ID: Galactosyl_T Pfam Description: Galactosyltransferase
MGTLASAMRRENHRRSKAPSSALASGTVPLVMTFLSCLAWLYVAGRLWQDAQTRAILSAGLHEKSSGSVSKVLSVEDKLIRNLGCKAIGGKVVEAEMDLARAKTEGYLWENRTAAVDSGKKQKLLAVIGVYTGFGSHRKRNVFRGSWMPRGDALKKLEEKGVVIRFVIGRSANRGDSLDRNIDDENQQTKDFLLLESHEEVTEELPSKAKFFFSAAVDTWEAEFYVKVEDNINLDLAGLIEMLEGRRGSQGLYMGCMKSGVVISEKYRQWYEPDWWKFGDSNTYFRHASGSLFILSKNLARYININSASLQSYAHDDISVGSWMMGLNATYVDDDRLCCSSSRQGKTMNQLLAVPRKLPCFFWVANAMFLNHHSQRKSVQMLE

SEQ ID NO: 19752 - DNA, 5778 bp, Sorghum bicolor
  misc_feature: Ceres ANNOT ID no. 8735428
  misc_feature: Encodes the peptide sequence at SEQ ID NO 19753
atgacggcgccgcgcggtggcggggacgagccgccgccgccgccgccgtcgtcggctgcggcggggcacgccgcggggaacgagccggtgacgccgacgtccgcgctcgggtcggggctcaaccgccgcgggtcgaggggtgcgggcatggccaccttctccatggaggtcttcgacaacgaagtcgtcccatctacgctcaacagcatcgcgcccatcctgcgcgtcgcggccgagatcgagcacgagcgcccccgggtcgcctacctctgtcggttctatgccttcgagaaggcgcaccggctggatcaaaactccattggccgtggcgtcaggcagttcaagacagcactgctccaacgtcttgagaaggataatagccctagtcttgctaagcgtgtgaagaaaagtgatgctcgcgagatcgagagtttttaccaacagtactacgagaactatgttcgtgcacttgacaaaggggagcaagctgacagggctcaacttgggaaggcctaccagaccgctggagtcctctttgaggtactctgcgccgtcaataaaaatgagaaagtcgaggagctcaatcctgagattattcgcttgcacaaggatgtgcaagagaagaaagacatctacacaccattcaatatcctccctcttgatgccgccagtgcatcccagtccatcatgcagctggaggagatcaaagcagcagttgcagccctgcggaacatacggggcttgacctggccttcaacattcgagccacagaggcagaagggtggcgaccttgatttgttggattggttgagagctatgtttggctttcagcgagatagtgtacggaatcaaagagagcatttgattctcttccttgctaatgtccacattaggctcgagccaaaggccgatccactcagcaagcttgatgaccgagctgttgatgttgtgatgactaagctattcaacaattacaggaagtggtgcaaatttttgtcacggaagcatagtttaagatttcctcaaggcgcacaaccacaggaaattcagcagcggaagattctatacctaggtctttatcttctaatatggggtgaagcagcaaatatcagatttatgccggagtgtctttgctacatcttccataatatggcatatgagctgcatggtctgctagctggaaacgttagtattgtgactggggagaatatcaggccatcttatggtggggatgaggaggcattcttgaagaaagtggttacacctttctatagagtcatcagaaaggaggcaggcaaatcacagcatgggaagacgccacattctgcgtggtctaactatgatgatctaaacgagacatctgattgtttctcacttgggtggcctatgcgggatgatggtgacttcttcaaatccgtgcatgattcaaggcctgctggaagctcaccacaaaaggattccacgaaaagtacggggaagacaaattttgttgagactagaacattttggcacatcttccgaagttttgaccgaatgtggactttctacattttggctctacaggcaatgctgattattgcctggaatgattattcattgactgagatccttcggaaagaccttttgtattctctgtctagtgtatttgtcaccgcagcatttctacagttcctccaaagcattttggacttaattctgaactttcctggcagtcatagatgcaagttcgttgacatcatgagaagtattctgaagatgatagttagtgccgtgtgggctgtggttcttccatttttctacattagcacagcatctaaagtcaacttattaccactcaaggatttaaataaatatctccgttatgtcaaaggggtgccacctctatatatcctggctgtggcagtgtacctaatacctaatatccttagtgcagcactcttcctgtttccaatgttccgaaggtggatagaaaattcagactggcatattgttagactgcttttatggtggtctcagaaacgaatttacgttggccgtggaatgcacgaaagccaagtttcactttttaactactttgtccaaattcaacctctgataaaaccaacaaaggacgtaatgggtgttcataatattaaatatgagtggcatgaattttttccaaatgcatcctataatattggtgccatcatgtcgctctgggctcctgttctattggtctatttaatggatacacagatttggtatgccatcttctctacaatatttggtggcatgactggagcacttgggcgacttggggagatacgaacattgggaatgctgagatcacgattccattctttgcctggagccttcaacacatatttggtgccttcagataaaagcagaaacaggcgcttttcactctcaaagcgctttgctgaggtttctcccaacaagagaactgaagccgccaagtttgctcaattgtggaatgaagtaatatgcagtttccgggaagaagatcttataagtgatagggagatggacttgctagtggttccttattcgtcagaccccagcctcaaattgatgcagtggccgctgttcttgcttgctagcaagatacctatagctttagacatggcagcacaatttagacctagagattcagatctttggaaacgtatatgtgctgatgagtacatgaaatgtgctgtactggaatgttatgagtcattcaaacttgttcttaatttagtggtggttggagaaaatgaaaaaaggattattggtattataatcaaagaaatagaagctaatattggaaagaatacattccttgccaactttagaatgagcgcactcccagttctttgcaagaaatttgtagagcttgtatctaccttgaaagaaagagatgcctcaaagtttgataatgtggtgctgttgcttcaagacatgttagaagtgataacaagagatatgatggttaatgagattagagagctggctgagtttggtcatggtaacaaggattcatcagttccgagaagacagctttttgcgggctctggtacaaagcctgcaattgttttccctcctccggtttcagcacagtgggaagaacagattaagcgactgtacctccttttgactgtgaaagaatctgcaatggacgtcccaacaaatttagaagctcgtcgaagaatagcatttttcactaattcactattcatggacatgccgcgtgcacctagagtacgcaaaatgctctcattcagtgaggaaactgtatattcgaaaagtgatcttgatctggagaatgaagatggtgtatcaattatattctacctacaaaagatctatccagatgaatggaacaatttcatggaaagaattaattgcaaaagagaaagtgaagtatggggaaatgaggaaaatgtcctacaacttcgtcattgggcttctcttagagggcagacactctgtagaacagttagaggcatgatgtactataggagggctttgaagcttcaagcgttcctggacatggcttctgaatgtgaaatattggaagggtataaagcagttgcagatccagcagaggaggagaagaaaagccaaagatctttgtcctctcaactcgaggctgtagcagacatgaaatttacatatgttgctacttgccagatatatggaaatcagaaacaatctggtgatcgacgtgcaacagatatcttgaacttgatggtgaattaccctggtctgcgtgtggcatacattgatgaagtagaagagagagaaggtgacaaggtgcagaaggtcttttattcagttctagtaaaagctctcgacaatcatgatcaggaaatataccgtataaaactgccaggaccagcaaaattaggtgaaggcaaaccggaaaatcaaaaccatgcaatcatttttacacggggtgaagcactccaaactatcgatatgaatcaggacaactatttggaggaggctttgaaaatgcggaatttgctggaagagtttaatgaaaaccatggtgtccgtcaacccacgattcttggagtgcgtgagcatatatttactggaggtgtgtcgtcacttgcatggtttatgagcaaccaggaaaccagctttgtgacaataggacagagggtcctagctaatccattgaaggtacgctttcactatggacatcctgatgtgttcgataggatttttcacattacaagaggaggcatcagcaaggcttcctgtggtataaatttaagtgaagacatttttgctggcttcaactcgactctaagaagaggaaatgtcacccatcatgagtacatccaagtggggaaagggcgtgatgtaggtctcaatcaaatttctctctttgaggccaaagttgcttgcggaaatggggagcagatactcagcagagatatctacaggcttggtcatcgatttgacttcttccggatgctttcgtgctattttacaactgttgggttttatattagctcaatgatggttgtgataatagtttatgttttcttgtacggaagactgtacttagcattaagtggactggagtttgcaattatgaaacaagcacggatgagagggaaccgtgcacttcaagcagctatgggatctcagtctattgtgcagctaggtcttttgatggcattgccaatgtttatggagattgggctagaaagaggtttcagaagtgccctaggggatttcataatcatgcaacttcagctttgttccgtgttcttcactttctcccttgggaccaagtcacattattttggccgcacaattctccatggcggtgcaaaatatagggcaaccggcagaggctttgttgttcgccatgtaaggtttgctgagaattacagaatgtactccagaagccattttgtgaaagcacttgagctgatgttactgctagtagtctatgagttgtatggtgatgttgctacagattcaactgcatatatacttctgacatcatcaatgtggttcttggtcataacttggctattcgctccattcctcttcaatccatcaggatttgagtggcaaaaaatagtagatgactgggatgattggaccaaatggataagcagtcgaggtggcattggggttcctgctaacaaggcttgggaatcctggtgggaagaggagcaggaacatttacagtccacaggtctactgggccgtttctgggaaatcatactatctctcaggttcttcatattccaatacggtatcatgtaccacctgaatatatctgctggcaacaaaagcatctctgtttacggtctttcttggctggttattgttgctgtggtgatggtcctaaaggtggtatccatgggtaggaagaaatttagtgcggatttccagcttatgttccggcttctcaaattgttcttgttcatcggatctgttggaacactggcagttcttttcactgttttgcatcttacagttggtgacatatttgcaagcttccttgcatttgcacccacaggatgggccattctgcagatatctcaagcaagtaaaccggtgatcaaggcatgtgggctgtggggatctgtgaaggccctctcgagggggtacgaatacctgatggggatcgtcatcttcgtcccagtggcggtgctggcatggttcccgtttgtctccgagttccagacgagattgctctttaatcaggcatttagccgagggcttcaaatctctcggatcttggctggcggcaagaaacaaagttga

SEQ ID NO: 19753 - protein, 1925 aa, Sorghum bicolor
  misc_feature: Useful for making plants with altered cell wall content and/or composition
  misc_feature: Functional homolog of the protein sequence given in SEQ ID NO 14737
  misc_feature: Useful for making plants with altered carbohydrate content
  misc_feature: Functional homolog of the protein sequence given in SEQ ID NO 14257
  misc_feature: Ceres ANNOT ID no. 8735428
  misc_feature (1140)..(1498): SWISSPROT Homolog: EC 2.4.1.34 1,3-beta-glucan synthase
  misc_feature (1054)..(1803): Pfam ID: Glucan_synthase Pfam Description: 1,3-beta-glucan synthase component
MTAPRGGGDEPPPPPPSSAAAGHAAGNEPVTPTSALGSGLNRRGSRGAGMATFSMEVFDNEVVPSTLNSIAPILRVAAEIEHERPRVAYLCRFYAFEKAHRLDQNSIGRGVRQFKTALLQRLEKDNSPSLAKRVKKSDAREIESFYQQYYENYVRALDKGEQADRAQLGKAYQTAGVLFEVLCAVNKNEKVEELNPEIIRLHKDVQEKKDIYTPFNILPLDAASASQSIMQLEEIKAAVAALRNIRGLTWPSTFEPQRQKGGDLDLLDWLRAMFGFQRDSVRNQREHLILFLANVHIRLEPKADPLSKLDDRAVDVVMTKLFNNYRKWCKFLSRKHSLRFPQGAQPQEIQQRKILYLGLYLLIWGEAANIRFMPECLCYIFHNMAYELHGLLAGNVSIVTGENIRPSYGGDEEAFLKKVVTPFYRVIRKEAGKSQHGKTPHSAWSNYDDLNETSDCFSLGWPMRDDGDFFKSVHDSRPAGSSPQKDSTKSTGKTNFVETRTFWHIFRSFDRMWTFYILALQAMLIIAWNDYSLTEILRKDLLYSLSSVFVTAAFLQFLQSILDLILNFPGSHRCKFVDIMRSILKMIVSAVWAVVLPFFYISTASKVNLLPLKDLNKYLRYVKGVPPLYILAVAVYLIPNILSAALFLFPMFRRWIENSDWHIVRLLLWWSQKRIYVGRGMHESQVSLFNYFVQIQPLIKPTKDVMGVHNIKYEWHEFFPNASYNIGAIMSLWAPVLLVYLMDTQIWYAIFSTIFGGMTGALGRLGEIRTLGMLRSRFHSLPGAFNTYLVPSDKSRNRRFSLSKRFAEVSPNKRTEAAKFAQLWNEVICSFREEDLISDREMDLLVVPYSSDPSLKLMQWPLFLLASKIPIALDMAAQFRPRDSDLWKRICADEYMKCAVLECYESFKLVLNLVVVGENEKRIIGIIIKEIEANIGKNTFLANFRMSALPVLCKKFVELVSTLKERDASKFDNVVLLLQDMLEVITRDMMVNEIRELAEFGHGNKDSSVPRRQLFAGSGTKPAIVFPPPVSAQWEEQIKRLYLLLTVKESAMDVPTNLEARRRIAFFTNSLFMDMPRAPRVRKMLSFSEETVYSKSDLDLENEDGVSIIFYLQKIYPDEWNNFMERINCKRESEVWGNEENVLQLRHWASLRGQTLCRTVRGMMYYRRALKLQAFLDMASECEILEGYKAVADPAEEEKKSQRSLSSQLEAVADMKFTYVATCQIYGNQKQSGDRRATDILNLMVNYPGLRVAYIDEVEEREGDKVQKVFYSVLVKALDNHDQEIYRIKLPGPAKLGEGKPENQNHAIIFTRGEALQTIDMNQDNYLEEALKMRNLLEEFNENHGVRQPTILGVREHIFTGGVSSLAWFMSNQETSFVTIGQRVLANPLKVRFHYGHPDVFDRIFHITRGGISKASCGINLSEDIFAGFNSTLRRGNVTHHEYIQVGKGRDVGLNQISLFEAKVACGNGEQILSRDIYRLGHRFDFFRMLSCYFTTVGFYISSMMVVIIVYVFLYGRLYLALSGLEFAIMKQARMRGNRALQAAMGSQSIVQLGLLMALPMFMEIGLERGFRSALGDFIIMQLQLCSVFFTFSLGTKSHYFGRTILHGGAKYRATGRGFVVRHVRFAENYRMYSRSHFVKALELMLLLVVYELYGDVATDSTAYILLTSSMWFLVITWLFAPFLFNPSGFEWQKIVDDWDDWTKWISSRGGIGVPANKAWESWWEEEQEHLQSTGLLGRFWEIILSLRFFIFQYGIMYHLNISAGNKSISVYGLSWLVIVAVVMVLKVVSMGRKKFSADFQLMFRLLKLFLFIGSVGTLAVLFTVLHLTVGDIFASFLAFAPTGWAILQISQASKPVIKACGLWGSVKALSRGYEYLMGIVIFVPVAVLAWFPFVSEFQTRLLFNQAFSRGLQISRILAGGKKQS

SEQ ID NO: 19754 - DNA, 546 bp, Sorghum bicolor
  misc_feature: Ceres ANNOT ID no. 8735423
  misc_feature: Encodes the peptide sequence at SEQ ID NO 19755
atggcgcggccacagcaacggtaccgcggcgtgcggcaacgccactggggatcctgggtctccgagatccgccaccccctcctgaagacaaggatctggctgggcaccttcgagacggccgaggacgcggcgcgcgcctacgacgaggcggcgcgcatcatgtgcggcccgcgcgtgcgcaccaacttccccgaggacgccgcaggcgccggcgacgggcagcagcagcagcaagccgcgtcgtcgttcctctcccccgcgctcgtcgccaagctccaccgcttcaacctcgcgtccgtgcaggcggcgcgcggcaaggccgacgctgcctcggccgcagccgcctcggcgcccgccgtgctcccgcgcatcgcggcgatgcctgccggcaatgccgccatgggaggaatcgccccctcgccgccgccgccgccgtcgtcgtcgtcggcaggagactggagcggcgggtttcttgaggagcagtacgtggaccagatgatcgaggagcttctagactccaacttctccatggagatctcctactag

SEQ ID NO: 19755 - protein, 181 aa, Sorghum bicolor
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 14579
  misc_feature: Ceres ANNOT ID no. 8735423
  misc_feature (6)..(57): Pfam ID: AP2 Pfam Description: AP2 domain
MARPQQRYRGVRQRHWGSWVSEIRHPLLKTRIWLGTFETAEDAARAYDEAARIMCGPRVRTNFPEDAAGAGDGQQQQQAASSFLSPALVAKLHRFNLASVQAARGKADAASAAAASAPAVLPRIAAMPAGNAAMGGIAPSPPPPPSSSSAGDWSGGFLEEQYVDQMIEELLDSNFSMEISY

SEQ ID NO: 19756 - DNA, 1980 bp, Sorghum bicolor
  misc_feature: Ceres ANNOT ID no. 8735436
  misc_feature: Encodes the peptide sequence at SEQ ID NO 19757
atggaggagaagggggcgatcacggggaggagggagcgggatcagttccccgtcggcatgcgggtcctcgccgtcgacgacgaccccgtctgcctcaaggtgctcgagaccctgctgcggcgctgccagtatcatgtaacgacgaccaaccaggccatcactgcgctgaagatgctaagggagaacagggatacgtatgatctggttatcagtgacgttcacatgcccgacatggacgggttcaagctccttgagcttgtagggcttgagatggacctacctgtcatcatgttatcagtgaatggggagacgaaatctgtgatgaaggggataactcatggcgcctgtgactacctcctaaaacctgttcgtatcgaagagcttaggaacatatggcagcatgttgtcagaaggaagttcagcaagcgcgagcgcagcaatctcgatatctataaagatttcaacaagttaccaagcgcggatccatgccacggccacaatcagatcactgctggggcttctgaccagagtgggaggatcagcaagaagaggaaggaaatgcatagcgacgaggaagatgacggcgaggagaatgatttccaagaaggtgatgaaccctcggctgctaagaagccaagagttgtttggtcagttgaactgcaccggaaatttgttgcggctgtcaaccagcttggaattgataaagctgtaccgaaaagaattcttgagcttatgaatgtggagaaactcaccagggaaaatgtcgcgagccatctacagaaatacaggctctatctcaaacggttaagtgctgtggcgtcacaacaagctagtattgtcgccgcttttggaggtagagaccccgcatttcttcacatgggagcctttgaaggccttcagagttatcaaccttttgccccctgtgctgctctatcatccttcagcccacacggcttgctaggtagaactagcgctgcaacattcggggtcccagaacttgctcctgccatgacagttcaaactgctaccaacaatggcataataagtcactgtgctggtgatgcaaacgattttcaactctctggtttacaagaaaaccaacaggcaaatttgggacaaggctcggccacatctcttgggctgccccaactccaacagaagtggatccagcaagaaactaatgatttatctgctgtcttttctgggagtgcactggctaacactctgtctggtgcactccagagagttacaagcagtccattgccaccacaagaacttttggagagcgcacaaagcaaagttagcgcccagccaccaataacaaggccatctgtgactgtgagttcagaactggttgaaaggactgttggagtttcggctaatttgcaggactctagtatatcccagcagggtgctcttccaataaatgatggatttactgctgacaagttacaattgcatgatccatttgatagcattggtggaacaaaattttcggtaaccatgcctgtttgttcttctggtagccttacagcatccagcaataccaagggtggtgctagttcttgcagtacagtgctgctcgctcctgatactgggagacatccaaactacttgcagtttggagttgcaggcaactctagacatgacatgaatgaaattaaacaggaccatctacatcaaggattgagcactggaggtttcaaccataattttggcgcctgtatgactgaacagccaaatccaaatgtgtcatatcttatgccacaagtgaagcctaacaccatggcatcagaagataaactaaagcagaggaatgcttatgatttggggattccaaagctcaatggtggttttagctctagtagctgcaattttgatggtcttctcaattccatgatcaaagcggagaaggatgatctctcattcacggataacgacttggggtgcgacttctttccacttggtgcttgcatatga

SEQ ID NO: 19757 - protein, 659 aa, Sorghum bicolor
  misc_feature: The sequence is a functional homolog of SEQ ID NO 936 in the 10/666,642 US patent application
  misc_feature: The sequence is a functional homolog of SEQ ID NO 172 in the 10/666,642 US patent application
  misc_feature: The sequence is a functional homolog of SEQ ID NO 2510 in the 10/374,780 US patent application
  misc_feature: The sequence is a functional homolog of SEQ ID NO 686 in the 10/412,699 US patent application
  misc_feature: The sequence is a functional homolog of SEQ ID NO 976 in the 10/225,066 US patent application
  misc_feature: The sequence is a functional homolog of SEQ ID NO 1452 in the 11/479,226 US patent application
  misc_feature: The sequence is a functional homolog of SEQ ID NO 148 in the 10/225,066 US patent application
  misc_feature: The sequence is a functional homolog of SEQ ID NO 2512 in the 10/374,780 US patent application
  misc_feature: The sequence is a functional homolog of SEQ ID NO 688 in the 10/412,699 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
  misc_feature: Ceres ANNOT ID no. 8735436
  misc_feature: Up-regulated in shoot tissues in response to salicylic acid treatment
  misc_feature (20)..(133): Pfam ID: Response_reg Pfam Description: Response regulator receiver domain
  misc_feature (213)..(263): Pfam ID: Myb_DNA-binding Pfam Description: Myb-like DNA-binding domain
MEEKGAITGRRERDQFPVGMRVLAVDDDPVCLKVLETLLRRCQYHVTTTNQAITALKMLRENRDTYDLVISDVHMPDMDGFKLLELVGLEMDLPVIMLSVNGETKSVMKGITHGACDYLLKPVRIEELRNIWQHVVRRKFSKRERSNLDIYKDFNKLPSADPCHGHNQITAGASDQSGRISKKRKEMHSDEEDDGEENDFQEGDEPSAAKKPRVVWSVELHRKFVAAVNQLGIDKAVPKRILELMNVEKLTRENVASHLQKYRLYLKRLSAVASQQASIVAAFGGRDPAFLHMGAFEGLQSYQPFAPCAALSSFSPHGLLGRTSAATFGVPELAPAMTVQTATNNGIISHCAGDANDFQLSGLQENQQANLGQGSATSLGLPQLQQKWIQQETNDLSAVFSGSALANTLSGALQRVTSSPLPPQELLESAQSKVSAQPPITRPSVTVSSELVERTVGVSANLQDSSISQQGALPINDGFTADKLQLHDPFDSIGGTKFSVTMPVCSSGSLTASSNTKGGASSCSTVLLAPDTGRHPNYLQFGVAGNSRHDMNEIKQDHLHQGLSTGGFNHNFGACMTEQPNPNVSYLMPQVKPNTMASEDKLKQRNAYDLGIPKLNGGFSSSSCNFDGLLNSMIKAEKDDLSFTDNDLGCDFFPLGACI

SEQ ID NO: 19758 - DNA, 1014 bp, Sorghum bicolor
  misc_feature: Ceres ANNOT ID no. 8735461
  misc_feature: Up-regulated in shoot tissues in response to salicylic acid treatment
  misc_feature: Encodes the peptide sequence at SEQ ID NO 19759
atgaccgtcgtgggaggcgacgacgcggcggcggcggcggcgggacgcgggcagacgacgacggtgtgcgtgaccggcgccggcggctacgtcgggtcgtggatcgtcaagctcctgctcgagaggggggcagacgacgcgaagaacgcgcacctgagggcgcttcccggcgcgacggagaggctggcgctgtgcaaggccgatctgctcgactacgacacgctgcgggcggccatcgctggctgccacggcgtcttccataccgcgtcgcccgttaccgacgatccagaggaaatggtggagccagcggtgacagggacgcgctacatcatcgacgccgcggccgaggccggcacggtccgccgcgtcgtcctgacctcgtccatcggcgcggtcgccatggatcccaaccgctcgccggacgccgtcgtcgacgagtcgtgctggagcgacctcgacttctgcaagaagaccaagaactggtactgctacgggaaggcggtggcggagcaggcggcgtgggaggaggcggcggcgcgcggggtggacctggtggtggtgaacccggtgctggtgcaggggccggcgctgcagccgtcggtgaacgccagcctgatgcacgtgctcaagtacctgaacggctccgccaagacgtacgccaacgccgtgcaggcgtacgtgcacgtccgcgacgccgccgacgcgcacgtccgcgtcttcgaggcgccgcacgccgccggccggtacatctgcgccgacggcgccgtgctccaccgcgaggacgtcgtcaggacgctccgcaagttcttcccggactaccccgtcccggaaaggtgctctgatgaggtgaacccaaggaagcagccgtacaagatatccaaccagaagctgagggacttgggcttggagttcacgccggcggcgcaggccctgtacgacaccgtcatatgcttccaggagaagggcatcatccctatccctgccccaacgccgtcgccgtcgccggaggcctga

SEQ ID NO: 19759 - protein, 337 aa, Sorghum bicolor
  misc_feature: Useful for making plants with altered carbohydrate content
  misc_feature: Functional homolog of the protein sequence given in SEQ ID NO 14118
  misc_feature: Useful for making plants with altered cell wall content and/or composition
  misc_feature: Useful for making plants with altered lignin content
  misc_feature: Functional homolog of the protein sequence given in SEQ ID NO 13818
  misc_feature: Ceres ANNOT ID no. 8735461
  misc_feature (21)..(322): SWISSPROT Homolog: EC 1.1.1.219 Dihydrokaempferol 4-reductase
  misc_feature (22)..(252): Pfam ID: Epimerase Pfam Description: NAD dependent epimerase/dehydratase family
MTVVGGDDAAAAAAGRGQTTTVCVTGAGGYVGSWIVKLLLERGADDAKNAHLRALPGATERLALCKADLLDYDTLRAAIAGCHGVFHTASPVTDDPEEMVEPAVTGTRYIIDAAAEAGTVRRVVLTSSIGAVAMDPNRSPDAVVDESCWSDLDFCKKTKNWYCYGKAVAEQAAWEEAAARGVDLVVVNPVLVQGPALQPSVNASLMHVLKYLNGSAKTYANAVQAYVHVRDAADAHVRVFEAPHAAGRYICADGAVLHREDVVRTLRKFFPDYPVPERCSDEVNPRKQPYKISNQKLRDLGLEFTPAAQALYDTVICFQEKGIIPIPAPTPSPSPEA

SEQ ID NO: 19760 - DNA, 561 bp, Sorghum bicolor
  misc_feature: Ceres ANNOT ID no. 8735503
  misc_feature: Encodes the peptide sequence at SEQ ID NO 19761
atggcccgcttgtacgtcggcaacctggatccccgggtgaccgctcgggagctggaggacgagttccgcacgttcggggttcttcgcagtgtttgggtggctcggaaaccacctggctttgcatttattgattttgatgataagagggatgctgaggatgcaatccgtgacctagatggcaagaatggatggagagttgagctatctcgtaatgccagcagtggtcgtggtggccgtgaccgatatggtggttctgagtccaagtgttacgagtgtggtgagactggccactttgctcgtgagtgccgtttgaggattggttctggaggtctaggcagtggaaggcgccgaagccgtagccgcagccgcagccgcagtcgtagtcccagatatcgccggagtccaagttatggtagaaggagttacagtcctgcagcacgctctccaaggcgtcgtagcgtgtcaccagctcgtgggcgcagctatagcaggtcaccacagtacaaacgtgcacgagaagactctccctatgataatggataccgccgcagcaggagctag

SEQ ID NO: 19761 - protein, 186 aa, Sorghum bicolor
  misc_feature: Useful for making plants with modulated flowering time
  misc_feature: Functional homolog of the protein sequence given in SEQ ID NO 13547
  misc_feature: Ceres ANNOT ID no. 8735503
  misc_feature (4)..(59): SWISSPROT Homolog: EC 5.2.1.8 Peptidylprolyl isomerase
  misc_feature (4)..(70): Pfam ID: RRM_1 Pfam Description: RNA recognition motif. (a.k.a. RRM, RBD, or RNP domain)
  misc_feature (87)..(104): Pfam ID: zf-CCHC Pfam Description: Zinc knuckle
MARLYVGNLDPRVTARELEDEFRTFGVLRSVWVARKPPGFAFIDFDDKRDAEDAIRDLDGKNGWRVELSRNASSGRGGRDRYGGSESKCYECGETGHFARECRLRIGSGGLGSGRRRSRSRSRSRSRSPRYRRSPSYGRRSYSPAARSPRRRSVSPARGRSYSRSPQYKRAREDSPYDNGYRRSRS

SEQ ID NO: 19762 - DNA, 1323 bp, Sorghum bicolor
  misc_feature: Ceres ANNOT ID no. 8735497
  misc_feature: Encodes the peptide sequence at SEQ ID NO 19763
atgcgagtgctggaggaggacctgtacccgtcgacgccggggaaggtgaaggtggagcggccgggcgcgatgagccgtcacctgcaccgctgcttcgcgtccacggggaccatgttcctgtgggcgctcttcctggtcgccatgacggccacctacctcagcgtccactccttcgtcgacacctcctcccgctacttcgccgcgtcctggggcggccttcactgggagcgccagatccgcgcgtcggcgtcgccgcggcggccccccgggtccgccgagggcgccgggctgtccgtgctcgtcacgggcgccgcgggcttcgtcggcacgcactgctcgctggcgctccgcaagcgcggcgacggcgtggtgggcatcgacaacttcaacaactactacgacccgtccctcaagaaggcccgccgcgcgctgctgggctcccacggcgtgttcgtcgtggagggcgacatcaacgacggccgcctcctggccaagctcttcgacgtcgtgcccttcacgcacgtgctccacctggcggcgcaggccggcgtgcgctacgccatggagaacccggcgtcgtacgtgcactccaacatcgccggcctcgtctccctcctcgaggcctgcaaggacgccgacccgcagccggccgtcgtgtgggcgtcctcctcctccgtctacggcctcaacgaccgcgtccctttctcggaggcgcaccgcaccgacaggccggcgtcgctctacgccgccaccaagaaggccggcgaggagatcacccacacctacaaccacatctacggcctctccgtcaccggcctccgcttcttcaccgtgtacgggccgtggggacgccccgacatggcctacttctccttcacacgcaacatcctccaggggaagcccatcacggtgtacaggggcagagaccacgtcgccctcgccagggacttcacctacatcgacgacatcgtgcgcggctgcctggcgtcgctggacacggcggggcggagcaccggcacgggcggcaagaagcgggggccggcgcagtaccggatcttcaacctcgggaacacgtcgccggtcacggtgcccacgctggtggccatcctggagaggtacctgagggtgaaggccaagaagaacgtggtggagatgcccggcaatggcgacgtgccctacacgcacgccaacatcagcctggcacgggaggagctcgggtacaagccgacgacgagcctggagatggggttgaagaagttcgtcaggtggtacctctcctactacggatacaacaggggaacacataccttcaggaactcatga

SEQ ID NO: 19763 - protein, 440 aa, Sorghum bicolor
  misc_feature: Useful for making plants with altered carbohydrate content
  misc_feature: Functional homolog of the protein sequence given in SEQ ID NO 14576
  misc_feature: Useful for making plants with altered cell wall content and/or composition
  misc_feature: Functional homolog of the protein sequence given in SEQ ID NO 14577
  misc_feature: Ceres ANNOT ID no. 8735497
  misc_feature (1)..(431): SWISSPROT Homolog: EC 5.1.3.6 UDP-glucuronate 4-epimerase
  misc_feature (99)..(356): Pfam ID: Epimerase Pfam Description: NAD dependent epimerase/dehydratase family
MRVLEEDLYPSTPGKVKVERPGAMSRHLHRCFASTGTMFLWALFLVAMTATYLSVHSFVDTSSRYFAASWGGLHWERQIRASASPRRPPGSAEGAGLSVLVTGAAGFVGTHCSLALRKRGDGVVGIDNFNNYYDPSLKKARRALLGSHGVFVVEGDINDGRLLAKLFDVVPFTHVLHLAAQAGVRYAMENPASYVHSNIAGLVSLLEACKDADPQPAVVWASSSSVYGLNDRVPFSEAHRTDRPASLYAATKKAGEEITHTYNHIYGLSVTGLRFFTVYGPWGRPDMAYFSFTRNILQGKPITVYRGRDHVALARDFTYIDDIVRGCLASLDTAGRSTGTGGKKRGPAQYRIFNLGNTSPVTVPTLVAILERYLRVKAKKNVVEMPGNGDVPYTHANISLAREELGYKPTTSLEMGLKKFVRWYLSYYGYNRGTHTFRNS

SEQ ID NO: 19764 - DNA, 1419 bp, Sorghum bicolor
  misc_feature: Ceres ANNOT ID no. 8735532
  misc_feature: Encodes the peptide sequence at SEQ ID NO 19765
atggcgcccgccgcgtcatccccgccgccgcacgtggcagtggttgccttccccttcagctcccacgcggcggtgatgctctccttcgcgcgcgccctggccgccgccgccgcgccgttcggggccacgctctcgttcctctccaccgcgtcctccctcgcgcacctccgcaaggccagcggcggcgccggcggctccgcggggaacgggctcccgatgaacctgcgcttcgttgaggtccccgacggcgcgcccgtggccgcggccggggaaaccgtgccggtgccgcggcagatgcagctgttcatggcggccgcggaggccggcggggtgaaggccggcctggaggcggcccgcgtcgcggcgggcggcgccagggtgagctgcgtggtgggcgacgcgttcgtgtggccggcggctgacgcggccgcctcggccggggcgccgtgggtgcctgtgtggacggccgcgtcgtgcgcgctcctggcgcacctccgcaccgacgcgctccgagaggacgtcggcgatcaggccgcgaaaatggcggacgagctgctgatctcccacccgggcctcgccaggtaccgcgtccgtgacctccccgacggcgtcgtctccggcgacttcaactacgtcatcaacctcctcctgcaccgcatggggcagcgcctcccgcgctccgccgccgccgtcgcgctcaacgccttcccgggcctggacccgcccgaagtcaccgcggcgctcgcggagatcctgccgaactgcctcccgttcggcccctaccacctgctcctccccaaggacgacggcgtcgacaccgccgacccgcacggctgcctggcctggctggaccgccaccccgcgcgcggcgtcgcgtacgtgagcttcggcacggtggcgtccccgcggcccgacgagctccgcgagctggcggccgggctggagtcctcgggctcgccgttcctgtggtcgctgcgcgaggactcgtggccgctcctcccgccggggttcctggaccgcatcgccagcgccgggtccgggctcgtggtgccctgggcgccgcaggtggccgtgctgcgccacccttccgtgggcgcgttcgtgacgcacgccgggtgggcgtcggtgctggagggcgtgtccagcggggtacccatggcgtgccgcccgttcttcggcgaccagcggatgaacgcgcggtccgtggcgcacgtgtgggggttcggcgccgcgttcgaggcgggcatgacgcgcgacggggtggccgccgccgtggaggagctgctgcgcggggaggaaggcgcgcggatgagggccagggcgcaggagctgcaggccgcggtggccgacgcgttcggccccggcggcgcgtgcaggaagaacttcgacaagttcgtccagatagtttgtcgcgcgtga

SEQ ID NO: 19765 - protein, 472 aa, Sorghum bicolor
  misc_feature: Useful for making plants with modulated flowering time
  misc_feature: Functional homolog of the protein sequence given in SEQ ID NO 14375
  misc_feature: Useful for making plants with altered carbohydrate content
  misc_feature: Functional homolog of the protein sequence given in SEQ ID NO 14374
  misc_feature: Ceres ANNOT ID no. 8735532
  misc_feature (71)..(472): SWISSPROT Homolog: EC 2.4.1.115 Anthocyanidin 3-O-glucosyltransferase
  misc_feature (24)..(472): Pfam ID: UDPGT Pfam Description: UDP-glucoronosyl and UDP-glucosyl transferase
MAPAASSPPPHVAVVAFPFSSHAAVMLSFARALAAAAAPFGATLSFLSTASSLAHLRKASGGAGGSAGNGLPMNLRFVEVPDGAPVAAAGETVPVPRQMQLFMAAAEAGGVKAGLEAARVAAGGARVSCVVGDAFVWPAADAAASAGAPWVPVWTAASCALLAHLRTDALREDVGDQAAKMADELLISHPGLARYRVRDLPDGVVSGDFNYVINLLLHRMGQRLPRSAAAVALNAFPGLDPPEVTAALAEILPNCLPFGPYHLLLPKDDGVDTADPHGCLAWLDRHPARGVAYVSFGTVASPRPDELRELAAGLESSGSPFLWSLREDSWPLLPPGFLDRIASAGSGLVVPWAPQVAVLRHPSVGAFVTHAGWASVLEGVSSGVPMACRPFFGDQRMNARSVAHVWGFGAAFEAGMTRDGVAAAVEELLRGEEGARMRARAQELQAAVADAFGPGGACRKNFDKFVQIVCRA

SEQ ID NO: 19766 - DNA, 1083 bp, Sorghum bicolor
  misc_feature: Ceres ANNOT ID no. 8735570
  misc_feature: Encodes the peptide sequence at SEQ ID NO 19767
atgaactcatggctgacgagaagccccgtaactccggaagccagttcagttcgaatggctgctgaatcagagcacggcaactgcaatgcttgggcagcgagagatccttctggagttctctcaccatacagctttaaccgcagaccagtgcaaagcagcgatgttgcgttgaagatcttatactgtggagtctgttatgctgacgttgtctggacacggaatatgcaccatgattcaaaatatcctgtggttcctgggcatgagatagctggagtcgtaactcaggttggtgcagatgtcaaaggctttaaagtgggtgaccatgtaggtgttggaacttatgtgaactcatgccgagattgtgagaactgcaatagctctctagagaaccactgtccaaaaggagtttatactttcaatggcattgatacagatggaactgtcacaaaggggggttactccactcacattgtagtccatgaaaggtattgcttccaaatacctgatggctatcctttggcgaaggcagcacctcttctgtgtgctggaataactgtgtatactccaatgatgcgacacaacatgaaccaacctggaaagtcacttggggtcattggactcggtggtctaggtcacatggcagtgaaatttggtaaagcatttggtctgaaggtcacagttttgagtacaagtgaatcaaagagacatgaagccatcagcctccttggagcggataattttgttatatcatcagatacacagcagatggagtccctgagaaactccctgcacttcatagttgacaccgcttctggcgaccatccatttgatccatatctctctctccttatggttggtggtgtgatggcaattgtgggctttccaagtgcacggaccttgtctggtagtgttactggaggtacaaaagacatccaagaaatggttaacttctgtgcggcgaacaaaatctctccagagattgagatcattaagatagattatatcaatgaggctctcacgaggcttgttaaccgagatgtgaaataccgctttgttatcgacatcgagaactctttcaagtaa

SEQ ID NO: 19767 - protein, 360 aa, Sorghum bicolor
  misc_feature: Useful for making plants with altered cell wall content and/or composition
  misc_feature: Functional homolog of the protein sequence given in SEQ ID NO 13798
  misc_feature: Ceres ANNOT ID no. 8735570
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (22)..(358): SWISSPROT Homolog: EC 1.1.1.195 Cinnamyl-alcohol dehydrogenase
  misc_feature (52)..(167): Pfam ID: ADH_N Pfam Description: Alcohol dehydrogenase GroES-like domain
  misc_feature (198)..(320): Pfam ID: ADH_zinc_N Pfam Description: Zinc-binding dehydrogenase
MNSWLTRSPVTPEASSVRMAAESEHGNCNAWAARDPSGVLSPYSFNRRPVQSSDVALKILYCGVCYADVVWTRNMHHDSKYPVVPGHEIAGVVTQVGADVKGFKVGDHVGVGTYVNSCRDCENCNSSLENHCPKGVYTFNGIDTDGTVTKGGYSTHIVVHERYCFQIPDGYPLAKAAPLLCAGITVYTPMMRHNMNQPGKSLGVIGLGGLGHMAVKFGKAFGLKVTVLSTSESKRHEAISLLGADNFVISSDTQQMESLRNSLHFIVDTASGDHPFDPYLSLLMVGGVMAIVGFPSARTLSGSVTGGTKDIQEMVNFCAANKISPEIEIIKIDYINEALTRLVNRDVKYRFVIDIENSFK

SEQ ID NO: 19768 - DNA, 1821 bp, Sorghum bicolor
  misc_feature: Ceres ANNOT ID no. 8735548
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 19769
atggcgcccgtgacgttctcaccgccgctcctcctcctcgccatccttctcctcaccaccgccggcacaactcaatgccacggtcacggtcacggccacaatcacaagagccagcgccaccacaccggcggaactagaatgcccaaaaagaccgccgcggcgagcgccagcagccctccggccgacaccgtccaccacgccatctgccacacgacgccgcacccggtgtcctgcctggtggccgttgcctcgcaccttgatgccgccgtcgccggcgcgaaggtggccgaggcgtccgctgtctctgtacagctcctcccgccgaacgtgctctccgtcgtgctggcgtccctccacggggcggagtcggcgctgtcgtcgctctccccgacgctctccgctctctccgcgccgcccgccgcctcccccgtgcccgcgggcgcctcgctccgccgcggcgccgcgcaggactgccaggagctccacgccgccacgctgtcgtcgctctcgcgttccgcgtcgctgctcgccgcggcgcccggcgccgagggcctccccgccgtgcgcgcgcacctcgcggccgcgctcaccaacaaggccacctgcctcgacgggctcgccggcgcgtccggcccgcggctcggcggcctcctcgcgtccctcgacgacgcgtacgagcatgtctccaactcgctcgccctcgtcgccggtcgcggcgtgtctgctgctggcttcgtgaacgccgtggcgaagacaattcacaaccggcggcttctccaggacgacgacggcagcggcggagacgacgatgacagcggcggagatgacgacgacaatgacggggatgacagcggtgggaacaccgggcagccggcggcgacggtgatcactgtggctaaggatgggtcggggaacttccggaccgtgggggaagcggtggcggcggcgccgaacagcagcgagacgaggacggtgatccacgtgaaggccgggacgtacgaggagaacgtggaggttccgccgtacaagaagaacatcgccctggtcggcgaagggcgcgacacgacggtcatcaccggcagccgcagcgccgccgacggctggaccacctttcgctcggccactttcggcgtctccggcgagggtttcctggcgcgcgacatcacgttccgcaacacggcgggcgcggccaggggccaggcggtggcgctgcgggtgaacgcggaccttgccgcgctgtaccgctgcggcgtggacgcccaccaggacgcgctgtacgcgcactcgttccggcagttctaccgcgagtgcgccgtgtccggcaccgtcgacgtcgtcttcggcgacgccgccgccgtgctgcaggcctgctcgctcctcgccagggtccccctgccgggccagtccgtcgtgctcacggcgcagggccgcgccgaccccaacgaggacaccggcatcgcgctgcaccactgcaccgtcgtctccgccgccggcggcggcctgcccgccggcacgcgcacgttcctgggccggccgtggggcgcgtacgcgcgcgccgtggtgatggactcctacctgggccaggtcgtggaccgggaagggtggctcgagtggcccggcgcggagcccagtcgccgggacacggtgtacttcggcgagtacgggaacgacgggccgggcgccgacacggagggccgcgtggactgggctggagtgcggcagatggagtacgacgaggcggcccagttcgccgtcgagaacttcatctacggcgacgagtggctgggcgccacctccttcccctacgatgacgacgtctga

SEQ ID NO: 19769 - protein, 606 aa, Sorghum bicolor
  misc_feature: Useful for making plants with altered carbohydrate content
  misc_feature: Functional homolog of the protein sequence given in SEQ ID NO 14738
  misc_feature: Useful for making plants with altered cell wall content and/or composition
  misc_feature: Functional homolog of the protein sequence given in SEQ ID NO 14739
  misc_feature: Ceres ANNOT ID no. 8735548
  misc_feature (296)..(602): SWISSPROT Homolog: EC 3.1.1.11 Pectinesterase
  misc_feature (295)..(592): Pfam ID: Pectinesterase Pfam Description: Pectinesterase
  misc_feature (58)..(234): Pfam ID: PMEI Pfam Description: Plant invertase/pectin methylesterase inhibitor
MAPVTFSPPLLLLAILLLTTAGTTQCHGHGHGHNHKSQRHHTGGTRMPKKTAAASASSPPADTVHHAICHTTPHPVSCLVAVASHLDAAVAGAKVAEASAVSVQLLPPNVLSVVLASLHGAESALSSLSPTLSALSAPPAASPVPAGASLRRGAAQDCQELHAATLSSLSRSASLLAAAPGAEGLPAVRAHLAAALTNKATCLDGLAGASGPRLGGLLASLDDAYEHVSNSLALVAGRGVSAAGFVNAVAKTIHNRRLLQDDDGSGGDDDDSGGDDDDNDGDDSGGNTGQPAATVITVAKDGSGNFRTVGEAVAAAPNSSETRTVIHVKAGTYEENVEVPPYKKNIALVGEGRDTTVITGSRSAADGWTTFRSATFGVSGEGFLARDITFRNTAGAARGQAVALRVNADLAALYRCGVDAHQDALYAHSFRQFYRECAVSGTVDVVFGDAAAVLQACSLLARVPLPGQSVVLTAQGRADPNEDTGIALHHCTVVSAAGGGLPAGTRTFLGRPWGAYARAVVMDSYLGQVVDREGWLEWPGAEPSRRDTVYFGEYGNDGPGADTEGRVDWAGVRQMEYDEAAQFAVENFIYGDEWLGATSFPYDDDV

SEQ ID NO: 19770 - DNA, 909 bp, Sorghum bicolor
  misc_feature: Ceres ANNOT ID no. 8735587
  misc_feature: Encodes the peptide sequence at SEQ ID NO 19771
atggctgctacaagtcactgcggcaacatccaggaccaggacgaagaagcttcggctcctggcgccgccgacctctacgccgtgctcgggctcaacagggagtgcaccgacgccgagctcagggtcgcgtaccggcggctcgccatgatatggcatccggacaggtgctcggcgtccggcagctcgccggcgcgcatggaggaggccaaggagcggttccaggagatccagggcgcctactccgtgctctccgactccaacaagcggctcctctacgacgtcggcgtctacgacagcgacgacgacgaggctgacctgtcggggatgggcgacttcctcggagagatggccgacatgatgagccaggccacgccaacggagaccttcgaggagctgcagcaggtgttcgtggacatgttccaggacgacctggacgacgccggcttcttcggcgggcttccgacgacgggccgcagggcccaggcacccagcacctcgctgccgccgtcggtgtcgtcgtcgccgttgcggccgacgcctgccgctggaagaagcaagggtccgcaagcgacgccgtcgtcgtcgtttaaaggcgtcgagaggcggggttcgacgtcgacggcgaaacggccgaggcccaacgggtcggcgggcctggaatcggacctgggcctctccggattctgcttcatgacggtaatgacagtactatcttccgtgcaggtgagtaaggagatgagcaagtcgaaggagaggcaagcggtatgggccagtgacgacggtgacaggagcaccgatggcaagcagaggttgtcgacgagccgcgatgtctccggtggtgggatgtcacgctcactgcagggccaaagcagcaaaaacttgttgcagtgtatggcctctaagtcttga

SEQ ID NO: 19771 - protein, 302 aa, Sorghum bicolor
  misc_feature: Useful for making plants with modulated nitrogen use efficiency
  misc_feature: Functional homolog of the protein sequence given in SEQ ID NO 14740
  misc_feature: Ceres ANNOT ID no. 8735587
  misc_feature (24)..(93): Pfam ID: DnaJ Pfam Description: DnaJ domain
MAATSHCGNIQDQDEEASAPGAADLYAVLGLNRECTDAELRVAYRRLAMIWHPDRCSASGSSPARMEEAKERFQEIQGAYSVLSDSNKRLLYDVGVYDSDDDEADLSGMGDFLGEMADMMSQATPTETFEELQQVFVDMFQDDLDDAGFFGGLPTTGRRAQAPSTSLPPSVSSSPLRPTPAAGRSKGPQATPSSSFKGVERRGSTSTAKRPRPNGSAGLESDLGLSGFCFMTVMTVLSSVQVSKEMSKSKERQAVWASDDGDRSTDGKQRLSTSRDVSGGGMSRSLQGQSSKNLLQCMASKS

SEQ ID NO: 19772 - DNA, 1077 bp, Sorghum bicolor
  misc_feature: Ceres ANNOT ID no. 8735563
  misc_feature: Encodes the peptide sequence at SEQ ID NO 19773
atgtgcggcggcgccatcctgtcggacatcatcccgccgccgccgcggcgggtcacggcgggccacctctggccggagagcaagaagccgaggaggggcgccggggccggaaggaggagggccgggccccccgtggaggaggaggaggaggaggaggacttcgaggccgacttcgaggtgttcgaggtggagtccggcgagtcggagctcgagtccgaggatgaggccaagcccttcgccgcccccaggaccaggagcgcgctccccagagatggattaaacactagtgcagttgttgttgatggccctgctgcaaattcagttaaaaggaagaggaagaaccagtttaggggtatccgccggcgcccatggggtaaatgggctgctgagatcagagatcctcgcaaaggtgttcgtgtttggcttggtactttcaactctcccgaagaagctgccagggcttatgatgctgaggcacgcaggatccgtggcaagaaggctaaagtcaacttcccagatgaggtttcgacgattcctcagaagcaccgtgctggtcctacccctctgaaagtgcctgagatggactttgaagagaagccgattatcaagccggcagtcaacaacatgaccaactcaaatgcatatcactaccctgttgtcgaccacaacatacccgagccatttatgcatactcaaaacatgtcatttgctcctttcgtgaattctgctgctcccattcaggaacctttcgtgaacctgtcctcagaccaaggtagcaactccttcagttgctcagacttcagcctcgagaatgacaccaggacccctgacataacgtcggtagttgttggtgagtctgcgttcgtccagaacactggtcctgctgtggtgcctccgttgatggggaatgctagtgttgatctcacagagttggatccatatatgaatttcctgatggacagtggttcagaggactcaatcaacactcttttgagctgtgatggatcccaggatgtggttagcaacatggacctttggagctttgatgacatgcccatgtctgctggtttctactga

SEQ ID NO: 19773 - protein, 358 aa, Sorghum bicolor
  misc_feature: Useful for making plants with altered lignin content
  misc_feature: Functional homolog of the protein sequence given in SEQ ID NO 13219
  misc_feature: Ceres ANNOT ID no. 8735563
  misc_feature (114)..(165): Pfam ID: AP2 Pfam Description: AP2 domain
MCGGAILSDIIPPPPRRVTAGHLWPESKKPRRGAGAGRRRAGPPVEEEEEEEDFEADFEVFEVESGESELESEDEAKPFAAPRTRSALPRDGLNTSAVVVDGPAANSVKRKRKNQFRGIRRRPWGKWAAEIRDPRKGVRVWLGTFNSPEEAARAYDAEARRIRGKKAKVNFPDEVSTIPQKHRAGPTPLKVPEMDFEEKPIIKPAVNNMTNSNAYHYPVVDHNIPEPFMHTQNMSFAPFVNSAAPIQEPFVNLSSDQGSNSFSCSDFSLENDTRTPDITSVVVGESAFVQNTGPAVVPPLMGNASVDLTELDPYMNFLMDSGSEDSINTLLSCDGSQDVVSNMDLWSFDDMPMSAGFY

SEQ ID NO: 19774 - DNA, 687 bp, Sorghum bicolor
  misc_feature: Ceres ANNOT ID no. 8735572
  misc_feature: Encodes the peptide sequence at SEQ ID NO 19775
atgcgatgtcactgctgccgccagcctctccagagtcagactccagactctccaatccagtccatccagcggaacatgatacagtcaggctcaggatcggacccgaatccagtccatacggttacgggggcgctccctgcaatccctgcatacacacagcttgcttgccgcgcagtagcaggtgcggaaggaatcgagccggagttcagacgttcagttcacatggctgctgaatcagagaacggcagctgcaatgcttgggcagcgagagatccttcgggaattctctcaccatacaagtttaaccgcagagcaatgcaaaatagcgatattgcaacgaaggtcatatactgtagagtctgttatgctgacgttggctggacacggaatatgctcaatgattcaaaatatcctttggttcctgggcatgagattgctggagttgtaactcaggttggtgcagatgtcaaaggatttaaagtgggtgaccatgctggtgttggaacatatgtgaactcatgccgagattgtgagaactgtaatagctctctagagaaccactgcccaaaaggtgtttatactttcaatggcattgatacacatggaactgtcacaatggagggttactccacgcacattgtagtccatgaaactatgacatattatgatagaaaaaagtctacgtga

SEQ ID NO: 19775 - protein, 228 aa, Sorghum bicolor
  misc_feature: Useful for making plants with altered cell wall content and/or composition
  misc_feature: Functional homolog of the protein sequence given in SEQ ID NO 13798
  misc_feature: The sequence is a functional homolog of SEQ ID NO 2 in US patent 7288696
  misc_feature: Ceres ANNOT ID no. 8735572
  misc_feature (78)..(217): SWISSPROT Homolog: EC 1.1.1.195 Cinnamyl-alcohol dehydrogenase
  misc_feature (108)..(223): Pfam ID: ADH_N Pfam Description: Alcohol dehydrogenase GroES-like domain
MRCHCCRQPLQSQTPDSPIQSIQRNMIQSGSGSDPNPVHTVTGALPAIPAYTQLACRAVAGAEGIEPEFRRSVHMAAESENGSCNAWAARDPSGILSPYKFNRRAMQNSDIATKVIYCRVCYADVGWTRNMLNDSKYPLVPGHEIAGVVTQVGADVKGFKVGDHAGVGTYVNSCRDCENCNSSLENHCPKGVYTFNGIDTHGTVTMEGYSTHIVVHETMTYYDRKKST

SEQ ID NO: 19776 - DNA, 1377 bp, Sorghum bicolor
  misc_feature: Ceres ANNOT ID no. 8735569
  misc_feature: Encodes the peptide sequence at SEQ ID NO 19777
atgaactcatggctggcgagaagccccgtaagcttgatccgcgacgtcactgctgtcggcaccctctccaatccaatccatccaccggtcaacggagcaggatcccgtctgcgcctttccaactccttccccatttgtaatttgctcactcgccggcggccgctacctgcaacccggcgacacccgaccgacagcctgctcgccacgcttgcatcgaggagagttcggggagcggccggtgcggacggaatcgacgcaggggtcagtcttttcccctcccctcccctgtattgcccgcctcgattcgactccaagggtcaacgattttcattctgcagttcagttcgaatggccgctgaatcagagaacggcaactgcaatgcatgggcagcgagagatccttccggagttctctcaccatacacgtttaaccgcagagcagtgcaaagcagcgatgttgcgctgaagatcatatactgtggagtctgttatgctgacgttaaatggacacggaatatgcagcatgattcaaaatatcctctggttccagggcatgagatagctggagttgtaactcaggttggtgcagatgtcaaaggctttaaagtgggtgaccatgtaggtgttggaacatatgtgaactcatgccgagattgtgagaactgcaatctctctctagaaaaccactgcccaaaaggagtttatactttcaatggcatcgacgcagatggaactgtcacaaaggggggttactccactcacattgtagtccatgaaaggtattgcttccaaatacccgatggctaccctttggcaaaggcagcacctcttctgtgtgctggaataactgtgtatactccaatgatgcgacacaacatgtaccaacctgggaagtcacttggggtcattggacttggtggtctgggtcacatggctgtgaaatttggtaaagcatttggtcttaaggtcacagttttgagtacaagtgaatcaaagagagatgaagccatcaccctccttggagcagataattttgttatatcatcagacacacaacagatggagtccctgaaaaactccctgcacttcatagttgacaccgcttctggtgaccatccatttgatccatatctctctctccttaaggttggtggtgtgatggcaatagtgggttttccaagtgcgcggaccttgtctggtagtcttgttggaggtacaaaagacatccaagaaatggttaacttctgtgcagagaacaaaatctatccggagatcgagatcattaagatagattacatcaatgaggctttggcaaggcttgtgaatcgagatgtgaaataccgctttgtaattgacatcgagaactctttcaagtag

SEQ ID NO: 19777 - protein, 458 aa, Sorghum bicolor
  misc_feature: Useful for making plants with altered cell wall content and/or composition
  misc_feature: Functional homolog of the protein sequence given in SEQ ID NO 13798
  misc_feature: The sequence is a functional homolog of SEQ ID NO 2 in US patent 7288696
  misc_feature: Ceres ANNOT ID no. 8735569
  misc_feature (120)..(456): SWISSPROT Homolog: EC 1.1.1.195 Cinnamyl-alcohol dehydrogenase
  misc_feature (150)..(265): Pfam ID: ADH_N Pfam Description: Alcohol dehydrogenase GroES-like domain
  misc_feature (296)..(418): Pfam ID: ADH_zinc_N Pfam Description: Zinc-binding dehydrogenase
MNSWLARSPVSLIRDVTAVGTLSNPIHPPVNGAGSRLRLSNSFPICNLLTRRRPLPATRRHPTDSLLATLASRRVRGAAGADGIDAGVSLFPSPPLYCPPRFDSKGQRFSFCSSVRMAAESENGNCNAWAARDPSGVLSPYTFNRRAVQSSDVALKIIYCGVCYADVKWTRNMQHDSKYPLVPGHEIAGVVTQVGADVKGFKVGDHVGVGTYVNSCRDCENCNLSLENHCPKGVYTFNGIDADGTVTKGGYSTHIVVHERYCFQIPDGYPLAKAAPLLCAGITVYTPMMRHNMYQPGKSLGVIGLGGLGHMAVKFGKAFGLKVTVLSTSESKRDEAITLLGADNFVISSDTQQMESLKNSLHFIVDTASGDHPFDPYLSLLKVGGVMAIVGFPSARTLSGSLVGGTKDIQEMVNFCAENKIYPEIEIIKIDYINEALARLVNRDVKYRFVIDIENSFK

SEQ ID NO: 19778 - DNA, 678 bp, Sorghum bicolor
  misc_feature: Ceres ANNOT ID no. 8735619
  misc_feature: Encodes the peptide sequence at SEQ ID NO 19779
atggactactcacaacctagtaagcctcgggtcctccttgctgcttcaggaagtgtagctgctataaaatttgagaacctttgtcgtagtttctctgagtgggcggatgtccgagccgtggccaccgcatcatctttgcactttattgatggatcatctctaccaagtgacattgttctttacactgatgatgatgagtggtctacctggaagaagatagcatatgaagttttacacattgagctgcgtaaatgggcagatattatggtgattgctccattattagcaaataccatggctaaggtacctttttctctttattattttgttcacatcgctggtgggttatgtgacaacctcttaacatgcatcgtgagagcgtgggactatagcaaaccgctctttgttgccccagctatgaacacattaatgtggaacaacccattcacaaagcgtcatcttcaaacggtcaaccaactgggcataatcttgatccccccagtggacgtactcttttatgcatctgtattgtctttacctgtgatgatgagtagaatattgagagttggggggaagcttgtagtgacagaggtagcttcctcccggcccagtaatgatagtgataacgagtctattgagtttgtaattgtcagtaagtattcttatgcagctgtataa

SEQ ID NO: 19779 - protein, 225 aa, Sorghum bicolor
  misc_feature: Useful for making plants with modulated flowering time
  misc_feature: Functional homolog of the protein sequence given in SEQ ID NO 13537
  misc_feature: Ceres ANNOT ID no. 8735619
  misc_feature (6)..(168): SWISSPROT Homolog: EC 4.1.1.36 Phosphopantothenoylcysteine decarboxylase
  misc_feature (9)..(139): Pfam ID: Flavoprotein Pfam Description: Flavoprotein
MDYSQPSKPRVLLAASGSVAAIKFENLCRSFSEWADVRAVATASSLHFIDGSSLPSDIVLYTDDDEWSTWKKIAYEVLHIELRKWADIMVIAPLLANTMAKVPFSLYYFVHIAGGLCDNLLTCIVRAWDYSKPLFVAPAMNTLMWNNPFTKRHLQTVNQLGIILIPPVDVLFYASVLSLPVMMSRILRVGGKLVVTEVASSRPSNDSDNESIEFVIVSKYSYAAV

SEQ ID NO: 19780 - DNA, 1353 bp, Sorghum bicolor
  misc_feature: Ceres ANNOT ID no. 8735666
  misc_feature: Encodes the peptide sequence at SEQ ID NO 19781
atggggcttcgggagcgcctgctggggtgcttcggggccggcggccatcatcaggagcaggagcaggagtctgcggcgcggccggcggcgagcaggcgtcccggcgggaagccgacgctgcggcggctgagcacggcgaaccttcggtcgctgtcgctgcaggacctgtcgcggaagctggagaccaccaagctgcacgccttcacgctggacgagctcaaggccgccaccaagaacttctccacctccaacttcctcggcgagggcgggttcggccccgtctacaagggcttcgtcgacggccgcctccgcccggggctccagccgcagcacgtcgccgtcaagtacctcgacagcgacggcgtccagggccaccgcgagtggctggcggaggtggtgtacctcgggatgctgagccatccgcatctggtcaagctggtgggcttctgcaaccaggacgaccaccggatgctggtgtacgagtacatgcccaggcaaagcctcgagaaccatctcttcaagaatctcctcgcgtcgctgccgtggtcgacgcggctcaagatcgccgtcggcgccgccaaggggctggcgttcctgcacgaggccgagacgcccgtcatctaccgcgacttcaaggcctccaatattcttctcgactcggactacacggcgaagctgtcggatttcgggctggccaaggaagggccgcagggtgacgcgacgcacgtgacgacgcgggtgatgggcacgcacgggtacgcggcgccggagtacatcctgacgggccacctgacggcgaagagcgacgtgtacagcttcggcgtggtgctgctggagctgctcacgggccggcgctccgtcgacaagcggcgcgggcggcgggagcagaacctcgtggactgggcgcgcccctacctccgccgcgccgacaggctgcaccggttcatggacccgagcctggagatgcagtactcggcgaccgccgcggagaaggccgccaaggtcgcgcaccagtgcctgcagagcgtgcccaaggccaggcccaacatgcgcgacgtcgtcgacgcgctcgagccgctcctggcgctcgacgacgacgtgcccatgggacccttcgtcttcacggtcggcgcggccgaggcggcgacggcaacggcgcaggtcgtcgaggacgctgtcgctgtcactgtggccaacgacgaccaggtggaagcggaggcggaggcggaggcgggcagccggcagggcaagaggcacgtcatgtcggccgtgcacgcggagagcccgctgcggagccggtacgccagcgccgtgaagagaccggagagcccgccgacactgagcagggcatga

SEQ ID NO: 19781 - protein, 450 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8735666
  misc_feature (60)..(350): SWISSPROT Homolog: EC 2.7.11.1 Non-specific serine/threonine protein kinase
  misc_feature (80)..(357): Pfam ID: Pkinase Pfam Description: Protein kinase domain
MGLRERLLGCFGAGGHHQEQEQESAARPAASRRPGGKPTLRRLSTANLRSLSLQDLSRKLETTKLHAFTLDELKAATKNFSTSNFLGEGGFGPVYKGFVDGRLRPGLQPQHVAVKYLDSDGVQGHREWLAEVVYLGMLSHPHLVKLVGFCNQDDHRMLVYEYMPRQSLENHLFKNLLASLPWSTRLKIAVGAAKGLAFLHEAETPVIYRDFKASNILLDSDYTAKLSDFGLAKEGPQGDATHVTTRVMGTHGYAAPEYILTGHLTAKSDVYSFGVVLLELLTGRRSVDKRRGRREQNLVDWARPYLRRADRLHRFMDPSLEMQYSATAAEKAAKVAHQCLQSVPKARPNMRDVVDALEPLLALDDDVPMGPFVFTVGAAEAATATAQVVEDAVAVTVANDDQVEAEAEAEAGSRQGKRHVMSAVHAESPLRSRYASAVKRPESPPTLSRA

SEQ ID NO: 19782 - DNA, 2103 bp, Sorghum bicolor
  misc_feature: Ceres ANNOT ID no. 8735708
  misc_feature: Encodes the peptide sequence at SEQ ID NO 19783
atggatttcggcgacgaacctgagggctccgacagccagcgccagcggaagcgctaccaccgccacaccccgcgccagattcagcagctcgaagcgatgttcaaggagtgcccgcaccccgacgagaaccagcgcgccgcgctcagccgggagctcggcctggagccacgccagatcaagttctggttccagaaccgccgcacccagatgaaggcgcagcacgagcgcgcggacaactgcttcctccgcgcggagaacgacaagatccggtgcgagaacatcaccatgcgcgaggcgctcaagaacgtcatctgccccaactgcggcggcccgccggtcgccgaggacttcttcgacgagcagaagctgcgcatggagaacgcccgcctgaaagaagagctggaccgggtgtcgagcatcacgtccaagtacctcggccggccgttcacgcagatgccgccggtgccgaccatgtccatgtcgtcgctggacctgtccatgggcgggatgcccgggcagcagggccacctcggcgggccgccgtcgctggacctcgacctcctcagcggctgctcgtccgggatgccgtaccagatgccggcgcccgtgacggagatggagcgccccatgatggtggacatggcgacgcgcgccatggacgagctcatccggctcgcccaggccggcgaccaaatctgggtcaagggcatgcccggggacgccagggagatgctcaacgtcgccacctacgacagcctcttctccaagcccggcgtcgcgttccgcccgccggacatgaacgtcgaggggtccagggactcgggcctcgtcttcatgagcgccgtcgcgctcgtcgacgtcttcatggacaccaacaagtggatggagttcttccccggcatcgtgtccaaggcgcagaccgtcgatgtcctcgtgaacggcttgggcgggaggagcgagtccttgatcatgatgtacgaggagctgcacatcatgacgccggtcgtcccgactcgcgagctgagcttcctccgctactgcaagcagatcgagcaaggtctgtgggccatcgccgacgtctccctggacgggcagcgcgacgcccactacggcatgccgtcccgctcccgtcgcatgccgtcggggtgcctcatcgccgacatgtcaaatggctactccaaggtgacctgggtcgaacacatggagatcgagcagatgctcccgatcaacgtcctctaccgcaacctcgtgctgagcggcgccgcgttcggggcgcaccgctggctcgccgcgctgcagcgtgcgtgcgagcggttcgcgtccgtggccaccctcggcgtgccgcaccacgacatcgccggagtgacgccggaggggaagcggagcatgatgaagctgtcgcagcggatggtgggcagcttctgcgcgagcctgagctcgtcgccgctgcagcggtggacgctgctctccggcaccacggacgtgagcgtccgagtgtccacgcaccgcagcaccgactccggcggccagcccaacggcgtcgtcctcagcgccgccacctccatctggctgcccgtccccggcgaccacgtgttcgccttcgtccgcgacgagaacgcgcgctcccagtgggacgtcctgtcgcacggcaatcaggttcaggaggtgtcgcgcatccccaacggctccaaccccggcaactgcatctccctgctgagagggctcaacgcgaaccagaacagcatgctgatcctccaggagagctgcacggacgcgtcgggggcgctggtggtgtactcgccgatcgacatcccggcggcgaacgtggtgatgagcggcgaggacccgtcgggcatcccgctcctgccgtcgggcttcgccatcctccccgacggacgcccggggtccggcgcgggcgcgtccagcagcgtcgtcctcccgctcgcgtcgcagccgggctgcgtggtcaccgtcgcgttccagatcctcgtcagcaacctgccgtcgtccaggctcaacgccgagtccgtcgccaccgtcaacagcctcatcggcaccaccgtccagcagatcaaggccgcgctcaactgcgccggcccttga

SEQ ID NO: 19783 - protein, 700 aa, Sorghum bicolor
  misc_feature: The sequence is a functional homolog of SEQ ID NO 1024 in the 10/225,066 US patent application
  misc_feature: The sequence is a functional homolog of SEQ ID NO 2886 in the 10/374,780 US patent application
  misc_feature: The sequence is a functional homolog of SEQ ID NO 434 in the 10/666,642 US patent application
  misc_feature: The sequence is a functional homolog of SEQ ID NO 244 in the 10/412,699 US patent application
  misc_feature: The sequence is a functional homolog of SEQ ID NO 424 in the 11/435,388 US patent application
  misc_feature: The sequence is a functional homolog of SEQ ID NO 519 in the 11/479,226 US patent application
  misc_feature: The sequence is a functional homolog of SEQ ID NO 58 in the 10/286,264 US patent application
  misc_feature: Ceres ANNOT ID no. 8735708
  misc_feature (213)..(438): Pfam ID: START Pfam Description: START domain
  misc_feature (16)..(72): Pfam ID: Homeobox Pfam Description: Homeobox domain
MDFGDEPEGSDSQRQRKRYHRHTPRQIQQLEAMFKECPHPDENQRAALSRELGLEPRQIKFWFQNRRTQMKAQHERADNCFLRAENDKIRCENITMREALKNVICPNCGGPPVAEDFFDEQKLRMENARLKEELDRVSSITSKYLGRPFTQMPPVPTMSMSSLDLSMGGMPGQQGHLGGPPSLDLDLLSGCSSGMPYQMPAPVTEMERPMMVDMATRAMDELIRLAQAGDQIWVKGMPGDAREMLNVATYDSLFSKPGVAFRPPDMNVEGSRDSGLVFMSAVALVDVFMDTNKWMEFFPGIVSKAQTVDVLVNGLGGRSESLIMMYEELHIMTPVVPTRELSFLRYCKQIEQGLWAIADVSLDGQRDAHYGMPSRSRRMPSGCLIADMSNGYSKVTWVEHMEIEQMLPINVLYRNLVLSGAAFGAHRWLAALQRACERFASVATLGVPHHDIAGVTPEGKRSMMKLSQRMVGSFCASLSSSPLQRWTLLSGTTDVSVRVSTHRSTDSGGQPNGVVLSAATSIWLPVPGDHVFAFVRDENARSQWDVLSHGNQVQEVSRIPNGSNPGNCISLLRGLNANQNSMLILQESCTDASGALVVYSPIDIPAANVVMSGEDPSGIPLLPSGFAILPDGRPGSGAGASSSVVLPLASQPGCVVTVAFQILVSNLPSSRLNAESVATVNSLIGTTVQQIKAALNCAGP

SEQ ID NO: 19784 - DNA, 645 bp, Sorghum bicolor
  misc_feature: Ceres ANNOT ID no. 8735743
  misc_feature: Encodes the peptide sequence at SEQ ID NO 19785
atggcggcgtcggtctttccggcgctgctgctcgccgtggcggcggcggcggcgctgctgctcctaccggcggcggaggccgtgtggctcgagctgccgccgtcggggaccaagtgcgtctccgaggagatccagcccaacgtcgtggtgctcgccgactactcgatcatgtacgagtcccaccccagctcgcaccccaccgtcgccgtcaaggttacgtcaccctatggaaatactgtacatcataatgaaaatgctacaatgggtcagtttgctttcactacttcagaagctggaaactaccttgcatgtttctggatagacagtgtggagaaaggatcaggaacatctctaaatcttgattggaagatagggattgctgcaaaggattgggatactattgctaagaaagaaaaaattgagggcgtagaactagagcttaggaaacttgaagctgcagttgaatccatacatcataacttgctgtatctcaaagcaagggaagcggaaatgcgaacagtgagcgagaaaacaaattcaagggttgcctggttcagcatcctgtcactgggagtctgcgttgccgtctctgtgctgcagttgtggcaccttcaagggttcttccggaagaagaagctcatttaa

SEQ ID NO: 19785 - protein, 214 aa, Sorghum bicolor
  misc_feature: Useful for making plants with altered carbohydrate content
  misc_feature: Functional homolog of the protein sequence given in SEQ ID NO 13728
  misc_feature: Useful for making plants with altered cell wall content and/or composition
  misc_feature: Functional homolog of the protein sequence given in SEQ ID NO 13729
  misc_feature: Ceres ANNOT ID no. 8735743
  misc_feature (52)..(124): Pfam ID: EMP24_GP25L Pfam Description: emp24/gp25L/p24 family/GOLD
MAASVFPALLLAVAAAAALLLLPAAEAVWLELPPSGTKCVSEEIQPNVVVLADYSIMYESHPSSHPTVAVKVTSPYGNTVHHNENATMGQFAFTTSEAGNYLACFWIDSVEKGSGTSLNLDWKIGIAAKDWDTIAKKEKIEGVELELRKLEAAVESIHHNLLYLKAREAEMRTVSEKTNSRVAWFSILSLGVCVAVSVLQLWHLQGFFRKKKLI

SEQ ID NO: 19786 - DNA, 483 bp, Sorghum bicolor
  misc_feature: Ceres ANNOT ID no. 8735762
  misc_feature: Encodes the peptide sequence at SEQ ID NO 19787
atgggccgaggtgtcacgcatgataacgagccagtcgtcgtgtcgggtctggagaaaaggatcctggtaacgagagtgttggccccgtgctttttctcggggatgccaatcccacgatgggaggagttcgcggactacattgagcgtgcgtgggccatggccaatggcgtcatcgtgaacaccctcgaggagatggagccagagtacgtcgtcggctacacggtggctagggggatgaaagtctcgaccgtcggaccggtgtcgctctaccaccagcgtgccacaacactagcagcgagagggaacaccactgacacagatgccgacatcaacactagttggacgctgcaggtgctgatcctgtcccacgctaaggtgggtggattcgtgacgcactgctggtggaactcgaagatggaggccatcgccatggggcggccgatggtgatgtggcctcacttcatggatccgttcttgaactag

SEQ ID NO: 19787 - protein, 160 aa, Sorghum bicolor
  misc_feature: Useful for making plants with altered carbohydrate content
  misc_feature: Functional homolog of the protein sequence given in SEQ ID NO 14741
  misc_feature: Ceres ANNOT ID no. 8735762
  misc_feature (114)..(160): SWISSPROT Homolog: EC 2.4.1.238 Anthocyanin 3'-O-beta-glucosyltransferase
MGRGVTHDNEPVVVSGLEKRILVTRVLAPCFFSGMPIPRWEEFADYIERAWAMANGVIVNTLEEMEPEYVVGYTVARGMKVSTVGPVSLYHQRATTLAARGNTTDTDADINTSWTLQVLILSHAKVGGFVTHCWWNSKMEAIAMGRPMVMWPHFMDPFLN

SEQ ID NO: 19788 - DNA, 1545 bp, Sorghum bicolor
  misc_feature: Ceres ANNOT ID no. 8735766
  misc_feature: Encodes the peptide sequence at SEQ ID NO 19789
atgggtagccaagggcaagcggcgaccgacggccggggagacgcagacgacaccggcggaagaacccaagcagcgcacttcgtgttcgtcccgctgatggctcagggccacctgatcccggccatcgacacggcgctgctgctctccacccacggcgccgtctgcaccatcgtcgggaccccggccacgtctgctcgggtacgcccgaccatcgagtccgccctgcagtccggcctgtcggtccgcctcgtcgagttcccgctcaactacgccgaggccggcctgcccgaaggcgccgacaacatggacaacgtcccggcagagtactcgcagaactacttcgacgccgtcgcgctcctccgcgcgccgatcgagcgctacctccgcgcgcaggcgccgtacccgacgtgcgtcgtggcggacttctgccagccgtggaccacggtgctcgcgaccaacctcggcgtcccgcgcctcaccttcttgagcatgtgcgccttctgcctcctgtgccagcacaatgtcgagcggttcaacgcgtacgacaacgtcgccgacgacaacgagccggtcgtcgtgccgggtctggaggagaaaaggatcctggtaacgagggcgcaggccccgggctttttccgggggatcccaatcccgtggtgggaggagttcgcggactacgtcgagcgcgcgcgggccgaggccgacggcgtcatcgtgaacaccttcgaggagatggagccggagtacgtcgccggctacgcggcggccagggggatgaaagtctggaccgtcgggccggtgtcgctgtactatcaccaggagcgcgccgcaacgctggcggcgagagggagcaccgccgacatcgacgccggcgagtgcctccggtggctggacggcaaggagcgcgactccgtcgtgtacgtcagcttcgggagcatcgcgcaggcggacgggaagcaggccgtggagctcggcctcgggctggaagcgtcggggcacccgttcatctgggtgatcaggaacgccgacgagtacgacggagccgtgcgcgtcttcctggacgagctcgacgcgcgcgtcgcggccgcggggcgcggcctgctcatcagggggtgggcgccgcaggtgctgatcctgtcccacgctgcggtgggcgcgttcgtgacgcactgcgggtggaactccacgatggaggccatcaccgcggggctgccggtggtgacgtggcctcacttcacggaccagttcctgaaccagaagatggccgtggaggtgctgggcatcggcgtcagcgtcgggatcacggagccgctcatgtaccagaaggtggagaaggagatcgtggtcggccggaacgtggtggaggaggccgtgaggagcgtgatgggcggcggggaggaggcagaggagaggcggcggcgggcccgcgcgctggcggtcaaggcgagagcggccatgcaggagggcgggtcgtcgcaccgcaacctgctggatttggtcgggcgcttcgagggtgtcatggccgagactaccaaaggcgcgtga

SEQ ID NO: 19789 - protein, 514 aa, Sorghum bicolor
  misc_feature: Useful for making plants with altered carbohydrate content
  misc_feature: Functional homolog of the protein sequence given in SEQ ID NO 14742
  misc_feature: Ceres ANNOT ID no. 8735766
  misc_feature (26)..(500): SWISSPROT Homolog: EC 2.4.1.238 Anthocyanin 3'-O-beta-glucosyltransferase
  misc_feature (26)..(504): Pfam ID: UDPGT Pfam Description: UDP-glucoronosyl and UDP-glucosyl transferase
MGSQGQAATDGRGDADDTGGRTQAAHFVFVPLMAQGHLIPAIDTALLLSTHGAVCTIVGTPATSARVRPTIESALQSGLSVRLVEFPLNYAEAGLPEGADNMDNVPAEYSQNYFDAVALLRAPIERYLRAQAPYPTCVVADFCQPWTTVLATNLGVPRLTFLSMCAFCLLCQHNVERFNAYDNVADDNEPVVVPGLEEKRILVTRAQAPGFFRGIPIPWWEEFADYVERARAEADGVIVNTFEEMEPEYVAGYAAARGMKVWTVGPVSLYYHQERAATLAARGSTADIDAGECLRWLDGKERDSVVYVSFGSIAQADGKQAVELGLGLEASGHPFIWVIRNADEYDGAVRVFLDELDARVAAAGRGLLIRGWAPQVLILSHAAVGAFVTHCGWNSTMEAITAGLPVVTWPHFTDQFLNQKMAVEVLGIGVSVGITEPLMYQKVEKEIVVGRNVVEEAVRSVMGGGEEAEERRRRARALAVKARAAMQEGGSSHRNLLDLVGRFEGVMAETTKGA

SEQ ID NO: 19790 - DNA, 1659 bp, Sorghum bicolor
  misc_feature: Ceres ANNOT ID no. 8735776
  misc_feature: Encodes the peptide sequence at SEQ ID NO 19791
atgtccataaatcaagggtattttgccatacaacccagcggaagtgcattagtaaaaacttatagaatcagtacccaaaaaaatcagtcaatagagattaattgtctaattctgcattctgtcaataaagagattttgggttgtggtcacaacttaactctggttttttggcttacactggtagaatccaagaaagacgcacttcttggtggcctgctgcttccagggttcgacgagcagacctgcgccagccgctatcagtccgtttactaccgcaagaacatgacccggctgccgtccccgtacctcatcaagcggctgcgggagcaggaggcgctgcagcggcggtgcggcccgggcacggagccatacatgagagcgtcggagaggctccggtccgggcaaaccggcgccgccgtcgacgacgtcgacggctgcagctacctcgtgctcatctcctacaggggcctcggcaaccggatgctcgccatcacctcggtgttcctctacgccctgctcaccaaccgcgtcctcctcgtggaccgcggctacggcaacaccctgccggacctcttctgcgagccgttcccggggacgacatgggcgctgccgcaagacttcccgctcgacggccagttccggcagctggacgagtcggcgccggagagctacgggaacgtggtggtgaaccggagcgggtccgtgtccgggttgcggttcgtgtacctgcacctcgaccacgccgcgtcgccggcgaaccggctcgtgtactgcgacgaccaccgccgcgagtcgttcctccgccggatgcagtgggcgatcatccggacggaccagtacatggcgccggggctcttcttcaacctggcgtaccaggaggagctggaccggctgttcccgcggaaggacacggtgttctacctcctgtcgcggtacctgctgcacccgaccaacgacgtctggggcatggtcaccaggttctacaactcgtacctgagggacgccgacgagcggctgggcatccagatccgggtgctgtccggcgaccatcgcgacaaggcgcagaacgtcctggaccagatcctggcgtgcgcgtcgcgggagcatctgctgccgggggtggtcaccacggatggggtcgcgccggcgccgccgcacgccggagcgcggcggcggtccaagaagaaggccgttctggtcaccgggctgagcgcgtggtaccacgacaacatcaaggagatgtactggaagtcggcgaccgtcgacggcgaggtggtgagcctgttccagcccagccacgaggagcaccagcagtggtaccacaacaagcacgacatgaaggcggcggcggagatctacctgctcagcctgaccgacaagatcgtcaccagcgcgtggtcgacgttcgggtacgtcggctacgcgatgggcgggctcaggccgtacctcatgttcatgccggagaaccagacggcgccggacccgccatgcacgagggccatgtccatggagccgtgctctcacggggcgccctccttcgagtgcacgaggaaagagatcggcaccatcatcaacaccgggatcctgctgccccatgtccgtgcttgcgaagacatctcatgggggctcaaacttactgacccggacgtagaaaattag

SEQ ID NO: 19791 - protein, 552 aa, Sorghum bicolor
  misc_feature: Useful for making plants with altered cell wall content and/or composition
  misc_feature: Functional homolog of the protein sequence given in SEQ ID NO 14023
  misc_feature: Ceres ANNOT ID no. 8735776
  misc_feature (61)..(547): SWISSPROT Homolog: EC 2.4.1.69 Galactoside 2-alpha-L-fucosyltransferase
  misc_feature (36)..(517): Pfam ID: XG_FTase Pfam Description: Xyloglucan fucosyltransferase
MSINQGYFAIQPSGSALVKTYRISTQKNQSIEINCLILHSVNKEILGCGHNLTLVFWLTLVESKKDALLGGLLLPGFDEQTCASRYQSVYYRKNMTRLPSPYLIKRLREQEALQRRCGPGTEPYMRASERLRSGQTGAAVDDVDGCSYLVLISYRGLGNRMLAITSVFLYALLTNRVLLVDRGYGNTLPDLFCEPFPGTTWALPQDFPLDGQFRQLDESAPESYGNVVVNRSGSVSGLRFVYLHLDHAASPANRLVYCDDHRRESFLRRMQWAIIRTDQYMAPGLFFNLAYQEELDRLFPRKDTVFYLLSRYLLHPTNDVWGMVTRFYNSYLRDADERLGIQIRVLSGDHRDKAQNVLDQILACASREHLLPGVVTTDGVAPAPPHAGARRRSKKKAVLVTGLSAWYHDNIKEMYWKSATVDGEVVSLFQPSHEEHQQWYHNKHDMKAAAEIYLLSLTDKIVTSAWSTFGYVGYAMGGLRPYLMFMPENQTAPDPPCTRAMSMEPCSHGAPSFECTRKEIGTIINTGILLPHVRACEDISWGLKLTDPDVEN

SEQ ID NO: 19792 - DNA, 1764 bp, Sorghum bicolor
  misc_feature: Ceres ANNOT ID no. 8735787
  misc_feature: Encodes the peptide sequence at SEQ ID NO 19793
atggccttggagggcgtggtcggcattggcatagccaagcggccatcactgcaatgcctggacgccgtggagaacgcggcccgacgtgccgagccagacgagcgtacggtggagcagagcacaacgccatggatgatcgcgaggaagaaggtcacagcgctcgccgtctgcctcgtcgcgttgcccgtcctgatgaccacggttagccggcgggactcgccgtggacgcccgcgtccttttggccgctggcgacattcgcgcggcaagatcttctgactcgcggtgctttgaaacgatttcgattgaaaagagctctaatctaccttccccgcgtgcgaaaattcgatgcagagaagctcctcggcggcctgctcgtgccggggttcgacgagcggtcatgcctcagccggtaccagtcagcgttctaccgcaagaacctgacgcggtcgccgtccgcgcacctcatcaagcggctgcgccagcacgaggcgctgcagcgccggtgtgggccgggcaccgaggcgtacagggcggcggccgcgcggctcaggtcctggcgccgcaacggcaccgacgtcgacgccgcctgcaggtacctcgtgctggtgccgtacaggggcctcgggaacaggatcctggccgtggcgtcggcgttcctctacgccgtgctcaccgaccgcgtcctgctcctcgacgggaacacgtcgacgggcgaaatcttctgcgagccgttcccggggacctcgtggctgctgccgctgaacttccccatcagcaacctccagaacctgacgggcgacgtgcgggagagctacaggaacctggtgcggaacgatagcgcggcggcgtcgctggcgtccaggctcccgtacgtgttcgtggacctcgaccattcctgcacctaccacgacaagctcttcttctgcgacgacgagcggccgttcctccgccgcgcgccgtggctggtgatgaggacggacggctacttcgtgccggcgctgttcctgaacccggcgcaccaggacgagctccacaggatgttccctcggaaggactcggtgttctacctgctggcgcactacctgttccacccgacgaacaaagtttggggactcatcacgaggttccacagctcgtacctgagggactcggacgaaaggctgggcatccaggtgagggtgttcgacggggacacgccgttccagcacatcttggagcagatcctcgcctgcacgtcgcaagagcacctgctccccgacgtggtcacgcaagaaccgccccgcccgtcgacggccggtgcgcggtccaaggccgtcctgatgaccggcctgagctcgtggtactacgagaacatccggtggaagtactggcagtcggcgacggccaccggcgaggtcgtgagcgtgtaccagccgagccacgaggagcaccagctctccggctacacgacgcacgacatgaaggcggtggcggagatgtacctcctgggcatgacggacaagatcgtcaccagcggctggtcgacgttcggctacgtcggccacggcctcggtgggctcacgccgtggatcatgttcaggcctgagaaccacaccacgccttacccgccgtgccggcgggccaagtcgatggagccgtgcatgcacgggccgccgttctacgactgcagggcgaagcacggtgccgacacgggaaagctggtgccacatgtccagcactgtgaagacatgagctgggggctgaaacttgttcaccccgagtga

SEQ ID NO: 19793 - protein, 587 aa, Sorghum bicolor
  misc_feature: Useful for making plants with altered cell wall content and/or composition
  misc_feature: Functional homolog of the protein sequence given in SEQ ID NO 14023
  misc_feature: Useful for making plants with altered carbohydrate content
  misc_feature: Functional homolog of the protein sequence given in SEQ ID NO 14024
  misc_feature: Ceres ANNOT ID no. 8735787
  misc_feature (118)..(584): SWISSPROT Homolog: EC 2.4.1.69 Galactoside 2-alpha-L-fucosyltransferase
  misc_feature (79)..(558): Pfam ID: XG_FTase Pfam Description: Xyloglucan fucosyltransferase
MALEGVVGIGIAKRPSLQCLDAVENAARRAEPDERTVEQSTTPWMIARKKVTALAVCLVALPVLMTTVSRRDSPWTPASFWPLATFARQDLLTRGALKRFRLKRALIYLPRVRKFDAEKLLGGLLVPGFDERSCLSRYQSAFYRKNLTRSPSAHLIKRLRQHEALQRRCGPGTEAYRAAAARLRSWRRNGTDVDAACRYLVLVPYRGLGNRILAVASAFLYAVLTDRVLLLDGNTSTGEIFCEPFPGTSWLLPLNFPISNLQNLTGDVRESYRNLVRNDSAAASLASRLPYVFVDLDHSCTYHDKLFFCDDERPFLRRAPWLVMRTDGYFVPALFLNPAHQDELHRMFPRKDSVFYLLAHYLFHPTNKVWGLITRFHSSYLRDSDERLGIQVRVFDGDTPFQHILEQILACTSQEHLLPDVVTQEPPRPSTAGARSKAVLMTGLSSWYYENIRWKYWQSATATGEVVSVYQPSHEEHQLSGYTTHDMKAVAEMYLLGMTDKIVTSGWSTFGYVGHGLGGLTPWIMFRPENHTTPYPPCRRAKSMEPCMHGPPFYDCRAKHGADTGKLVPHVQHCEDMSWGLKLVHPE

SEQ ID NO: 19794 - DNA, 1119 bp, Sorghum bicolor
  misc_feature: Ceres ANNOT ID no. 8735814
  misc_feature: Encodes the peptide sequence at SEQ ID NO 19795
atggtgcgcgacgcggcaaaagagacgatcccgctgctgacgcgctacaagatgggccatctcgagctctcccaccgcgttgtgctcgcgccgctgacgcggtgccgctcctacggccaagtgccgcagccgcacgccgcggcgtactactcgcagcgcgccaccagcggcggcctcctcatctcggaggccacggatgtgtcccccaccgcgcaggggtacccggagactcccggcatctggacgcacgagcaggtcgaggcgtggaagcccatcgtcgacgccgtccaccgcaagggcgccttcttcatctgccagatttggcacgtcggcagagcttccaccaatgagtttcagcctgacggtcaggcgcccatctccagcacggacaagcaaatctctccggaccccgagtcaggcatggtgtactccaagccgcggcgtctacggacggaggagatcccggggatcgtcgacgactttaggcgtgcggcacggaacgccatcgaggcaggattcgatggtgtggagatccacggcgcgcatgggtacctcctggagcagttcatgaaggatggcaccaacgacgaccgcgacgacgagtacggtggcagccttgagaaccggtgccgcttcgcggtggaggtggtcgatgctgtcgtccacgaggtgggcgcgcgtcgcgtgggcgttaggctgtctccgttcgtcgacttcctggactgtgtcgactctgatccactggcgcttggtgaatatatggtgcagcagctgaataggcacgaggggctactctactgccatatggtcgagccgcggatggccaatgttgatggccgcagacaaatccctcataggctcctaccgttcagaaaagccttcaatggaacgttcattgctgcaggcgggtatgatcgggaggaaggcaacaaggtggtgggtgaccattatactgacctcgttgcgtacgggagactctttttggctaatccagacttgcccagaaggtttgagttgggtgcacccttgaataagtacaaccggtcaactttcatcacgcaggatcctgtcgttggatatactgactacccattctatgaggataacaaccatgtatga

SEQ ID NO: 19795 - protein, 372 aa, Sorghum bicolor
  misc_feature: Useful for making plants with modulated water use efficiency
  misc_feature: Functional homolog of the protein sequence given in SEQ ID NO 13609
  misc_feature: Ceres ANNOT ID no. 8735814
  misc_feature (1)..(367): SWISSPROT Homolog: EC 1.3.1.42 12-oxophytodienoate reductase
  misc_feature (11)..(344): Pfam ID: Oxidored_FMN Pfam Description: NADH:flavin oxidoreductase / NADH oxidase family
MVRDAAKETIPLLTRYKMGHLELSHRVVLAPLTRCRSYGQVPQPHAAAYYSQRATSGGLLISEATDVSPTAQGYPETPGIWTHEQVEAWKPIVDAVHRKGAFFICQIWHVGRASTNEFQPDGQAPISSTDKQISPDPESGMVYSKPRRLRTEEIPGIVDDFRRAARNAIEAGFDGVEIHGAHGYLLEQFMKDGTNDDRDDEYGGSLENRCRFAVEVVDAVVHEVGARRVGVRLSPFVDFLDCVDSDPLALGEYMVQQLNRHEGLLYCHMVEPRMANVDGRRQIPHRLLPFRKAFNGTFIAAGGYDREEGNKVVGDHYTDLVAYGRLFLANPDLPRRFELGAPLNKYNRSTFITQDPVVGYTDYPFYEDNNHV

SEQ ID NO: 19796 - DNA, 1110 bp, Sorghum bicolor
  misc_feature: Ceres ANNOT ID no. 8735817
  misc_feature: Encodes the peptide sequence at SEQ ID NO 19797
atgccgctgctgacgccgttcaagatggggcagtttgagctgtcccaccgggtggtgctcgcgccgatgacgaggtgccgctcctacggcaacgtgccgcagccgcacgccgccgtctactactcgcagcgcgccactaggggcggcctcctcatcacggaggccaccggtgtgtcggccaccgctcaggggtacccggagacccccggcgtctggacgcaggagcatgtccaagcgtggaagcccatcgtcgacgccgtccaccgcaagggcgccctcttcttctgccagatttggcatgtcggcagggtctccaccaacgatttccagcctgacgggcaggcgccaatctcgagcacggacaagcaaatctcccctgacgcagcagagcccggcatggtgtactccaagccaagacggctgcggaaggacgagatccctgggatcgtcgacgacttcaggcgcgccgcgcggaacgccgtcgaagccgggttcgacggggtggagatccacggcgcgaacgggtacctcctggagcagttcatgaaggacggcgccaacgaccgcgacgacgagtacggcgggagcctcgagaaccggtgccgcttcgccgtcgaggtggtggacgccgtggtccgcgaggtgggtgctcctcgcgtgggcatcaggctctcgccattcctcgacttcatggactgcgtcgactccgaccccgccgcgctcgccgactacatggttcggcagctcaacaggcacgagggtttcctgtactgtcacatggtggagccacggatggccgtcgttgatggacggcggcagatcccgcacaggcttttgccattccgggagacgttcaaggggatcttcatcgcagctggcgggtatgaccgtgaggaaggcaacaaggttgtagcggagggctacactgatctagtctcctatggaaggctctttttggcaaatccggatctgcccagaagatttgagcttggctcgtcactgaataagtatgatcgctccacgttctacacccaagaccctgttgttggttacacggactacccgtcccttgacgacgacaagaatgacgccactgctgatgatgcttag

SEQ ID NO: 19797 - protein, 369 aa, Sorghum bicolor
  misc_feature: Useful for making plants with modulated water use efficiency
  misc_feature: Functional homolog of the protein sequence given in SEQ ID NO 13609
  misc_feature: Ceres ANNOT ID no. 8735817
  misc_feature (1)..(357): SWISSPROT Homolog: EC 1.3.1.42 12-oxophytodienoate reductase
  misc_feature (2)..(335): Pfam ID: Oxidored_FMN Pfam Description: NADH:flavin oxidoreductase / NADH oxidase family
MPLLTPFKMGQFELSHRVVLAPMTRCRSYGNVPQPHAAVYYSQRATRGGLLITEATGVSATAQGYPETPGVWTQEHVQAWKPIVDAVHRKGALFFCQIWHVGRVSTNDFQPDGQAPISSTDKQISPDAAEPGMVYSKPRRLRKDEIPGIVDDFRRAARNAVEAGFDGVEIHGANGYLLEQFMKDGANDRDDEYGGSLENRCRFAVEVVDAVVREVGAPRVGIRLSPFLDFMDCVDSDPAALADYMVRQLNRHEGFLYCHMVEPRMAVVDGRRQIPHRLLPFRETFKGIFIAAGGYDREEGNKVVAEGYTDLVSYGRLFLANPDLPRRFELGSSLNKYDRSTFYTQDPVVGYTDYPSLDDDKNDATADDA

SEQ ID NO: 19798 - DNA, 891 bp, Sorghum bicolor
  misc_feature: Ceres ANNOT ID no. 8735871
  misc_feature: Encodes the peptide sequence at SEQ ID NO 19799
atggcaggaggcaacaggtcgcaggacgaggacgtgcgcgtgggcgtggaccgtttcccggagcggcagccgatcggcactacggcggcggacgacctgggcggccgcgactacagcgagccccctgcggcgccgctgttcgagtcgtcggagctgtcgtcgtggtccttctaccgcgccggcatcgccgagttcgtggccacgttcctcttcctctacgtgacggtgctgacggtgatgggcgtgagcaagtccccctccaagtgcggcaccgtgggcatccagggcatcgcgtgggcgttcggcggcatgatcttcgcgctcgtctactgcaccgcgggggtgtcgggggggcacatcaacccggccgtcaccttcgggctcctcctcgccaggaagctgtcgctggcgcgggcggtctactacgtggtgatgcagtgcctgggcgccgtctgcggcgccggcgtcgtgaaggcgctcgtcgggagcgcgctgtaccagtccgcgggcggcggcgccaacgccgtcgcccccgggtacaccaagggcgacggcctcggcgccgagatcgtcggcacgttcgtgctcgtgtacaccgtcttctccgccaccgacgccaagcgcagcgccagggactcccacgtccccgtgctggccccgctgcccatcggcttcgccgtcttcctcgtgcacctcgccaccatccccatcaccggcaccggcatcaaccccgccaggagcctcggcgccgccatcatctacgacagcccgcacgggtggcacggccactggatcttctgggtgggcccgttcgccggagcggcgcttgcggcggtgtaccaccaggtcgtcatcagggccatccccttcaagtcgagcgctcactactag

SEQ ID NO: 19799 - protein, 296 aa, Sorghum bicolor
  misc_feature: Useful for making plants with modulated water use efficiency
  misc_feature: Functional homolog of the protein sequence given in SEQ ID NO 14289
  misc_feature: Useful for making plants with modulated drought sensitivity
  misc_feature: Functional homolog of the protein sequence given in SEQ ID NO 14287
  misc_feature: Useful for making plants with modulated cold sensitivity
  misc_feature: Functional homolog of the protein sequence given in SEQ ID NO 14288
  misc_feature: Ceres ANNOT ID no. 8735871
  misc_feature (51)..(281): Pfam ID: MIP Pfam Description: Major intrinsic protein
MAGGNRSQDEDVRVGVDRFPERQPIGTTAADDLGGRDYSEPPAAPLFESSELSSWSFYRAGIAEFVATFLFLYVTVLTVMGVSKSPSKCGTVGIQGIAWAFGGMIFALVYCTAGVSGGHINPAVTFGLLLARKLSLARAVYYVVMQCLGAVCGAGVVKALVGSALYQSAGGGANAVAPGYTKGDGLGAEIVGTFVLVYTVFSATDAKRSARDSHVPVLAPLPIGFAVFLVHLATIPITGTGINPARSLGAAIIYDSPHGWHGHWIFWVGPFAGAALAAVYHQVVIRAIPFKSSAHY

SEQ ID NO: 19800 - DNA, 1173 bp, Sorghum bicolor
  misc_feature: Ceres ANNOT ID no. 8735891
  misc_feature: Encodes the peptide sequence at SEQ ID NO 19801
atggagcagaagatggagcgtcgccttcatgccgaacgcgagtcggggagggagcagaagatggagcgccggcgctgcgaggaagataagaaatggcagctcagggccgcggccagtcctcggggcgggggtagttctgcttctcaaagggcgccagagcgagggcgctttgatggccggcggcgtggaccagatccgtcgtcgtcggcggcggcggcggcggcggcggcgtccgggtcggcggccaccggcgccggcggcgggccgcggccgtaccggtcgaggttcggtgacacgacgctgacgaaggtgttcgtgggcgggctggcgtgggagacgccctcggaggggctccggcagcacttcgagcggtacggcgacatcctcgaggccgtcgtcatcacggaccgcctcaccggccgctccaagggctacggattcgtgacgttccgggagccggaggcggcgcggcgcgcggtgcaggacccgaacccgacgatcgccgggcggcgcgccaactgcaacattgcctcgctaggcccgccgcctcgctccgtcccgtatccagcggcccaggccccgcagttcatccccagggcgccggcctctccttcccagatgatgatgccgcagcagcacggtggtggtggtggtggtggcccagctgctatgtacccgtctcaatttgggtactggtaccctcctgactttcaataccaacaggccattgccaatcctcaagtgctgcagaactactacgctcagctgtatggtctgacctcgcctacggcggcagcggcggcggcaccctaccaccagtacctcggctacgtggcgcatccgcctccaacgccgccaagggcagcgatactgccggcgccgcctgcggcggcacagcaggtcgccgtgcaaccgttggtgcagcatccgccgccggcacagcaggtcacgatgcaaccactgctgcagcatccgccggcacagctccaggccgccgcccctttcttcccggctccctcgctttcgcacaacttcaggctccagctgccgccgcctcctcaagctatgtcagtattgcctgtgcctcccaacacaacagaatcgctgccagctgatcaggccgctgcctctgtagctcgtgcgacaaatgcgagcagtactccgggagcctga

SEQ ID NO: 19801 - protein, 390 aa, Sorghum bicolor
  misc_feature: Useful for making plants with modulated biomass
  misc_feature: Functional homolog of the protein sequence given in SEQ ID NO 14743
  misc_feature: Ceres ANNOT ID no. 8735891
  misc_feature (99)..(177): SWISSPROT Homolog: EC 5.2.1.8 Peptidylprolyl isomerase
  misc_feature (104)..(174): Pfam ID: RRM_1 Pfam Description: RNA recognition motif. (a.k.a. RRM, RBD, or RNP domain)
MEQKMERRLHAERESGREQKMERRRCEEDKKWQLRAAASPRGGGSSASQRAPERGRFDGRRRGPDPSSSAAAAAAAASGSAATGAGGGPRPYRSRFGDTTLTKVFVGGLAWETPSEGLRQHFERYGDILEAVVITDRLTGRSKGYGFVTFREPEAARRAVQDPNPTIAGRRANCNIASLGPPPRSVPYPAAQAPQFIPRAPASPSQMMMPQQHGGGGGGGPAAMYPSQFGYWYPPDFQYQQAIANPQVLQNYYAQLYGLTSPTAAAAAAPYHQYLGYVAHPPPTPPRAAILPAPPAAAQQVAVQPLVQHPPPAQQVTMQPLLQHPPAQLQAAAPFFPAPSLSHNFRLQLPPPPQAMSVLPVPPNTTESLPADQAAASVARATNASSTPGA

SEQ ID NO: 19802 - DNA, 1407 bp, Sorghum bicolor
  misc_feature: Ceres ANNOT ID no. 8735909
  misc_feature: Encodes the peptide sequence at SEQ ID NO 19803
atgacgaaccaggacgtggtggtcccggacatgggcattgcggcggccgcggcgctgccggcggcccccggccgcgccctcttcgcgtgccgcggcgccgccgtctcgtcgctgcgcggcgcgtacggtggcctcggcctccccggcggcgccgctaccgacgctggcgagttcctagcagcagcaggcggccggggtggtgcccctgcccccgcggcggcgaatgcgccgccgggtcggacctgcaccagccgtgtcgtcgaggccatccgcgcgtcgtcgcccacccgctgccccgccgccgtcgacgagtacgacgcgtggacgaggaggcacccgtcggcgctgggcagcttcgaccagatcgcggcggcggccatggggaaaaggatcgtcatgttcatggactacgacggcacgctgtccccgatcgtcaccgacccggacatggcgttcatgacccccgagatgagggcggcggtgcgcaacgtcgccaagcacttcccgacggcgatcgtgaccggccggtgcatcgaaaaggtctgcggcttcgtaggcctcccggagctctactacgccggcagccacgggatggacatcaaaggcccaagctccaagccagctcgcgagttcctgccggtgatcaacaaggcttacagagctcttgaggagaggactaaggacacgccaggggccagggtggagaacaacaagttctgcctgtccgtgcacttcagatgcgtcgatgaaaagagctggagctcattggctgacaaggtcaaggccgtgctccgggacttccccgagctgaagctcactgagggcaggaaagtcttggagatccggccgtcgatcatgtgggacaagggcaaggccgtcgagttcttgctcaagtcgctcggattcgacgacagcaccaacgtcctgccggtgtacatcggagacgaccggaccgacgaggatgctttcaaggcgttgagggagagaggtcaaggcatagggatccttgtttccaaatgccccagggagacagatgcctcctactctctccaggaccccactgaggtcagactgctttgtccttcctatataatgctgacccaggcgccaactctgaactggacaactggtgctagtcatcatcaggtaaattcagcttacttgaccactgttattatctcccaatgttcagagttcagacatagcctgatgatgtatggacaatttagtcgggatttgataagtggtgtcccctcagcttacaatcagttgtctttcttccatatcgtgtccgtgagggaaccaactggttgtacgttctttctgcctcatgcatgcatgcctgatcctgcccatcgcttgcttcatgtgacttgtaccgtgcagcctgctagctatagcttatag

SEQ ID NO: 19803 - protein, 468 aa, Sorghum bicolor
  misc_feature: Useful for making plants with modulated flowering time
  misc_feature: Useful for making plants with modulated low light sensitivity
  misc_feature: Functional homolog of the protein sequence given in SEQ ID NO 13725
  misc_feature: The sequence is a functional homolog of SEQ ID NO 16 in US patent 7214858
  misc_feature: Ceres ANNOT ID no. 8735909
  misc_feature (134)..(356): SWISSPROT Homolog: EC 3.1.3.12 Trehalose-phosphatase
  misc_feature (134)..(354): Pfam ID: Trehalose_PPase Pfam Description: Trehalose-phosphatase
MTNQDVVVPDMGIAAAAALPAAPGRALFACRGAAVSSLRGAYGGLGLPGGAATDAGEFLAAAGGRGGAPAPAAANAPPGRTCTSRVVEAIRASSPTRCPAAVDEYDAWTRRHPSALGSFDQIAAAAMGKRIVMFMDYDGTLSPIVTDPDMAFMTPEMRAAVRNVAKHFPTAIVTGRCIEKVCGFVGLPELYYAGSHGMDIKGPSSKPAREFLPVINKAYRALEERTKDTPGARVENNKFCLSVHFRCVDEKSWSSLADKVKAVLRDFPELKLTEGRKVLEIRPSIMWDKGKAVEFLLKSLGFDDSTNVLPVYIGDDRTDEDAFKALRERGQGIGILVSKCPRETDASYSLQDPTEVRLLCPSYIMLTQAPTLNWTTGASHHQVNSAYLTTVIISQCSEFRHSLMMYGQFSRDLISGVPSAYNQLSFFHIVSVREPTGCTFFLPHACMPDPAHRLLHVTCTVQPASYSL

SEQ ID NO: 19804 - DNA, 1122 bp, Sorghum bicolor
  misc_feature: Ceres ANNOT ID no. 8735931
  misc_feature: Encodes the peptide sequence at SEQ ID NO 19805
atggggcgcgtgaagctgcagatcaagaggatcgagaacaacacgaaccggcaggtgaccttctcgaagcggcggaatggcctcatcaagaaggcctacgagctctccgtcctctgcgacatcgacatcgcgctcatcatgttctccccctccaatcgcctcagccatttctccggcaggcgcaggatcgaggacgtgatcacgaggtacatcaatctcccggagcacgacaggggaggagtcgttcggaatagagagtatctgatcaagatgcttacacaactcaaatgcgagggtgacatagccgaacaacttgcacccaataaagggccagtaaactccaatgtagaggagcttcagcaggagatcaggacataccaacaccagctgcaagtcttggaggagcaacttaggatgtttgagccggatccggtggcattggcatcgatgcatgaggttgagacgtgcgagaaattcctcatggacaccctcacccgcgtcgaggagcgaaagaaatatttgctgtgcaaccacatgggcccgttcgagccgtcgccctccgacatgcaccacgtgttcggcctgccgccgccgccgcagccaccggcgcagcagcagcagcacgaagaggagccgcaaggggacctgggcgtcaacgcgttcgccggcgacgtgtcctcgtggttcgccgacgggctgccgacgtcgtcgatcttcgcggggccagaccccatcttgtccttcagggatcaggtgatcttcgactcgatgaggcgggacccagtcgtggggggagtggacccaggaatagcctcgatgtgccacgtggaccagcaggcccctagcgatgactggcagcaagcgtacacgtcagcggagctcctctccgcgctcatcccgtccacgcctttcccccttgacgaccaggacgccatggcgccagtgctcacgtctccaatggcggtgccgccgcacatgcacgagcaagtggtggaggcgccggggaactgctccaacgtcaacgtgccggtggacggggactgcgccgccaccgccacccctgccgctgcccctgtcgctcctcaggagcacggcctgcccggcgcggtcaacatcggctag

SEQ ID NO: 19805 - protein, 373 aa, Sorghum bicolor
  misc_feature: Useful for making plants with modulated flowering time
  misc_feature: Functional homolog of the protein sequence given in SEQ ID NO 13660
  misc_feature: Useful for making plants with modulated biomass
  misc_feature: Functional homolog of the protein sequence given in SEQ ID NO 13659
  misc_feature: The sequence is a functional homolog of SEQ ID NO 1701 in the 10/412,699 US patent application
  misc_feature: The sequence is a functional homolog of SEQ ID NO 1961 in the 10/412,699 US patent application
  misc_feature: The sequence is a functional homolog of SEQ ID NO 1949 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1967 in the 10/412,699 US patent application
  misc_feature: The sequence is a functional homolog of SEQ ID NO 1955 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8735931
  misc_feature (9)..(59): Pfam ID: SRF-TF Pfam Description: SRF-type transcription factor (DNA-binding and dimerisation domain)
MGRVKLQIKRIENNTNRQVTFSKRRNGLIKKAYELSVLCDIDIALIMFSPSNRLSHFSGRRRIEDVITRYINLPEHDRGGVVRNREYLIKMLTQLKCEGDIAEQLAPNKGPVNSNVEELQQEIRTYQHQLQVLEEQLRMFEPDPVALASMHEVETCEKFLMDTLTRVEERKKYLLCNHMGPFEPSPSDMHHVFGLPPPPQPPAQQQQHEEEPQGDLGVNAFAGDVSSWFADGLPTSSIFAGPDPILSFRDQVIFDSMRRDPVVGGVDPGIASMCHVDQQAPSDDWQQAYTSAELLSALIPSTPFPLDDQDAMAPVLTSPMAVPPHMHEQVVEAPGNCSNVNVPVDGDCAATATPAAAPVAPQEHGLPGAVNIG

SEQ ID NO: 19806 - DNA, 1542 bp, Sorghum bicolor
  misc_feature: Ceres ANNOT ID no. 8735953
  misc_feature: Encodes the peptide sequence at SEQ ID NO 19807
atggcaatagaagactcagcgaatggccgtcgcccgccgacggcgaacgtcgacagcagcggctgcgacgtcaaggcgcatttcgtgttcatcccgctgatgtttcagggccacctgatcccggcggccgacaccgcgcttctgctagccacccacggcgctctcgccagcatcgtcgtcaccccgtccaacaccggccggatcaagccggccgtcgacttcgcccgaaagtccggcctggcggtccggctcgtcgagctcccgctcgacctcgccgcggaagggctgcccgacggcgccgacgacgtcgacaaggtgccggagggtctctggaccaactacttccgcgccctggcgcgcctccgggagcctctggagcggcacctccgcgcgcacgcgccgtacccgacgtgcgtcgtggcggacttctgccacccgtgggctagggagctcgcggcgaacctccaggtcccgcgcctcgctttcttcagcatgtgcgccttctgcctcctctgccagcacaacgtcgagaggttccacgcgtacgacggcgtggccgatgaccacgagctggtcgtcgtgcccggcctggagaaaaaggtcgaggtgtcgagggctcaggctcccggtttcttccgcggggtgcccgggttcgagaaattcgcggacgacgtcgagcaggtgttggccgaggccgacggcgtcgtcaccaacagcttcgtggagatggagccggagtacgtcgccggctacgcggaagccagggcgatgaaggtgtggaccgtcgggccggtgtctctgttccaccagcggagcaccgcgacgctggcgtcgagagggaacaccgccgccatcggtgccgacgagtgcctccggtggctcgacggcaaggagcccaactccgtcgtgtacgtcagcttcgggagcctcgcgcacgcacgacagaagcaggtcgtggagctcggtctcgggctggaggcgtcagggcacccgttcatctgggtggtcaagaacgccgccgccggcgaggaagtggccgagttcctacacgacctcgaggcgcgcgtcgccgggcgcggcctgctcatcagggggtgggcgccgcaggtgctgatcctgtcccacgcagccatcggcagcttcgtgacgcactgcgggtggaactcgaccatggaggccatcacggccgggctgccggtggtggcgtggccgcacttctcggaccagttcttgaacgccaagttcgccgtggaggtgctggggatcggcgtggacgtcggggtgacggagccgctcatgtaccagcttgaggagaaggagatcgtggtggccagagatgtggtggagaaggcggtgagggaggtcatgcagggaggaggcgagggggaggagcggaggaggagggcacgagcgcttgcggccaaggccaggactgccgtggagaaaggcgggtcgtcgcacgcgaacctgctggatttgatcaactgcttcaaggtggacgcgggatgtcgtgctcgccccttcgggaggtcgactgcatga

SEQ ID NO: 19807 - protein, 513 aa, Sorghum bicolor
  misc_feature: Useful for making plants with altered carbohydrate content
  misc_feature: Functional homolog of the protein sequence given in SEQ ID NO 14742
  misc_feature: Ceres ANNOT ID no. 8735953
  misc_feature (27)..(456): SWISSPROT Homolog: EC 2.4.1.238 Anthocyanin 3'-O-beta-glucosyltransferase
  misc_feature (39)..(506): Pfam ID: UDPGT Pfam Description: UDP-glucoronosyl and UDP-glucosyl transferase
MAIEDSANGRRPPTANVDSSGCDVKAHFVFIPLMFQGHLIPAADTALLLATHGALASIVVTPSNTGRIKPAVDFARKSGLAVRLVELPLDLAAEGLPDGADDVDKVPEGLWTNYFRALARLREPLERHLRAHAPYPTCVVADFCHPWARELAANLQVPRLAFFSMCAFCLLCQHNVERFHAYDGVADDHELVVVPGLEKKVEVSRAQAPGFFRGVPGFEKFADDVEQVLAEADGVVTNSFVEMEPEYVAGYAEARAMKVWTVGPVSLFHQRSTATLASRGNTAAIGADECLRWLDGKEPNSVVYVSFGSLAHARQKQVVELGLGLEASGHPFIWVVKNAAAGEEVAEFLHDLEARVAGRGLLIRGWAPQVLILSHAAIGSFVTHCGWNSTMEAITAGLPVVAWPHFSDQFLNAKFAVEVLGIGVDVGVTEPLMYQLEEKEIVVARDVVEKAVREVMQGGGEGEERRRRARALAAKARTAVEKGGSSHANLLDLINCFKVDAGCRARPFGRSTA

SEQ ID NO: 19808 - DNA, 261 bp, Sorghum bicolor
  misc_feature: Ceres ANNOT ID no. 8735984
  misc_feature: Encodes the peptide sequence at SEQ ID NO 19809
atgtcgagccggaggtcccgcgcgtcggtgtcggaggaggagatcaacgagctcatctccaggctccagacgctgctccccagcgcgcgccgccgtggcggcagcgaggcgtcgacgacgaagctgctcaaggagacctgcagctacatcaagagcctgcaccgggaggtggacgacctgagcgaccgcctgtccgacctcatggccaccatggaccacaacagccccggcgccgagatcatccgcagcctcctccgctag

SEQ ID NO: 19809 - protein, 86 aa, Sorghum bicolor
  misc_feature: Useful for making plants with modulated nitrogen use efficiency
  misc_feature: Functional homolog of the protein sequence given in SEQ ID NO 14244
  misc_feature: Useful for making plants with altered terpenoid content
  misc_feature: Functional homolog of the protein sequence given in SEQ ID NO 14245
  misc_feature: Useful for making plants with modulated seedling growth
  misc_feature: Functional homolog of the protein sequence given in SEQ ID NO 14152
  misc_feature: Useful for making plants with altered lignin content
  misc_feature: Functional homolog of the protein sequence given in SEQ ID NO 14246
  misc_feature: Useful for making plants with modulated biomass
  misc_feature: Functional homolog of the protein sequence given in SEQ ID NO 14242
  misc_feature: Ceres ANNOT ID no. 8735984
  misc_feature (4)..(54): Pfam ID: HLH Pfam Description: Helix-loop-helix DNA-binding domain
MSSRRSRASVSEEEINELISRLQTLLPSARRRGGSEASTTKLLKETCSYIKSLHREVDDLSDRLSDLMATMDHNSPGAEIIRSLLR

SEQ ID NO: 19810 - DNA, 1020 bp, Sorghum bicolor
  misc_feature: Ceres ANNOT ID no. 8735997
  misc_feature: Encodes the peptide sequence at SEQ ID NO 19811
atggccggcggccgcgcgttccggccgtccgcgccgcgccgcgcggcgttcgcggctctgctcacgctcctcctcctcgcggcccgcctcgccaacccctccgcatttgccgacgaccccgacccgtcccccgagttcgatgaccccgcgttgtaccattacgccatcttctccgacaatgtgctcgccgtctccgtcgtggtggcctctgctgcgcgcgccgcggccgacccttcgcgccacgtcttccacgtggtcaccgcgcccatgtacctgcctgcattccgggtctggttcgcgcggcgcccgccgccgcttggcgtgcacgtccagctccttgcttactccgactttccattcctcaatgccaccaactcgcctgtggtcaggcagatcgacgccggcaacagggacgtcgagttgctggattacctgaggttctacctcccagatatgttcccgacgctgcggagggtggtccttttggaggacgatgtggtggtgcagaaggatttggcagcgctttggcaggtcgacttggatgggaaggtgaatggcgcagtggagacttgcttcggggggtttaggaggtataggaagtatctcaacttcacgcagcccattgtgcgggatcgattcaatcccagcgcctgtgcatgggcatatgggttaaatgtgttcgatcttgagacatggcggcgggatggttgcacagaattgttccatcagtatatggaaatgaatgaggatggcgagctgtgggatcctacatccattctaacagctgggctgatgtccttctatggcaataccaagccactggataagtcatggcatgtaatgggtcttggctataatccaagcatcagccctgaggcaatccgtagtgctgcagtgatacacttcgatgggaacatgaagccctggcttgatgttgctttgaaccaatacaaggccctgtggacaaagtatgtggacactgaaatggagttcctaacactctgtaactttggtctttga

SEQ ID NO: 19811 - protein, 339 aa, Sorghum bicolor
  misc_feature: Useful for making plants with altered cell wall content and/or composition
  misc_feature: Functional homolog of the protein sequence given in SEQ ID NO 14744
  misc_feature: Useful for making plants with altered carbohydrate content
  misc_feature: Functional homolog of the protein sequence given in SEQ ID NO 14745
  misc_feature: Ceres ANNOT ID no. 8735997
  misc_feature (20)..(313): Pfam ID: Glyco_transf_8 Pfam Description: Glycosyl transferase family 8
MAGGRAFRPSAPRRAAFAALLTLLLLAARLANPSAFADDPDPSPEFDDPALYHYAIFSDNVLAVSVVVASAARAAADPSRHVFHVVTAPMYLPAFRVWFARRPPPLGVHVQLLAYSDFPFLNATNSPVVRQIDAGNRDVELLDYLRFYLPDMFPTLRRVVLLEDDVVVQKDLAALWQVDLDGKVNGAVETCFGGFRRYRKYLNFTQPIVRDRFNPSACAWAYGLNVFDLETWRRDGCTELFHQYMEMNEDGELWDPTSILTAGLMSFYGNTKPLDKSWHVMGLGYNPSISPEAIRSAAVIHFDGNMKPWLDVALNQYKALWTKYVDTEMEFLTLCNFGL

SEQ ID NO: 19812 - DNA, 738 bp, Sorghum bicolor
  misc_feature: Ceres ANNOT ID no. 8736014
  misc_feature: Encodes the peptide sequence at SEQ ID NO 19813
atggagcccaagaatgaagagagcagcttgtggccttactggacaggtgcttggcctgatagccacctgcttgaagaggaagcgcttctctccggcctctccttaccaagcttgcacttccatccatcgtgctccaccattacatccaccaacattctgcaaggtgagctcgacgccatctttgaggatgatgtgctgaggcactgggatgacatggagcttcagtctggaaacaaggtagaggaggaagcaggcaacgagaggctgccgctgctttgctacaccgaggaggagaaggaagcagtgtcctcgaacaataaggtcgtcgtcagagcagcaggccagcaagcagtgagatcgccagaggagcaggtgctcacgttcgagctcgtgtcgcagtacttctacatgccgatcatgcaggcggcgcgggagctcaacgtcggcctcaccctcctcaagaagaggtgcagggaactgggcatccctaggtggccgcatcgcaagatgaagagcttgcagtccctcatcaagaatgtccaggaggcgggcaaggcgaccgatgaggagcagctgagggcgttggtggagatgttgcagcaggagaagcagcttctggagcagaggccgtatgagcagctagatgaaaagaccaagaggctcaggcaggcctgcttcaaggccaactacaagaagaaacggctcttggctctcaaaggaggggaggcaccaagatga

SEQ ID NO: 19813 - protein, 245 aa, Sorghum bicolor
  misc_feature: The sequence is a functional homolog of SEQ ID NO 962 in the 11/435,388 US patent application
  misc_feature: Ceres ANNOT ID no. 8736014
  misc_feature (122)..(173): Pfam ID: RWP-RK Pfam Description: RWP-RK domain
MEPKNEESSLWPYWTGAWPDSHLLEEEALLSGLSLPSLHFHPSCSTITSTNILQGELDAIFEDDVLRHWDDMELQSGNKVEEEAGNERLPLLCYTEEEKEAVSSNNKVVVRAAGQQAVRSPEEQVLTFELVSQYFYMPIMQAARELNVGLTLLKKRCRELGIPRWPHRKMKSLQSLIKNVQEAGKATDEEQLRALVEMLQQEKQLLEQRPYEQLDEKTKRLRQACFKANYKKKRLLALKGGEAPR

SEQ ID NO: 19814 - DNA, 1728 bp, Sorghum bicolor
  misc_feature: Ceres ANNOT ID no. 8736030
  misc_feature: Encodes the peptide sequence at SEQ ID NO 19815
atggcctccttagccgcggtggcgggggcgtggctcgagcccgacatccacgggccgacggccgtgctcccgcgccggctgtggccgtcgtggtcgggaggcggcggccgcgccgagctgttcccgttcccgctgcttggctgggcgtggccggcgtcgggcggcggcgaggcgctgcgggccgcgtgggacgcggcgcgcgcggcggccgtggcgccggcgctggccgccgcgtcgtgggtctgcctggccctgtcggccatgctcctcgcggacgccgtgttcctggccgccgccagcctcctggcgcggcggaggaggccgtaccgggcgccgggccccattgctagtgctggccccgccgccgaggaggaggacgacggggacggggatgaggaggctggccgcaccgtcggctaccccgtggtgctcgtccaaatccccatgtacaacgagcgggaggtgtacaagctttccattggagcagcatgcgggatgtcgtggccgtcggatagggtcatcgtacaggttctcgacgattccactgatccgacggatctggtggagcttgaatgcaagttttgggctaacaaaggcaagaacgtaaaatatgaggtgaggaacaatcggaaaggttacaaggcgggtgcgcttaaacaagggatgctctacgactatgttcaacagtgtgattttgtcgctgtgtttgatgctgatttccaaccagaacctgacttcctcatgaggaccatcccatatcttgttcataatccacgaattggtcttgttcaggcgcggtgggaatttgttaatcacaatgaattcctgatgacaaggatacaaaagatgacattagattatcacttcaaagtagagcaggaagcaggttcatccatctttggcttctttggttttaacggaactgctggtgtctggagaatttcttctatcaaggaagctggaggctgggaggatcgaaccactgtggaagacatggatttagcagtcagagcaggtctgaaaggatggaaattcatctatgttggggatgttaaggtgaaaagtgaactgccaagcaatctgaaggcatatcgccgtcaacaacatcggtggacatgtggggcagcaaatttattccggaagacgggagtggaaattattctgactaaggaggtgtcgctttggaggaagctctatctgatctacagcttctttttcattaggaaggttgttgcccatgtggtacctttcatgctctactgtgtagtaattcctttatctgtccttattcctgaggtcagtgttcctgtatggggggtggtttatatcccaacaacaataacacttctttacgccatcagaaatccaagttctatccatttcataccattctggatcctttttgagaatgtgatgtcttttcaccgaacaaaggccacattcatcggtttgctcgagcttgggagtgtaaacgagtgggttgtcactgagaagcttggtaattcaaacggcaccaagtctgtgccacaaatacttgaaaagcctcgctgcaggttttgggacagatgcatcatatcagagattttagtcgccgccttcctcttcttctgtgccacatacaacttggttttaggagacgacttctatttcgtttacatatatttacaggcaataacatttcttattgttggcaccggtttctgcggaacatccagctccaactcataa

SEQ ID NO: 19815 - protein, 575 aa, Sorghum bicolor
  misc_feature: Useful for making plants with altered cell wall content and/or composition
  misc_feature: Functional homolog of the protein sequence given in SEQ ID NO 13963
  misc_feature: Useful for making plants with altered carbohydrate content
  misc_feature: Functional homolog of the protein sequence given in SEQ ID NO 13964
  misc_feature: Ceres ANNOT ID no. 8736030
  misc_feature (140)..(500): SWISSPROT Homolog: EC 2.4.1.12 Cellulose synthase (UDP-forming)
MASLAAVAGAWLEPDIHGPTAVLPRRLWPSWSGGGGRAELFPFPLLGWAWPASGGGEALRAAWDAARAAAVAPALAAASWVCLALSAMLLADAVFLAAASLLARRRRPYRAPGPIASAGPAAEEEDDGDGDEEAGRTVGYPVVLVQIPMYNEREVYKLSIGAACGMSWPSDRVIVQVLDDSTDPTDLVELECKFWANKGKNVKYEVRNNRKGYKAGALKQGMLYDYVQQCDFVAVFDADFQPEPDFLMRTIPYLVHNPRIGLVQARWEFVNHNEFLMTRIQKMTLDYHFKVEQEAGSSIFGFFGFNGTAGVWRISSIKEAGGWEDRTTVEDMDLAVRAGLKGWKFIYVGDVKVKSELPSNLKAYRRQQHRWTCGAANLFRKTGVEIILTKEVSLWRKLYLIYSFFFIRKVVAHVVPFMLYCVVIPLSVLIPEVSVPVWGVVYIPTTITLLYAIRNPSSIHFIPFWILFENVMSFHRTKATFIGLLELGSVNEWVVTEKLGNSNGTKSVPQILEKPRCRFWDRCIISEILVAAFLFFCATYNLVLGDDFYFVYIYLQAITFLIVGTGFCGTSSSNS

SEQ ID NO: 19816 - DNA, 936 bp, Sorghum bicolor
  misc_feature: Ceres ANNOT ID no. 8736048
  misc_feature: Encodes the peptide sequence at SEQ ID NO 19817
atggcgatcatctccgacttcaaggaggacgaggctccgcagcaggcggcggctgcgccggcgaacggccccggcgtcgaggaggccctcgtggcggcgctggagaggagcggcggcgcgctccccttcctcgaggcggccatcgatgtcgcccaccgcaggtccggactgttccgcgaccctgcggcggtgagcaaggtcaccgcgatggcggcggccgtcagggcgcaggtggaggccgaggagagggcggccagggaggccaagagaaaggtggaggagaccgagaggaaggctgccgccgaggcgcagaaggttgccaaggagactgcggctgcggcggcggcggcggtggagaagccagagagctcggtggagaaggacagcatggaagtggataagaaggaggaaggcaacgtgagacaaccaaatgctggaaatggtcttgatttggagaagtactcgtggactcaacagttgccagaggttaacatcaccattcctgttcctcaaggaacaaaatcaagatttgtggtctttgatataaagaagaatcatctgaaggttggtctgaagggccagccacctatcattgatggcgagctccataagccagttaaggttgatgactgcttctggagcatagaggatggaaaaactctatccatattgcttacaaagcacaaccaaatggagtggtggaagtctgttataaagggtgaccctgaagttgatacccaaaaggtggaacccgagagcagcaaactctctgatttggatcctgagactagacaaaccgtggagaagatgatgtttgaccagcgccagaagcagatgggccttccaactagtgatgaaatgcaaaagcaagaaattctcaagaagttcatgtctgagcacccggagatggacttctctagagcaaaattagcttga

SEQ ID NO: 19817 - protein, 311 aa, Sorghum bicolor
  misc_feature: Useful for making plants with modulated biomass
  misc_feature: Functional homolog of the protein sequence given in SEQ ID NO 14746
  misc_feature: Ceres ANNOT ID no. 8736048
  misc_feature (152)..(227): Pfam ID: CS Pfam Description: CS domain
MAIISDFKEDEAPQQAAAAPANGPGVEEALVAALERSGGALPFLEAAIDVAHRRSGLFRDPAAVSKVTAMAAAVRAQVEAEERAAREAKRKVEETERKAAAEAQKVAKETAAAAAAAVEKPESSVEKDSMEVDKKEEGNVRQPNAGNGLDLEKYSWTQQLPEVNITIPVPQGTKSRFVVFDIKKNHLKVGLKGQPPIIDGELHKPVKVDDCFWSIEDGKTLSILLTKHNQMEWWKSVIKGDPEVDTQKVEPESSKLSDLDPETRQTVEKMMFDQRQKQMGLPTSDEMQKQEILKKFMSEHPEMDFSRAKLA

SEQ ID NO: 19818 - DNA, 1728 bp, Sorghum bicolor; identical to SEQ ID NO: 19814
  misc_feature: Ceres ANNOT ID no. 8736028
  misc_feature: Encodes the peptide sequence at SEQ ID NO 19819

SEQ ID NO: 19819 - protein, 575 aa, Sorghum bicolor; identical to SEQ ID NO: 19815
  misc_feature: Useful for making plants with altered cell wall content and/or composition
  misc_feature: Functional homolog of the protein sequence given in SEQ ID NO 13963
  misc_feature: Useful for making plants with altered carbohydrate content
  misc_feature: Functional homolog of the protein sequence given in SEQ ID NO 13964
  misc_feature: Ceres ANNOT ID no. 8736028
  misc_feature (140)..(500): SWISSPROT Homolog: EC 2.4.1.12 Cellulose synthase (UDP-forming)

SEQ ID NO: 19820 - DNA, 648 bp, Sorghum bicolor
  misc_feature: Ceres ANNOT ID no. 8736075
  misc_feature: Encodes the peptide sequence at SEQ ID NO 19821
atggcatccagcgcctcccggttcatcaagtgcgtcacagtgggggacggcgccgtgggaaagacctgcatgctcatctgctacaccagcaacaagttccccactgattacatacccactgtcttcgataacttcagtgcaaacgtggtggtcgacggcaccaccgtgaatttgggcctttgggatactgcagggcaggaagattacaacagattgaggccactgagctaccgcggagcagatgtgttcgtgctcgctttctcgcttgtcagccgagctagctacgagaatgttatgaagaagtggctaccggagcttcagcattatgcaccgggtgtacccatagtgttggctggaactaaattggatcttcgtgaagataagcactacttacttgaccatcctggcgcagtacctgttactacagcacagggggaggaacttcgcaagcacattggcgcaacttgttacatcgagtgcagctcaaaaactcagcagaatgtgaaagctgtgtttgatgctgccatcaaggtagtaatccggcctccgaccaagcagcgagaaaggaagaaaaagaaagcacggcgaggatgctcaatgttttgcagccgtatcatgcacacaaggagactaggatgcttcaagtga

SEQ ID NO: 19821 - protein, 215 aa, Sorghum bicolor
  misc_feature: Useful for making plants with modulated nitrogen use efficiency
  misc_feature: Functional homolog of the protein sequence given in SEQ ID NO 13110
  misc_feature: Ceres ANNOT ID no. 8736075
  misc_feature (10)..(181): Pfam ID: Ras Pfam Description: Ras family
  misc_feature (10)..(123): Pfam ID: Miro Pfam Description: Miro-like protein
MASSASRFIKCVTVGDGAVGKTCMLICYTSNKFPTDYIPTVFDNFSANVVVDGTTVNLGLWDTAGQEDYNRLRPLSYRGADVFVLAFSLVSRASYENVMKKWLPELQHYAPGVPIVLAGTKLDLREDKHYLLDHPGAVPVTTAQGEELRKHIGATCYIECSSKTQQNVKAVFDAAIKVVIRPPTKQRERKKKKARRGCSMFCSRIMHTRRLGCFK

SEQ ID NO: 19822 - DNA, 639 bp, Sorghum bicolor
  misc_feature: Ceres ANNOT ID no. 8736070
  misc_feature: Encodes the peptide sequence at SEQ ID NO 19823
atgtcgttcgacggcctcacgttcgcgggtgcaggggtcacgggtgcagcatggcgtccggcagcggcccgtcacgagggagatcgcggaggtggcgggacacaggccgcggaggcggatgtggctgcggacgggattgagccggtggatcctcaggatattgtcatgcttgtcatatcatggcacatgaaagccgccacaatgtgtgaatttactcgtcaggaattcattggtggactgcagtcaattggggtagattcaatcgagaagttccgtggaaagttaccatcattacgagctgagctaaaagatgacaataagttccgtgatatatacaactttgcattcacttgggcaagggaaaagggtcaaaagtctctctcactggagactgctattggaatgtggcagttgctatttgctgaaaggaactggcctcttctcgagcattggtgtcagtttttacaggtcaggcacaataaagccatatctagagacacatgggcccagctgctggaatttgtaaagacgatcgatccacagctatccaactatgacgacgaaggtgcctggccctacctcatagacgaatttgtggaatatctgactgagaatggattggtccagcgtaaaagatga

SEQ ID NO: 19823 - protein, 212 aa, Sorghum bicolor
  misc_feature: Useful for making plants with altered lignin content
  misc_feature: Functional homolog of the protein sequence given in SEQ ID NO 13194
  misc_feature: Ceres ANNOT ID no. 8736070
MSFDGLTFAGAGVTGAAWRPAAARHEGDRGGGGTQAAEADVAADGIEPVDPQDIVMLVISWHMKAATMCEFTRQEFIGGLQSIGVDSIEKFRGKLPSLRAELKDDNKFRDIYNFAFTWAREKGQKSLSLETAIGMWQLLFAERNWPLLEHWCQFLQVRHNKAISRDTWAQLLEFVKTIDPQLSNYDDEGAWPYLIDEFVEYLTENGLVQRKR

SEQ ID NO: 19824 - DNA, 873 bp, Sorghum bicolor
  misc_feature: Ceres ANNOT ID no. 8736115
  misc_feature: Encodes the peptide sequence at SEQ ID NO 19825
atggcttccgaggtgcgcgcatggcttctcctcctcgtcgtcgtcctcctagccgggggtgctagcttgtggccggcagcaggggcagcgccggcgctgccgctcgacgtcaactatgtgaaggactgggggcgcctggtcgatcacgggactgaggttgatctcatcttggatcagagcaccgcggctcgtggtggtgggttcaagtccaaggtcacgtacgggtcagggttcttccacttgaggatgaagctgccgtccggctacacggccggcgtcgtcacaaccttctaccttatttcggagccggaagacggcacccgtgacgaggtggacttcgagttcctgggcgacaaggccggcgtgcccatcaccctccaaaccaacttcttcgtcaacggccacggccagagggagcagcggcttcacctctggttcgacccttccgccgacttccatgactacaagatcctctggaacccctaccagctcgtgatgttcgtggacgagacgccgatccgggtggtgcgcaacctgaggagcaccgtgccggggtacgagttcccaacgaagccgatgctgatccgcgcgagcatctgggacggctcctcctgggccacggacggcgggcgaaccaaggtggactggtccaaggcaccgttcacggctgggtaccagggattcgacgtcgacggctgcgccacgggcagcgcgacgccgtgcgactcgccggccctgtggtggaacggcggcggctaccgggacctcaccccgcagcagcgggcggcctacgagggcgtcaagaggaagtacatgatctccgactactgcgccaacaagaaaggccgcaagatcgagtgcagctattcttga

SEQ ID NO: 19825 - protein, 290 aa, Sorghum bicolor
  misc_feature: Useful for making plants with altered cell wall content and/or composition
  misc_feature: Functional homolog of the protein sequence given in SEQ ID NO 14747
  misc_feature: Ceres ANNOT ID no. 8736115
  misc_feature (38)..(280): SWISSPROT Homolog: EC 2.4.1.207 Xyloglucan:xyloglucosyl transferase
  misc_feature (35)..(218): Pfam ID: Glyco_hydro_16 Pfam Description: Glycosyl hydrolases family 16
  misc_feature (233)..(287): Pfam ID: XET_C Pfam Description: Xyloglucan endo-transglycosylase (XET) C-terminus
MASEVRAWLLLLVVVLLAGGASLWPAAGAAPALPLDVNYVKDWGRLVDHGTEVDLILDQSTAARGGGFKSKVTYGSGFFHLRMKLPSGYTAGVVTTFYLISEPEDGTRDEVDFEFLGDKAGVPITLQTNFFVNGHGQREQRLHLWFDPSADFHDYKILWNPYQLVMFVDETPIRVVRNLRSTVPGYEFPTKPMLIRASIWDGSSWATDGGRTKVDWSKAPFTAGYQGFDVDGCATGSATPCDSPALWWNGGGYRDLTPQQRAAYEGVKRKYMISDYCANKKGRKIECSYS

SEQ ID NO: 19826 - DNA, 426 bp, Sorghum bicolor
  misc_feature: Ceres ANNOT ID no. 8736124
  misc_feature: Encodes the peptide sequence at SEQ ID NO 19827
atggccgtggtgatgaagcagcaggatcctttagaggaagcaattgaggccatcagatccttcaggtacctttgctccaagcagtctcaggaatccctcggcaacctcctcattgatctacacaaggcgacgaagaaagcacggacccatggcaagaagtttcaggtctcaaaccaacaggagacgtctcgcattctgggcgaacatgcagtgcaacaacttccaagctgcactgaaatggtgtaccgcaatgcacaaacaattgagtctgatgccaacagggcgtgcaaccttgggctgtgcctgattaatcagagggtaggcaagaggaggcacgagaagcgctttcaactacgaagaatactactatatgagatcagaagatcgatgcatgaaaaagttgttgctcgtgctgagcagcattaa

SEQ ID NO: 19827 - protein, 141 aa, Sorghum bicolor
  misc_feature: Useful for making plants with altered terpenoid content
  misc_feature: Functional homolog of the protein sequence given in SEQ ID NO 13067
  misc_feature: Ceres ANNOT ID no. 8736124
MAVVMKQQDPLEEAIEAIRSFRYLCSKQSQESLGNLLIDLHKATKKARTHGKKFQVSNQQETSRILGEHAVQQLPSCTEMVYRNAQTIESDANRACNLGLCLINQRVGKRRHEKRFQLRRILLYEIRRSMHEKVVARAEQH

SEQ ID NO: 19828 - DNA, 1158 bp, Sorghum bicolor
  misc_feature: Ceres ANNOT ID no. 8736202
  misc_feature: Encodes the peptide sequence at SEQ ID NO 19829
atgggcggcgccgcgatgtgggccgctgctttggcggcgacggtggtcttcttggccgtcgaggtttcgggtgccgcgggggcgttgccgaggttcgcggaggcgccggagtaccggaacggggaagggtgcccggctgcggcggcgggggtgtgcgacccgggcttggtgcacatcgccatgacgctggacgcgcactacctgcgtggctccatggcggcggtgtactcgctgctcaagcacgcgtcctgcccggagtccatcttcttccacttcctggccgcggaggcagacggggaggaggacccggagccggagctgctgcggcgcgcggtcgcggcgtcgttcccgtcgctgcggttcgagatctacccgttccgcgccgaggccgtggccgggctcatctcggcgtccgtgcgcgccgcgctcgaggcgccgctcaactacgcgcggaaccacctggccgacctgctcccgcgctgcgtgccgcgggcgatatacctcgactccgacgtgctcgccgccgacgacgtcaggcgcctctgggagacgcgcctccccgccgccgccgtcgtggcggcgcccgagtactgccacgccaacttctcccgctacttcacgcccgcgttctggtctgacccggagctcggcgcccgcgtcttcgcggggcgccgccgcccgccctgctacttcaacaccggcgtcatggtcatcgacctccgccgctggcgcgccgggaactaccgccagcgcatcgagcgctggatggaaatccagaaggtgaagcgcatctacgagctgggctccctgcccccgttcctgctcgtcttcgccggcgaggtggaggccgtcgaccaccgctggaaccagcacggcctcggcggcgacaacgtccacggcagctgccgcccgctccacgccgggcccgtcagcctcatgcactggtcgggcaagggcaagccatgggaccgcctcgacgccggcaggccgtgcccgctcgaccacacctggaagtcgtacgacctctacatccccagcgactcctccggcgccgcctctccggcctccgggccggcattgtccgcatccgtgctctcatgggcggcgaagggagcggccgtggcgacatggcaggggaaatcaggaatgggttggtag

SEQ ID NO: 19829 - protein, 385 aa, Sorghum bicolor
  misc_feature: Useful for making plants with altered cell wall content and/or composition
  misc_feature: Functional homolog of the protein sequence given in SEQ ID NO 14009
  misc_feature: Useful for making plants with altered carbohydrate content
  misc_feature: Functional homolog of the protein sequence given in SEQ ID NO 14010
  misc_feature: Ceres ANNOT ID no. 8736202
  misc_feature (58)..(326): Pfam ID: Glyco_transf_8 Pfam Description: Glycosyl transferase family 8
MGGAAMWAAALAATVVFLAVEVSGAAGALPRFAEAPEYRNGEGCPAAAAGVCDPGLVHIAMTLDAHYLRGSMAAVYSLLKHASCPESIFFHFLAAEADGEEDPEPELLRRAVAASFPSLRFEIYPFRAEAVAGLISASVRAALEAPLNYARNHLADLLPRCVPRAIYLDSDVLAADDVRRLWETRLPAAAVVAAPEYCHANFSRYFTPAFWSDPELGARVFAGRRRPPCYFNTGVMVIDLRRWRAGNYRQRIERWMEIQKVKRIYELGSLPPFLLVFAGEVEAVDHRWNQHGLGGDNVHGSCRPLHAGPVSLMHWSGKGKPWDRLDAGRPCPLDHTWKSYDLYIPSDSSGAASPASGPALSASVLSWAAKGAAVATWQGKSGMGW

SEQ ID NO: 19830 - DNA, 1482 bp, Sorghum bicolor
  misc_feature: Ceres ANNOT ID no. 8736383
  misc_feature: Encodes the peptide sequence at SEQ ID NO 19831
atggcgggctcgtcggcggctcatccgcagctgaagcagctcaagccgctgtaccagcacgtggtgaacaacttcgtcgccgtgctcgctgcgccgctggccgtggcggccgtcgtcaacgcggcgcgcgtcggtcccgacgagctcctcgcccgggtgcaggcggtccgcgcggtgcacgcgttcctcgccgtgttcgtcgcggccgccgccgcgacgctgtacgtgatgctccgtccccggtccgtgtacctggtggactacgcctgcttccgcactcggcccaactgccgcgtccccttcgccaccttcctggagcacgccaagctggtgaccttcgtggagggcgcctccatcgacgagcgcagcgtccggttcatgacgcggctcctggagcgctccggcctcggcgaggagacctgcctcccccccgcgcaccactacatcccgccgtaccggaacatggaggcctcgcgcgcggaggtggagctggtcatcttctcggccatcgacgacctcctcgccaagacgggcatcagcccggccgccatcgacatcctggtggtgaactgcagcctgttcgcgcccatcccgtcgttcacggacatgatcatccacaggtacgggatgcggccggacatccgcaacgtgcacctctccgggatgggctgcagcgcggggctcgtctccgtgggtctcgccaagaacttcctccaggtggctccgaagggcgcgcacgcgctggtggtgtcgacggagaccatcacccccaactactacgtgggcaaggagcgcgccatgctgctgcccaactgcctcttccgcatgggcggcgccgccgtgctgctgtcgacgtcccgcggcagggccaggttccgcctcgcccgcgtggtgcgcacgctgacgggcgcgcaggacagcgcgtaccggtgcgtgttccaggaggaggacggcgagggccaccgcgggatcaacctgtcaaaggacctgatgaccatcgcgggggacgcgctcaaggccaacatcacggccatcgggcccctggtgctgccggcgtcggagcagctcctgttcgcgctgtccttcatcgcgcggcgcgtgctgaaccggcgcgtgaagccgtacctgccggacttccgcacggcgttcgagcacttctgcatccacgcgggcgggcgcgccgtcatcgacgagctgcagcggagcctggggctgtcggacgaggacgtggaggcgtcgcggatggcgctgcaccggttcggcaacacgtccagcagctcggtgtggtacgagctggcgtacatcgaggcaaaaggacggatgcgacggggagaccgcgtgtggatgattgggtttgggtccgggttcaagtgcaacagcgcggcgtgggagtgcatcgcgcccgcgcgcaccgccgagggaccctgggcggagagcatcagccgctaccccgtccacatcccagaggtgctcaagcactaa

SEQ ID NO: 19831 - protein, 493 aa, Sorghum bicolor
  misc_feature: The sequence is a functional homolog of SEQ ID NO 2 in US patent 7038112
  misc_feature: Ceres ANNOT ID no. 8736383
  misc_feature (73)..(487): SWISSPROT Homolog: EC 2.3.1.119 Icosanoyl-CoA synthase
  misc_feature (75)..(367): Pfam ID: FAE1_CUT1_RppA Pfam Description: FAE1/Type III polyketide synthase-like protein
  misc_feature (383)..(465): Pfam ID: ACP_syn_III_C Pfam Description: 3-Oxoacyl-[acyl-carrier-protein (ACP)] synthase III C terminal
MAGSSAAHPQLKQLKPLYQHVVNNFVAVLAAPLAVAAVVNAARVGPDELLARVQAVRAVHAFLAVFVAAAAATLYVMLRPRSVYLVDYACFRTRPNCRVPFATFLEHAKLVTFVEGASIDERSVRFMTRLLERSGLGEETCLPPAHHYIPPYRNMEASRAEVELVIFSAIDDLLAKTGISPAAIDILVVNCSLFAPIPSFTDMIIHRYGMRPDIRNVHLSGMGCSAGLVSVGLAKNFLQVAPKGAHALVVSTETITPNYYVGKERAMLLPNCLFRMGGAAVLLSTSRGRARFRLARVVRTLTGAQDSAYRCVFQEEDGEGHRGINLSKDLMTIAGDALKANITAIGPLVLPASEQLLFALSFIARRVLNRRVKPYLPDFRTAFEHFCIHAGGRAVIDELQRSLGLSDEDVEASRMALHRFGNTSSSSVWYELAYIEAKGRMRRGDRVWMIGFGSGFKCNSAAWECIAPARTAEGPWAESISRYPVHIPEVLKH

SEQ ID NO: 19832 - DNA, 1473 bp, Sorghum bicolor
  misc_feature: Ceres ANNOT ID no. 8736394
  misc_feature: Encodes the peptide sequence at SEQ ID NO 19833
atgagctcgccacctctgttcggcaacggcaagggcctcaaggccgtgtgccgccgcgtggtggacaacatcctcgccgtcgtgacggtgccgctcacggccgccgcgctggtcgccatggcgcggttcgggccggaggaacaactggccggccagttccgcgaggcgcggcccgtgcacgtcttcttggcggcgttcgtccctgccgcggctgccacggtgtacctgatgctgcgcccgcgcgcggtgtacctggtggactacgcctgcttccgcacggcgtccaactgccgcgtccccttctccacgttcctggagcacgccaagcaggtgcccgtgctcgacgagcgcagcatccggttcatgaccaagctgctggagcgctcgggtctcggggaggagacgtgcctgccccccgcgcaccactacatcccgccctacaactactgcaccctcgacgcggcgcgcggcgaggtcgacctcgtcgtcttctccgcgctcgacgacctgttcgccaagacgggcatcagcgccggcgccatcgacatcgtcgtcgtcaactgcagcctcttctgccccacgccgtccttcgtcgacatgatcgtccacaggtacaagctgcgcagcgacgtccgcagcgtgcacctctccggcatggggtgcagcgccgggctcatctccgtggggcttgccaggaacctcctccaggtcgctccgaaaggcacgcacgcgctggttgtctccacggagaccatcacgccaaactactacgtgggcagcgagcgcgctatgctcctgcccaactgcctgttccgcgtaggcggcgccgcggcgctgctgtcgaactccccggacaaggcaaggttccgcctgaagcacgtcgtgcgcacgctcaccggcgcgcaggacagcgcgtacacgtgcgtgttccagcaggaggacgacaacggcaacgtgggcatcaacctgaacaaggacctgatgaccatcgccgggaacgcgctcaaggccaacatcaccgccatgggacccctcgtcctcccggcatcagagcagctgctgttcgcgctctccttcatcgcgcggaaggtgatcagcggcaagttcaagccgtacctgccggacttccgcacggcgttcgagcacttctgcatccacgcgggcgggcgcgccgtcatcgacgagctgcagcgcagcctgggcctgtcggacgagcaggtagaggcgtcgaggatgacgctgcaccggttcgggaacacgtcgagcagctcgctgtggtacgagctggcctacatggaggccaaggggtgtatgcggaggggtgaccgcgtgtggatgattgggtttgggtccgggttcaagtgcaacagcgcggcgtgggagtgcatcgagcccgcgcgcaccgccgagggaccctgggccacgtccatccacaggtacccggtgcacattccagacgtgatgaagcactaa

SEQ ID NO: 19833 - protein, 490 aa, Sorghum bicolor
  misc_feature: The sequence is a functional homolog of SEQ ID NO 2 in US patent 7038112
  misc_feature: Ceres ANNOT ID no. 8736394
  misc_feature (75)..(484): SWISSPROT Homolog: EC 2.3.1.119 Icosanoyl-CoA synthase
  misc_feature (75)..(364): Pfam ID: FAE1_CUT1_RppA Pfam Description: FAE1/Type III polyketide synthase-like protein
  misc_feature (380)..(462): Pfam ID: ACP_syn_III_C Pfam Description: 3-Oxoacyl-[acyl-carrier-protein (ACP)] synthase III C terminal
MSSPPLFGNGKGLKAVCRRVVDNILAVVTVPLTAAALVAMARFGPEEQLAGQFREARPVHVFLAAFVPAAAATVYLMLRPRAVYLVDYACFRTASNCRVPFSTFLEHAKQVPVLDERSIRFMTKLLERSGLGEETCLPPAHHYIPPYNYCTLDAARGEVDLVVFSALDDLFAKTGISAGAIDIVVVNCSLFCPTPSFVDMIVHRYKLRSDVRSVHLSGMGCSAGLISVGLARNLLQVAPKGTHALVVSTETITPNYYVGSERAMLLPNCLFRVGGAAALLSNSPDKARFRLKHVVRTLTGAQDSAYTCVFQQEDDNGNVGINLNKDLMTIAGNALKANITAMGPLVLPASEQLLFALSFIARKVISGKFKPYLPDFRTAFEHFCIHAGGRAVIDELQRSLGLSDEQVEASRMTLHRFGNTSSSSLWYELAYMEAKGCMRRGDRVWMIGFGSGFKCNSAAWECIEPARTAEGPWATSIHRYPVHIPDVMKH

SEQ ID NO: 19834 - DNA, 1368 bp, Sorghum bicolor
  misc_feature: Ceres ANNOT ID no. 8736468
  misc_feature: Encodes the peptide sequence at SEQ ID NO 19835
atggcgcgggcctcacgggctcacccctggccgcgcgagagccatggatggacttgccatctcctcctctttctctcggtgctctcagtttggaaaactatgctccatagcgcccgcgcgcccaactctggtgagcttctcgccaccgaccatggccccaaccccagctccaagtcctccagcagcctcagcgccgccgccaccttcgcgccgccgctcgccgccgccgcgcatggaggagtagcggcggtgccgtttggcatggtgccgccgggggtggcgacggcggatgacgcccggttctgcatgccgtgggcgactccggcgcacttcgagaactggggcgactccggcatcgtcgtcacgagcccgctcgccgagacggcctccaccgacgtcgacgacgtcagcggcggcaaccaccaccacgacgcgcacatgggtgttgccatcacgcggagcgtcgacggacacgagaactcattgccggtgtgcaaggtagaatcgagggatcacaaggcgcagaggaggcttgcgcaaaaccgagaggccgccaggaaaagccggatgaggaagaaggcatacattgtggagctggagaacagccggtccaagctggctcagcttgagcaggagcttcaaagggcaaggcagcaggggatgttcattgcaagtggacggtccggcgcgctggcgttcgatctggagtacgcccggtggctggacgagcaccagcaccacatgaacgacctccgtgtggccctgagcgcgcagatcggcgacgacgacctgggcgtgctggtggacggcgtgatgctgcactacgacgagatgttccggctcaagggcgtggccacccggacggacgtgttccacgtgctgtcgggcatgtggatgagccccgcggagcggttcttcatgtggctgggcgggttccggtcgtcggagctgctcaaggtggtggcgcggcaggtggagccgcagctgacggagcagcagctggtgggcatctgcagcctgcagcagtcgctgcagcaggcggaggacgcgctgtcgcaggggatggaggccctgcagcagggcctcggggacacgctcgccgccgccgccccggcggcgcccggaccgtccgcgtccgccgccgacagcgtcaccaactacatgggccagatggccgtcgccatgagcaagctcgccaccgtggagaacttcctccggcaggcggacctgctgcggcagcagacgctgaagcaggtgcaccggatcctgaccacccgccaggccgcgcgcgcgctgctcgtcgtcagcgactacttctcgcggctccgagcgctcagctccctgtggctgacgcgccccacggattga

SEQ ID NO: 19835 - protein, 455 aa, Sorghum bicolor
  misc_feature: The sequence is a functional homolog of SEQ ID NO 1496 in the 10/374,780 US patent application
  misc_feature: The sequence is a functional homolog of SEQ ID NO 1566 in the 10/412,699 US patent application
  misc_feature: The sequence is a functional homolog of SEQ ID NO 1878 in the 10/412,699 US patent application
  misc_feature: The sequence is a functional homolog of SEQ ID NO 2138 in the 10/374,780 US patent application
  misc_feature: The sequence is a functional homolog of SEQ ID NO 372 in the 10/225,066 US patent application
  misc_feature: The sequence is a functional homolog of SEQ ID NO 878 in the 11/435,388 US patent application
  misc_feature: The sequence is a functional homolog of SEQ ID NO 1792 in the 10/412,699 US patent application
  misc_feature: The sequence is a functional homolog of SEQ ID NO 2030 in the 10/374,780 US patent application
  misc_feature: The sequence is a functional homolog of SEQ ID NO 206 in the 10/225,068 US patent application
  misc_feature: The sequence is a functional homolog of SEQ ID NO 356 in the 10/412,699 US patent application
  misc_feature: The sequence is a functional homolog of SEQ ID NO 831 in the 11/479,226 US patent application
  misc_feature: The sequence is a functional homolog of SEQ ID NO 934 in the 11/435,388 US patent application
  misc_feature: The sequence is a functional homolog of SEQ ID NO 1492 in the 10/374,780 US patent application
  misc_feature: The sequence is a functional homolog of SEQ ID NO 1562 in the 10/412,699 US patent application
  misc_feature: The sequence is a functional homolog of SEQ ID NO 1794 in the 10/412,699 US patent application
  misc_feature: The sequence is a functional homolog of SEQ ID NO 2032 in the 10/374,780 US patent application
  misc_feature: The sequence is a functional homolog of SEQ ID NO 380 in the 10/412,699 US patent application
  misc_feature: The sequence is a functional homolog of SEQ ID NO 534 in the 10/225,066 US patent application
  misc_feature: The sequence is a functional homolog of SEQ ID NO 936 in the 11/435,388 US patent application
  misc_feature: Useful for making plants with modulated biomass
  misc_feature: Functional homolog of the protein sequence given in SEQ ID NO 13416
  misc_feature: The sequence is a functional homolog of SEQ ID NO 242 in the 10/374,780 US patent application
  misc_feature: The sequence is a functional homolog of SEQ ID NO 764 in the 10/412,699 US patent application
  misc_feature: The sequence is a functional homolog of SEQ ID NO 826 in the 10/225,066 US patent application
  misc_feature: The sequence is a functional homolog of SEQ ID NO 950 in the 11/435,388 US patent application
  misc_feature: The sequence is a functional homolog of SEQ ID NO 96 in the 11/375,241 US patent application
  misc_feature: Ceres ANNOT ID no. 8736468
  misc_feature (169)..(221): Pfam ID: bZIP_1 Pfam Description: bZIP transcription factor
MARASRAHPWPRESHGWTCHLLLFLSVLSVWKTMLHSARAPNSGELLATDHGPNPSSKSSSSLSAAATFAPPLAAAAHGGVAAVPFGMVPPGVATADDARFCMPWATPAHFENWGDSGIVVTSPLAETASTDVDDVSGGNHHHDAHMGVAITRSVDGHENSLPVCKVESRDHKAQRRLAQNREAARKSRMRKKAYIVELENSRSKLAQLEQELQRARQQGMFIASGRSGALAFDLEYARWLDEHQHHMNDLRVALSAQIGDDDLGVLVDGVMLHYDEMFRLKGVATRTDVFHVLSGMWMSPAERFFMWLGGFRSSELLKVVARQVEPQLTEQQLVGICSLQQSLQQAEDALSQGMEALQQGLGDTLAAAAPAAPGPSASAADSVTNYMGQMAVAMSKLATVENFLRQADLLRQQTLKQVHRILTTRQAARALLVVSDYFSRLRALSSLWLTRPTD

SEQ ID NO: 19836 - DNA, 345 bp, Sorghum bicolor
  misc_feature: Ceres ANNOT ID no. 8736497
  misc_feature: Encodes the peptide sequence at SEQ ID NO 19837
atggcgagcaaggtggtctccatcctggtgctcgcattcctgctcctcgccgccgtcgccgtccccgtgtctgcaggtccgcggcagcgggggaagaacggcggtggcggcgccggcggcggtggtgggagcccaagtggtggcggcaacctgaagccctgggagtgctcgcccaagtgcgcgtcgcggtgctcgcagacgcagtacaagaaggcctgcctcaccttctgcaacaagtgctgcgccacgtgcctctgcgtgccgccgggcttctacggcaacaagggcgcctgcccctgctacaacaactggaagaccaaggaaggagggcccaagtgcccctag

SEQ ID NO: 19837 - protein, 114 aa, Sorghum bicolor
  misc_feature: Useful for making plants with altered alkaloid content
  misc_feature: Useful for making plants with modulated nitrogen use efficiency
  misc_feature: Functional homolog of the protein sequence given in SEQ ID NO 12973
  misc_feature: Useful for making plants with modulated oxidative stress sensitivity
  misc_feature: Functional homolog of the protein sequence given in SEQ ID NO 13910
  misc_feature: Ceres ANNOT ID no. 8736497
  misc_feature (2)..(114): Pfam ID: GASA Pfam Description: Gibberellin regulated protein
MASKVVSILVLAFLLLAAVAVPVSAGPRQRGKNGGGGAGGGGGSPSGGGNLKPWECSPKCASRCSQTQYKKACLTFCNKCCATCLCVPPGFYGNKGACPCYNNWKTKEGGPKCP

SEQ ID NO: 19838 - DNA, 1701 bp, Sorghum bicolor
  misc_feature: Ceres ANNOT ID no. 8736588
  misc_feature: Encodes the peptide sequence at SEQ ID NO 19839
atggcggtgaaggtggaccgaggcatcgggtgggcgtggcatgggggttgggacaaaggtgatgaagcgggggagggggcaacgaagcaagagaagggggctgcacgaggccacttctccatgctccggagcacacgcaaatttcacctggaaagccggaagcgccgcgcgatcatggggtcactgacgccggcggagggccagcggcgggcgcacgccgtgtgcgtgccgttcccgacgcagggccacatcacgcccatgctcaagctggccaagctcctccacgcgcggggcttccacgtcaccttcgtcaacaccgagttcaaccaccggcgcctgctccacacgcgcggggccaacgcgctcgacggcgtgccgggcttccgcttcgacgccatccccgacggcctcccgccctccgacgccgacgccacgcaggacatccccgcgctctgcaacgccaccatgaccaagtgcctcccgcacctcctctccctcctcgccaggatcaacaacggcgacaccgacgccgagtcggagtcgtcgtcgtcgtctccgccggtcacctgcctcgtcgtggacgccttcatgtcgttcggcttcgacgccgccagggagatcggcgtccccgtcgtcgcgttcctcaccatcgccgcctgcgggtacatgggcatccgcaacttccgcaacctcatcgacctgggcctcgtgccgttcaagcacgaggcggacctcgccgacgacggccacctcgccaccgtggtgactacgggcgcgtacggcatgtgcgacggcgtgcagctgcgggacttccccagcttcatccgcaccacggaccgcgacgacgccatgctcaacttcctcctgcacgtgttcgagcggatatcgctcgtcccggacgccgtcgtcatcaacacattcgaggacctcgagcgcaccacgctggacgccatgcgcagcgtcctaccgccggtgtaccccatcgggccggtcctcctccgcgagcgccatgagatccccgccggcagcccgctggcggggctcggctgcaacctgtggaaggagcaggaaggcgtcctggagtggctcgccgtcgccggccgccgcgcgccgcggtccgtggtgtacgtgaactacggcagcatcacggtgatgaccagcgcgcagctgctcgagttcgcctggggcctggccgacagcgggtacccgttcgtgtggaacatccgcccggacctcgtcaggggcgacaccgccgtgctgccgccggagttcgcgtccgccgtcgagagccgggcgctgctgaccacgtggtgcgcgcaggaggcggtgctccggcacgaggcggtcggggtgttcctcacccactccggctggaactcgacgctggagagcctctgcgcgggggtgccgatgatcagctggcccttcttcgcggagcagcagaccaactgccggtacaagcgcacggagtggggcgtcgggatggagatcggcggtgaggtgcggcgcgacgaggtggcggccatcttaaaggaggccatgcacggggagaaggggcgggagatgcgccggcgcgcggaggagtggaaggagaaggccgcaatggccgcgctgccgggtgggcctgccgagacaaaccttgacagggtcatccaaaccgtgctgctctccaagaaccaagcaaaaaatgtcgatgcgtga

SEQ ID NO: 19839 - protein, 566 aa, Sorghum bicolor
  misc_feature: Useful for making plants with altered carbohydrate content
  misc_feature: Functional homolog of the protein sequence given in SEQ ID NO 14338
  misc_feature: Ceres ANNOT ID no. 8736588
  misc_feature (189)..(554): SWISSPROT Homolog: EC 2.4.1.121 Indole-3-acetate beta-glucosyltransferase
  misc_feature (73)..(558): Pfam ID: UDPGT Pfam Description: UDP-glucoronosyl and UDP-glucosyl transferase
MAVKVDRGIGWAWHGGWDKGDEAGEGATKQEKGAARGHFSMLRSTRKFHLESRKRRAIMGSLTPAEGQRRAHAVCVPFPTQGHITPMLKLAKLLHARGFHVTFVNTEFNHRRLLHTRGANALDGVPGFRFDAIPDGLPPSDADATQDIPALCNATMTKCLPHLLSLLARINNGDTDAESESSSSSPPVTCLVVDAFMSFGFDAAREIGVPVVAFLTIAACGYMGIRNFRNLIDLGLVPFKHEADLADDGHLATVVTTGAYGMCDGVQLRDFPSFIRTTDRDDAMLNFLLHVFERISLVPDAVVINTFEDLERTTLDAMRSVLPPVYPIGPVLLRERHEIPAGSPLAGLGCNLWKEQEGVLEWLAVAGRRAPRSVVYVNYGSITVMTSAQLLEFAWGLADSGYPFVWNIRPDLVRGDTAVLPPEFASAVESRALLTTWCAQEAVLRHEAVGVFLTHSGWNSTLESLCAGVPMISWPFFAEQQTNCRYKRTEWGVGMEIGGEVRRDEVAAILKEAMHGEKGREMRRRAEEWKEKAAMAALPGGPAETNLDRVIQTVLLSKNQAKNVDA

SEQ ID NO: 19840 - DNA, 2268 bp, Sorghum bicolor
  misc_feature: Ceres ANNOT ID no. 8736578
  misc_feature: Encodes the peptide sequence at SEQ ID NO 19841
atggatgcagagagcggccgcggcgccgcgagtgcgcgcaagaagtcgtggcggtcggagctggtgctggcgtaccagagcctcggcgtggtgtacggcgaggtggcgacgtcgccgctctacgtgtacaagagcgccttcgccggcggcgacatcgaccactccgagggcaacgaggagatctatggggtgctctcgctcgtgttctggacgctcaccctcatcacgctcctcaagtacgtgctcgtcgtcctgcgcgccgacgacgacggcgagggcggtaccttcgcgctctactccctcatctgccgccgggtccgtgcggggctcctccctggcgtcgtcggcgacagtagcgctgccgacgacgagctcaaggagcagcgcgacggcggcgcgctgccgccgctggcgtcgagcgtgcgcgcggcgctgcagcagcgcagggagctgcagtggctgctgctcatgttcgctctgctcgggacgtccatggtcatcggcgacggcgtcctcacccctgctgtgtccgatgttctgcttccagtaacatgtgtgatcctggtaggcttgttcgccttgcaacacttcggcacacacagggttggatttctcttcgcgcctattgtctgcctgtggcttgcctgcatcagtgccataggggtatacaacatcttcatttggaatccccatatctataaagccctatcaccatactacatgcacagttttatccagaagacacaagttggaggctggatgtcactgggtgggatccttttatgtgtaactggttctgaagctatgtatgcggaccttggacatttttcgcagtcttcaatcaagatcgctttcacaatggtggtttatccatcactcgtacttgcctatatgggacaagctgcttacatttcacagcatcacaattttgagaggaaccaccatattggattttacatatcagtacctgagaaaatcagatggcctgttctggggattgcaatccttgcagctgtagttggcagccaagcagtaatcactggcacattctcagttatcaaacagtgttgctccttaaattgctttccaagggtgaagattgtgcatacatcctccacagtacatggccaaatatacataccagagatcaattggatcttaatgatactgtgcttggctgttactataggcttcagaaacacgaaacagatggcaaatgcacaagggttggcagttataacagttatgattgtcacaacttgctttatgtcactcgtcattgtcctttgctggaacaagaatgttgtgtttgctcttgccttccttcttttctttggtgcaatcgaagctgtctacttctcagcttccctcgtgaagttccatgaaggggcttgggtacctataattctttccttcactttcttgattgtgatgtgtgtttggcactatggcacaacaaagaagtacgagtttgatgtggagaacaaagtctcaataagctggcttttgaatttaggcccttcgttgggtattgttcgagtcagaggcataggtctcatacacacagaacttgtgtctgggattcctgccattttctcccactttgtcaccaacctccctgcatttcatcaggttctggtcttcctatgcattaaatccgtttctgtaccacatgtccaatctgaagagcgatttttggtcggacgcattggcctgaaacaatacaggctatacagggtagttgtccgatacgggtaccgggatgttcagcaggacagcctggaatttgagaaggccttagtgagcagcattgcagagttcatacgctctggggactctgaccaaaatggttatccggatggttcagagagtccctatgagaggttgtctattatcagcaaaggcctgccatttcaagaggcctatggtgaggttgagggatcacctgaatcatctgttcggaaggatacaaaccgaaatttagtatcttccaagtcgacaagggtgaggtttgtgctcccagaaaatgcgcagatcaacagcgaagtgcgcaacgagctgcaagagctgactgaggcaagagaggcaggcatgtccttcatcatggggcgctcttatatgaaggcgaaaagtgggtctagcctgatgaagcggattgccataaacttcatctacgagtttttgacgaggaatagccgaggtcctgcctacgcggctaacgtgccacatgtttccacccttgaggtaggaatggtttgccaagtctga

SEQ ID NO: 19841 - protein, 755 aa, Sorghum bicolor
  misc_feature: Useful for making plants with modulated biomass
  misc_feature: Functional homolog of the protein sequence given in SEQ ID NO 13565
  misc_feature: Ceres ANNOT ID no. 8736578
  misc_feature: Up-regulated in shoot tissues in response to salicylic acid treatment
  misc_feature (22)..(755): Pfam ID: K_trans Pfam Description: K+ potassium transporter
MDAESGRGAASARKKSWRSELVLAYQSLGVVYGEVATSPLYVYKSAFAGGDIDHSEGNEEIYGVLSLVFWTLTLITLLKYVLVVLRADDDGEGGTFALYSLICRRVRAGLLPGVVGDSSAADDELKEQRDGGALPPLASSVRAALQQRRELQWLLLMFALLGTSMVIGDGVLTPAVSDVLLPVTCVILVGLFALQHFGTHRVGFLFAPIVCLWLACISAIGVYNIFIWNPHIYKALSPYYMHSFIQKTQVGGWMSLGGILLCVTGSEAMYADLGHFSQSSIKIAFTMVVYPSLVLAYMGQAAYISQHHNFERNHHIGFYISVPEKIRWPVLGIAILAAVVGSQAVITGTFSVIKQCCSLNCFPRVKIVHTSSTVHGQIYIPEINWILMILCLAVTIGFRNTKQMANAQGLAVITVMIVTTCFMSLVIVLCWNKNVVFALAFLLFFGAIEAVYFSASLVKFHEGAWVPIILSFTFLIVMCVWHYGTTKKYEFDVENKVSISWLLNLGPSLGIVRVRGIGLIHTELVSGIPAIFSHFVTNLPAFHQVLVFLCIKSVSVPHVQSEERFLVGRIGLKQYRLYRVVVRYGYRDVQQDSLEFEKALVSSIAEFIRSGDSDQNGYPDGSESPYERLSIISKGLPFQEAYGEVEGSPESSVRKDTNRNLVSSKSTRVRFVLPENAQINSEVRNELQELTEAREAGMSFIMGRSYMKAKSGSSLMKRIAINFIYEFLTRNSRGPAYAANVPHVSTLEVGMVCQV

SEQ ID NO: 19842 - DNA, 2292 bp, Sorghum bicolor
  misc_feature: Ceres ANNOT ID no. 8736637
  misc_feature: Up-regulated in shoot tissues in response to salicylic acid treatment
  misc_feature: Encodes the peptide sequence at SEQ ID NO 19843
atgacgatcctctcgccgctcgccaccaaggtgttcatccccgtcgccgccgtcatcggcatcgtcttcgccgtcgtgcagtgggtgctcgtgtcgcgggtgaagctctccccggccgcggccgccgcgtccggcggagggaagaacggctacggcgactacctcatcgaggaggaggaggggctcaacgaccacaacgtcgtcgtcaagtgcgccgagatccagaacgctatctccgaaggagcaacatcgtttcttttcactgagtaccaatatgttggtatcttcatgtctatcttcgccgttgtgatcttcctcttccttggttcggttgagggattcagcacgaagagccagccctgcacctataacaaggacaagtactgcaagcctgcactgttcactgccctcttcagcactgtgtccttcttgcttggagccatcacctctctggtatctggtttccttggcatgaagattgccacatatgcgaatgccagaactaccctggaagctaggaagggtgttggcaaggcttttatcactgctttccgctctggcgctgttatgggtttcctgcttgcatcaagtgggcttgtggttctgtacatcaccattaatgtatttaagttgtattatggtgatgactgggagggtctttttgagtctatcactggctatggccttggtgggtcgtccatggctctcttcggaagagttggtggaggtatctacacgaaggctgctgatgttggtgccgatcttgttggaaaggtcgagaggaacattcctgaggatgatcctaggaacccagctgtgattgctgataatgttggtgacaatgttggtgacattgctggaatgggatctgatctctttgggtcatatgctgagtcttcctgtgctgcccttgttgttgcgtctatttcatctttcggaatcgaccatgacttcactgggatgtgctacccactccttgttagctctgttggtatcatcgtctgcttgatcaccaccctttttgctactgatttctttgaagtcaaggctgtgaaagaaattgagcccgcacttaagaagcagctcatcatctccaccgccctaatgactgttggtattgctgtaatcagctggttggcccttccagctaagttcaccatctacaacttcggtactcagaaggatgtctccaactggggcttgttcttctgtgttgcaattggtctgtgggctggtctgattattggttttgtcacagaatactacactagcaatgcatacagtcctgtgcaagatgtcgcggattcgtgcagaaccggtgctgccactaatgtcatttttggtctcgctcttggatacaagtcagttatcatcccgatttttgctatcgctgttagcatctatgtcagtttctccattgctgcaatgtacggcatcgctgttgccgctcttggtatgctgagcacaatcgcaactggtcttgccattgatgcttatggtcccatcagtgacaatgctggtggtattgctgagatggctggaatgagccacagaatctgtgagagaactgatgctcttgatgctgctggcaacacaactgccgctattggaaaggggtttgccattggttccgctgctcttgtgtccctggcgctttttggcgccttcgtcagcagagctggagtgacggttgtcgatgtcctctcccccaaggttttcattggtttgattgttggagccatgcttccctactggttctctgccatgaccatgaagagtgttggaagtgctgccctgaagatggtggaggaggtccgcaggcagctcaacaccattcctaggttgatggagggaactgccaagcctgactatgcaacctgtgtgaagatctccaccgatgcttccatcaaggagatgattcccccgggtgctctggtcatgctcactcccctcattgttggaaccctcatcggtgttgagactctctctggcgttcttgctggtgccctggtttctggagtgcagattgccatctctgcttccaacaccggtggtgcatgggacaatgccaagaagtacattgaggctggtgccagccagcatgcaaggaccctcggccccaagggatctgactgccacaaggctgctgtgatcggtgacaccattggtgaccccctgaaggacacctcgggcccgtccctcaacatcctcatcaagctcatggccgtggagtctcttgtgtttgcccccttcttcgccacccaaggtggcattctgttcaagtacctgtaa

SEQ ID NO: 19843 - protein, 763 aa, Sorghum bicolor
  misc_feature: Useful for making plants with modulated water use efficiency
  misc_feature: Functional homolog of the protein sequence given in SEQ ID NO 13830
  misc_feature: Ceres ANNOT ID no. 8736637
  misc_feature (1)..(763): SWISSPROT Homolog: EC 3.6.1.1 Inorganic diphosphatase
  misc_feature (6)..(749): Pfam ID: H_PPase Pfam Description: Inorganic H+ pyrophosphatase
MTILSPLATKVFIPVAAVIGIVFAVVQWVLVSRVKLSPAAAAASGGGKNGYGDYLIEEEEGLNDHNVVVKCAEIQNAISEGATSFLFTEYQYVGIFMSIFAVVIFLFLGSVEGFSTKSQPCTYNKDKYCKPALFTALFSTVSFLLGAITSLVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGIDHDFTGMCYPLLVSSVGIIVCLITTLFATDFFEVKAVKEIEPALKKQLIISTALMTVGIAVISWLALPAKFTIYNFGTQKDVSNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRICERTDALDAAGNTTAAIGKGFAIGSAALVSLALFGAFVSRAGVTVVDVLSPKVFIGLIVGAMLPYWFSAMTMKSVGSAALKMVEEVRRQLNTIPRLMEGTAKPDYATCVKISTDASIKEMIPPGALVMLTPLIVGTLIGVETLSGVLAGALVSGVQIAISASNTGGAWDNAKKYIEAGASQHARTLGPKGSDCHKAAVIGDTIGDPLKDTSGPSLNILIKLMAVESLVFAPFFATQGGILFKYL

SEQ ID NO: 19844 - DNA, 1419 bp, Sorghum bicolor
  misc_feature: Ceres ANNOT ID no. 8736676
  misc_feature: Encodes the peptide sequence at SEQ ID NO 19845
atggctgaggaggtcacgccccacgtccacgtcctcctcatctgctacccgagccaaggccacatcaaccccatgctccgcctcgccaagcgcatcgcggccaagggcgtcctcgtcacctgctcctcgtcctccgtcatccgcgacgatctcgccgccgcctcgggggtgtcggctggcggcgacggcgtgcccttcggcgccggccgcatccggttcgatttcctgggcgaccctttcgacaagacactgccggacctcaaaggctacctgcggcgccttgagaccgacgggcggctggctttggcggacctgctcaggcgccaggcggaagcagggcggccggtggcgtgcgtcatcgggaacccgttcctgccgtgggtgaccgacgtcgcggccgacgctggcatcccctcggcggtgctgtgggtgcagtcgtgcgcggtgttctcgatctactaccacttcgcgcacgggctggcggagttcccgcacgaggacgacctcgaagcccggttcacgctcccgggcctcccgacgctgtccgtcgtcgatgtgccgtcgttcctgctcgcgtcgcacccgtacaaggtcctcggcgacacgatccaggaccagttccgcaacatgggcaaggcgtcgtgggtgttcgtcaactcgttcgacgagctggaacgcgatgtggtcaccgcgctcccgagcgtcaggccgcgccctccgcagctgatccccgtcggccctctcgtcgaactcgctggccaggacgacgtcccgctgcgcggcgacctcatcaaggcgtcggacgactgcgtcggatggctggacgcgcaggcgccgcgctccgtggtgtacgcgtcggtcgggagcatggtagtgctctccgccgaggtgatcgcggagatggcgcacgggctcgcgtccaccggccggcccttcctatgggtggtgcggccggacactcgccctttgctccccgaggggttccttgacgccgtcgccggtcgcggcatggtcgtgccgtggagcccgcaggaccgcgtgctggcgcacgcctccacggcgtgcttcctgacgcactgcgggtggaactccacgctcgagacggtcgccgccggtgttcccgtgctggctttcccacagtggggcgaccagtgcacggacgccaagttcctggtcgacgagcttaggatgggcgtccacctccgcgccccgctgcggcgggagggtgtgcgcgaggctgtggatgcagcaacgacagggccagaggctgacgccatgctcgccaacgctaagtcctggagcgcggcggcgcgggccgcagtgacgccaggagggtcgtcggaccggcatgttcaggcgttcatcgacgaggtctctcgtcaagcacgtggacggcaagctgaagcagctgtggtttag

SEQ ID NO: 19845 - protein, 472 aa, Sorghum bicolor
  misc_feature: Useful for making plants with altered carbohydrate content
  misc_feature: Functional homolog of the protein sequence given in SEQ ID NO 14401
  misc_feature: Ceres ANNOT ID no. 8736676
  misc_feature (9)..(460): SWISSPROT Homolog: EC 2.4.1.210 Limonoid glucosyltransferase
  misc_feature (10)..(462): Pfam ID: UDPGT Pfam Description: UDP-glucoronosyl and UDP-glucosyl transferase
MAEEVTPHVHVLLICYPSQGHINPMLRLAKRIAAKGVLVTCSSSSVIRDDLAAASGVSAGGDGVPFGAGRIRFDFLGDPFDKTLPDLKGYLRRLETDGRLALADLLRRQAEAGRPVACVIGNPFLPWVTDVAADAGIPSAVLWVQSCAVFSIYYHFAHGLAEFPHEDDLEARFTLPGLPTLSVVDVPSFLLASHPYKVLGDTIQDQFRNMGKASWVFVNSFDELERDVVTALPSVRPRPPQLIPVGPLVELAGQDDVPLRGDLIKASDDCVGWLDAQAPRSVVYASVGSMVVLSAEVIAEMAHGLASTGRPFLWVVRPDTRPLLPEGFLDAVAGRGMVVPWSPQDRVLAHASTACFLTHCGWNSTLETVAAGVPVLAFPQWGDQCTDAKFLVDELRMGVHLRAPLRREGVREAVDAATTGPEADAMLANAKSWSAAARAAVTPGGSSDRHVQAFIDEVSRQARGRQAEAAVV

SEQ ID NO: 19846 - DNA, 1962 bp, Sorghum bicolor
  misc_feature: Ceres ANNOT ID no. 8736839
  misc_feature: Encodes the peptide sequence at SEQ ID NO 19847
atgcctcgcaacttggagagcccagtgcagacccagatggcagtctcagccttggatcgagctcttagcagtgagtaccctaccaaaagcagaagcgagaccaaggttggcggatggaaacgtgtttttgttcaaactgacactggttgtgtcctggctattcaattggatcgtggtgacaatgcacacacggtcaaaagaaggctgcaggtagccctaaactttcccactgatgagaggtcactgacattaggcgatcgtgttctgaaaaatgatctcagcaccattagaaatgattccccgttgcttctcaccaagactttcatgcatcgaagttcctccacaccatgcttgtctcctagaggcaaggatctccaacagcaaaaagataagggttgtccaattgagctgttagtatgcccgagccgctgttctcgaacaaggcagctcgtgaaggatgttgctagggcaatcaggaaaggtgtggatccagtacctatcaaaagtgggcttggtggtgcctactatttcaagaacagcaaaggtgagaatgcagcaattgtgaagccaaatgatgaggagccttttgcacccaacaacccaaaaggttttatagggaaatcccttggacagccaggcctcaaaagatcggttcgaattggtgagactggtttcagagaggttgctgcttaccttctggaccatgataactctgctaatgtccctccgacgctacttgttaagatttctcatcctgtgtttcatatgaatgaaggcgccaactgtgctaacaaaaatattgctgatggtagcactcaagctgttagcaagattgcatcatttcagcagttcattcctcatgattttgatgccagtgatcatggcacctcaagctttcctgtttctgctgtccataggattggtattcttgacatcaggatcttcaacactgatagacatgctggaaatcttctggtaaggaagcaaactggagcaggaaaatttgggaatcagactgaacttattcctattgatcatggtctctgccttccagagtgtttggaggatccttattttgaatggatccactggcctcaggcatcagtcccattctctgaggatgagctcgagtacatagcaaatcttgatccagtaaaagatgctgacatgctgcggatggagttgcctatgatccgtgaagcatgcctcagagtactaatactctcaaccatatttctgaaagaagccacagcatttggtctgtgccttgcagagattggggagatgatgagcagggaatttactgggatggaagatcagccaagtgagttagagtttgtctgcatggaggcaaggaggctagcagcagagcaagaagacagttccacagaacatgactctggtgaggaggatttaactcagtttgaacttgacagcgaagatcatgaaatgctaaaagaaccatcagcccaccagtttgaatttaagacaagaaactccagaaaccaactgtccaaattggatgaagccgatgaagaagaggaggaagaagaggaagatgatactgaggaggtagaaagcaatgccggaaagttagctcgccctaagcctgtcaataagtggcttgctaacatttcaaagctgtcgacctcactgaagggtgtcaatctaacagacaaaacccagcgtcaactgtctgctggtcctaagtttgtggatcctgcgaatacttctaagagcaacagcaacgatacgggctctcaactttgtaactggggaagtgcaaatgatatgctccctacaagtgtgagcttcgtcaagctggctgacatgaaacctgagacatggggcctgttcctcgagaagttccaggagctcctgcctgagacattccgctcccgaaagtgcagtgtcacagcacaaagggcaaagcagaggcttggcacttcttgccagttttga

SEQ ID NO: 19847 - protein, 653 aa, Sorghum bicolor
  misc_feature: Useful for making plants with altered protein content
  misc_feature: Functional homolog of the protein sequence given in SEQ ID NO 13479
  misc_feature: Ceres ANNOT ID no. 8736839
  misc_feature (149)..(257): SWISSPROT Homolog: EC 2.7.1.67 1-phosphatidylinositol 4-kinase
  misc_feature (170)..(433): Pfam ID: PI3_PI4_kinase Pfam Description: Phosphatidylinositol 3- and 4-kinase
MPRNLESPVQTQMAVSALDRALSSEYPTKSRSETKVGGWKRVFVQTDTGCVLAIQLDRGDNAHTVKRRLQVALNFPTDERSLTLGDRVLKNDLSTIRNDSPLLLTKTFMHRSSSTPCLSPRGKDLQQQKDKGCPIELLVCPSRCSRTRQLVKDVARAIRKGVDPVPIKSGLGGAYYFKNSKGENAAIVKPNDEEPFAPNNPKGFIGKSLGQPGLKRSVRIGETGFREVAAYLLDHDNSANVPPTLLVKISHPVFHMNEGANCANKNIADGSTQAVSKIASFQQFIPHDFDASDHGTSSFPVSAVHRIGILDIRIFNTDRHAGNLLVRKQTGAGKFGNQTELIPIDHGLCLPECLEDPYFEWIHWPQASVPFSEDELEYIANLDPVKDADMLRMELPMIREACLRVLILSTIFLKEATAFGLCLAEIGEMMSREFTGMEDQPSELEFVCMEARRLAAEQEDSSTEHDSGEEDLTQFELDSEDHEMLKEPSAHQFEFKTRNSRNQLSKLDEADEEEEEEEEDDTEEVESNAGKLARPKPVNKWLANISKLSTSLKGVNLTDKTQRQLSAGPKFVDPANTSKSNSNDTGSQLCNWGSANDMLPTSVSFVKLADMKPETWGLFLEKFQELLPETFRSRKCSVTAQRAKQRLGTSCQF

SEQ ID NO: 19848 - DNA, 162 bp, Sorghum bicolor
  misc_feature: Ceres ANNOT ID no. 8737228
  misc_feature: Encodes the peptide sequence at SEQ ID NO 19849
atggatccaaatgggaacagacaaacatattatggacgcatagaagacatatgggaactagactatgcagctaattttaaagttcctttgttccgaaaaccggtgcatgactatgaattctttcaaaattcaaaattgattggttcaaacttttgcatgtga

SEQ ID NO: 19849 - protein, 53 aa, Sorghum bicolor
  misc_feature: The sequence is a functional homolog of SEQ ID NO 1066 in the 10/374,780 US patent application
  misc_feature: The sequence is a functional homolog of SEQ ID NO 1308 in the 10/412,699 US patent application
  misc_feature: Ceres ANNOT ID no. 8737228
MDPNGNRQTYYGRIEDIWELDYAANFKVPLFRKPVHDYEFFQNSKLIGSNFCM

SEQ ID NO: 19850 - DNA, 987 bp, Sorghum bicolor
  misc_feature: Ceres ANNOT ID no. 8737500
  misc_feature: Encodes the peptide sequence at SEQ ID NO 19851
atgacgattcagttttgtgcagttctgctactgcctgtggccttcctcctcttcgcaggtagctcacaggtggtggctcagctggagctcggctactacagcaagacgtgcccgaacgtcgaggcgatcgttcgcgcggagatggagaagatcatctcggctgcacccagccttgctggccccctcctcaggcttcatttccacgactgcttcgtcaggggttgtgacgcgtctgtgctgctcaacactactgcggccaacgtggcagagatggacgccattccgaacaggagcctgcgaggcttcggttctgtagagagggtgaaggccaagctcgaagctgcctgccccaacacggtttcctgcgccgacgttctcaccctcatggcccgcgacgccgttgtgctggccaagggccccttctggccggtcgcgctcgggaggcgagacggcagggtgtccactgcgactgaggcggctgaccagctacctccggcctacggagacataccactgctcaccaaaatttttgcctcgaaaggactcgatagcaaggacctagttgtcctctccggcggccacaccctcggcacggcgcactgccagtcttacgccggccggctctacaacttcagcagcgcctacaatgcagacccatccctggacaccgaatacgccgaccggctgaggacgcgctgcaggagcatcgacgacaaggctacgctctcggagatggatcctggcagctacaagaccttcgacaccagctactaccgccacgtcgccaagcgcagggggctcttccagtctgacgccgcgctcctcaccgacgccgccactagggactacgtcgagcgtattgccaccggcaagtttgatgatgtgttctttaaggacttcagcgagtccatgatcaagatgggcaacgtcggcgtgatcaccggtgttgacggtgaaatcaggaagaaatgctacattgtcaactaa

SEQ ID NO: 19851 - protein, 328 aa, Sorghum bicolor
  misc_feature: Useful for making plants with altered carbohydrate content
  misc_feature: Functional homolog of the protein sequence given in SEQ ID NO 13757
  misc_feature: Useful for making plants with altered cell wall content and/or composition
  misc_feature: Functional homolog of the protein sequence given in SEQ ID NO 14748
  misc_feature: Useful for making plants with modulated phosphate use efficiency
  misc_feature: Functional homolog of the protein sequence given in SEQ ID NO 13134
  misc_feature: Useful for making plants with modulated nitrogen use efficiency
  misc_feature: Functional homolog of the protein sequence given in SEQ ID NO 13758
  misc_feature: Ceres ANNOT ID no. 8737500
  misc_feature (26)..(328): SWISSPROT Homolog: EC 1.11.1.7 Peroxidase
  misc_feature (44)..(290): Pfam ID: peroxidase Pfam Description: Peroxidase
MTIQFCAVLLLPVAFLLFAGSSQVVAQLELGYYSKTCPNVEAIVRAEMEKIISAAPSLAGPLLRLHFHDCFVRGCDASVLLNTTAANVAEMDAIPNRSLRGFGSVERVKAKLEAACPNTVSCADVLTLMARDAVVLAKGPFWPVALGRRDGRVSTATEAADQLPPAYGDIPLLTKIFASKGLDSKDLVVLSGGHTLGTAHCQSYAGRLYNFSSAYNADPSLDTEYADRLRTRCRSIDDKATLSEMDPGSYKTFDTSYYRHVAKRRGLFQSDAALLTDAATRDYVERIATGKFDDVFFKDFSESMIKMGNVGVITGVDGEIRKKCYIVN

SEQ ID NO: 19852 - DNA, 987 bp, Sorghum bicolor
  misc_feature: Ceres ANNOT ID no. 8737539
  misc_feature: Encodes the peptide sequence at SEQ ID NO 19853
atggctgccaagtcttgtcaagtgctactgctcccattggtgctgcttctcgctggcagctcgttggcagtggcagatcagctggaagtcggctactacagcaagacatgcccgaacgtcgaggcgcttgtccgcgaggagatggagaagatcatgtcagccgcatccagccttgctggccctctcctcaggcttcacttccatgactgcttcgtgaggggttgtgacgcctccgttctgctcaactccaccgacggcaacacggcagagaaggacgccactccgaacaagagtctgcgaggcttcggttccgtggagagggtgaaggccaagctcgaggccgcctgccccaacaccgtctcctgtgccgatgtcctcacgctcatggcccgcgacgccgtcgtgcttgccaggggccccttctggcccgtggcgctcgggaggcgagacggcagggtgtccagtgcaactgaggcggccgaccagctgcctccggcctacggagacataccactgctcaccaaaatttttgcatcgaaaggcctcgatgcaaaggacctagttgtcctctccggcggccacaccctcggcacggcgcactgcacgtcttacgccggccggctctacaacttcagtagcgcctacaacgccgacccatctctcgacagcgagtacgccgacaggctcaggacgcgctgcaagagcgacgacgacaaggccatgctttccgagatggaccccggcagctacaagaccttcgacacgagctactatcgccacgttgccaagcgcaggggactgttccagtccgacgctgcgctcctgaccgatgcaaccaccagggagtacgtccagcgcattgccaccggcaagttcgacgatgtgttcttcaaggacttcagcgaatccatgatcaagatgggaagtgtcggcgtgctcaccggtgttgacggggagatcaggaagaagtgctacgttgctaattag

SEQ ID NO: 19853 - protein, 328 aa, Sorghum bicolor
  misc_feature: Useful for making plants with altered carbohydrate content
  misc_feature: Functional homolog of the protein sequence given in SEQ ID NO 13757
  misc_feature: Useful for making plants with altered cell wall content and/or composition
  misc_feature: Functional homolog of the protein sequence given in SEQ ID NO 14262
  misc_feature: Useful for making plants with modulated nitrogen use efficiency
  misc_feature: Functional homolog of the protein sequence given in SEQ ID NO 13758
  misc_feature: Useful for making plants with modulated phosphate use efficiency
  misc_feature: Functional homolog of the protein sequence given in SEQ ID NO 13134
  misc_feature: Ceres ANNOT ID no. 8737539
  misc_feature (27)..(328): SWISSPROT Homolog: EC 1.11.1.7 Peroxidase
  misc_feature (44)..(290): Pfam ID: peroxidase Pfam Description: Peroxidase
MAAKSCQVLLLPLVLLLAGSSLAVADQLEVGYYSKTCPNVEALVREEMEKIMSAASSLAGPLLRLHFHDCFVRGCDASVLLNSTDGNTAEKDATPNKSLRGFGSVERVKAKLEAACPNTVSCADVLTLMARDAVVLARGPFWPVALGRRDGRVSSATEAADQLPPAYGDIPLLTKIFASKGLDAKDLVVLSGGHTLGTAHCTSYAGRLYNFSSAYNADPSLDSEYADRLRTRCKSDDDKAMLSEMDPGSYKTFDTSYYRHVAKRRGLFQSDAALLTDATTREYVQRIATGKFDDVFFKDFSESMIKMGSVGVLTGVDGEIRKKCYVAN

SEQ ID NO: 19854 - DNA, 996 bp, Sorghum bicolor
  misc_feature: Ceres ANNOT ID no. 8737559
  misc_feature: Encodes the peptide sequence at SEQ ID NO 19855
atggaattcaagtcttgtctagtaccgctgctgctccctactatggccctgctgcttctcgcttttggcagctcgcccgcggcggctcagctgcaagtcggctactacagcaagacatgcccgaacgtcgaggccatcgtccgcaacgagacggcgaagatcatcggcgctgcgcccagcctcgccggtccacttctcaggctccatttccacgactgctttgtcaggggttgtgacgcctcagtcctgctggagtccaacgggggcaacaaggccgagaaggacgccaagccgaacaagagcctgcggggcttcggttccgtggagagagtgaaggccaagctggaagccgcctgccccaacacggtttcctgcgcggacgtcctcaccctcatggcccgcgacgccgtcgtgctcgccaggggcccttcctggcctgtcgcactcggtaggcgagacggcagggtgtcgagcgccacggaggcggccgaccacctgcctcctgccttcggggacgtcccgctgctcaccaagatcttcgccgccaatggcctcgacgtcaaggacctcgctgtcctctccggcggccacaccctcggcacggcgcactgcgggtcctacgccggccggctatacaacttcagcagcggctacagcgcggacccatccctcgacagcgagtacgcccacaggctcaggacgcgctgcaagagcgccgacgacaaggccacgctttccgagatggaccccggcagctacaagaccttcgacaccagctactaccgccaggtcgcgaaacggagggggctcttccagtccgacgccgcgctcctcgcagacgccaccactagggagtacgtccagcgcattgccaccggcaagtttgacgacgtgttcttcaaggacttcggcgagtccatgatcaagatgggcaacgttggcgtgctcaccggtgctcagggggagatcagaaagaagtgctacatcgtcaactaa

SEQ ID NO: 19855 - protein, 331 aa, Sorghum bicolor
  misc_feature: Useful for making plants with altered carbohydrate content
  misc_feature: Functional homolog of the protein sequence given in SEQ ID NO 13757
  misc_feature: Useful for making plants with altered cell wall content and/or composition
  misc_feature: Functional homolog of the protein sequence given in SEQ ID NO 14262
  misc_feature: Useful for making plants with modulated nitrogen use efficiency
  misc_feature: Functional homolog of the protein sequence given in SEQ ID NO 13758
  misc_feature: Useful for making plants with modulated phosphate use efficiency
  misc_feature: Functional homolog of the protein sequence given in SEQ ID NO 13134
  misc_feature: Ceres ANNOT ID no. 8737559
  misc_feature (27)..(331): SWISSPROT Homolog: EC 1.11.1.7 Peroxidase
  misc_feature (47)..(293): Pfam ID: peroxidase Pfam Description: Peroxidase
MEFKSCLVPLLLPTMALLLLAFGSSPAAAQLQVGYYSKTCPNVEAIVRNETAKIIGAAPSLAGPLLRLHFHDCFVRGCDASVLLESNGGNKAEKDAKPNKSLRGFGSVERVKAKLEAACPNTVSCADVLTLMARDAVVLARGPSWPVALGRRDGRVSSATEAADHLPPAFGDVPLLTKIFAANGLDVKDLAVLSGGHTLGTAHCGSYAGRLYNFSSGYSADPSLDSEYAHRLRTRCKSADDKATLSEMDPGSYKTFDTSYYRQVAKRRGLFQSDAALLADATTREYVQRIATGKFDDVFFKDFGESMIKMGNVGVLTGAQGEIRKKCYIVN

SEQ ID NO: 19856 - DNA, 1605 bp, Sorghum bicolor
  misc_feature: Ceres ANNOT ID no. 8737752
  misc_feature: Encodes the peptide sequence at SEQ ID NO 19857
atggcggcggcgttgtgggagacgctgctggcggcatcggcggcggatgggaccggtgggagcagcaccacggtggtgtccatctgcgtgttcacggcggtgctgtgcctgtgcctcgtcgccggccacctcctcgaggagaacaagtgggtcaacgagtccatcaccgccctcatcatcgggtgcatcgtaggagccatcatatttctgctcaccgaagggaagcactcgcacatcctgaggttcgacgagcagctcttctttatctacgtgcttccaccgataatcttcaatgccgggtttcaggtcaagaagaagcagttcttccacaacttcatgaccatcatgtccttcggcgtgttcggcgttttcatttcaggtgcaatagtttcggcaggctgctattggctcttcccgaaagtcggatttggaaaacttgatgcggtagattatttagcactgggagcaatattttcttcgacagataccgtgtgcacattgcagctgaacacacaggtcataaaccaagacgagacaccaaggctgtacagcttggtgtttggagaaggagttgtcaacgatgcaacagcagttgttcttttcaatgctatcaagaatctcgatatcagtcagctcaaaggtggggttgtgctaaaactgatagctgacttcctctatctcttcgcaaccagcacgatcatcggaatctcaatcggtctagcgactgcatatgttctcaaagctctgtattttggtaggcattcgactgatcgagaggttgccttgatggctctcatggcttatttatcatatatgctggcagagttgctagagctgagtggaattttgaccgtgttcttttgcgggattgtcatgtcccactatgcatggcacaacgtgacagagagctcaagaatcacaacaaagcatatatttgcaacattgtctttcattgctgagacgttcatctttctttatgttggtatggatgctcttgacgttgataagtggaagacatcaaaggaaagctttaagacatccatcggcatctttggcatcgtcgtattactcatattactgggacgagtggcatttgtttttcctgtgtccattttgtcaaatatcctgagtggaagttctgagaggaccccaatcacattcaagcaccaggtggttatttggtgggctgggctcatgagaggcgccgtttcgattgcactagcatacaatcagttcacattttcaggtgtaacatcggatccagttcatgccaccatcatcaccagcacaatcattgttgtatttttcaccactctggtgtttggcttcctgaccaggcctctcattagtgccatgctcccgcatcagtcgagggcgctgtccagaggccatagcaccggcagcaactccccaaaggatgacgacttggccctgccgtttctctcgtctgacgaaggcgcgtctggcagcggtattgtcttggagcaggccaaaaggagcttatctatgatgctggagaggcctgtccacacggttcacgtctactggaggaagttcgatgataggttcatgaggccaatctttggtggaccgcagtcatactga

SEQ ID NO: 19857 - protein, 534 aa, Sorghum bicolor
  misc_feature: Useful for making plants with modulated water use efficiency
  misc_feature: Functional homolog of the protein sequence given in SEQ ID NO 13934
  misc_feature: The sequence is a functional homolog of SEQ ID NO 2 in US patent 7041875
  misc_feature: Useful for making plants with modulated drought sensitivity
  misc_feature: The sequence is a functional homolog of SEQ ID NO 2 in US patent 7250560
  misc_feature: The sequence is a functional homolog of SEQ ID NO 4 in US patent 7250560
  misc_feature: The sequence is a functional homolog of SEQ ID NO 4 in US patent 7256326
  misc_feature: Ceres ANNOT ID no. 8737752
  misc_feature (26)..(451): Pfam ID: Na_H_Exchanger Pfam Description: Sodium/hydrogen exchanger family
MAAALWETLLAASAADGTGGSSTTVVSICVFTAVLCLCLVAGHLLEENKWVNESITALIIGCIVGAIIFLLTEGKHSHILRFDEQLFFIYVLPPIIFNAGFQVKKKQFFHNFMTIMSFGVFGVFISGAIVSAGCYWLFPKVGFGKLDAVDYLALGAIFSSTDTVCTLQLNTQVINQDETPRLYSLVFGEGVVNDATAVVLFNAIKNLDISQLKGGVVLKLIADFLYLFATSTIIGISIGLATAYVLKALYFGRHSTDREVALMALMAYLSYMLAELLELSGILTVFFCGIVMSHYAWHNVTESSRITTKHIFATLSFIAETFIFLYVGMDALDVDKWKTSKESFKTSIGIFGIVVLLILLGRVAFVFPVSILSNILSGSSERTPITFKHQVVIWWAGLMRGAVSIALAYNQFTFSGVTSDPVHATIITSTIIVVFFTTLVFGFLTRPLISAMLPHQSRALSRGHSTGSNSPKDDDLALPFLSSDEGASGSGIVLEQAKRSLSMMLERPVHTVHVYWRKFDDRFMRPIFGGPQSY

SEQ ID NO: 19858 - DNA, 1512 bp, Sorghum bicolor
  misc_feature: Ceres ANNOT ID no. 8737798
  misc_feature: Encodes the peptide sequence at SEQ ID NO 19859
atgtcgcgtctagctcttctcctgctcttcgccttgccgttcctcgtcgtcgtctcggccgtgaaggcaagcagcaacgtctcaaggagccagttccccaagggcttcctctttggcacagcgtcctcggcctaccagtatgaaggagcggtgagggaaggcggcagagggccaagcatctgggacacctacactcacactcacccagagaagatagcagatggaagcaatggagacatggcaattgattcatatcaccgttaccaggaggatgtcaaaatcatgaaggatataggttttaatgcctatagattttctatttcttggacaagaattctgcctaacggaaaactgagtggaggggtcaacatggaaggaatcaaatactacaacaacttcattaacaagctaatttcagaaggcattcaaccattcgtgaccctttttcactgggactccccacaagcattagaacagcagtatggtggctttttgagccagcttattgtagaagacttccgtgactacgccaacatctgctttagggagtttggggacagagtcaagcactggataacattcaatgagccttggagtttcagtattaatggttatgccagtggtatattagcacctggaagatgctctgcttgggaaaattcaggatgcagcacgggagactctggaagggaaccttatattgtagctcataaccaacttctagctcatgcagcagcagttcaggtgtacaaaggcaaataccaggagaagcaaaaagggagcataggaatcactctagtcagcaattggatgattccctacacaaattccaagggagataaggatgctgccaagcgcgcactagaatttatgtatggctggttcatggatcctctaactaagggagattacccactcagcatgagaacactagttggtaatagattaccaagattcacaaaagaacagtcaaaagccatacatggatcattcgacttcattggcctcaactactatacagcaagatatgttcagaataccaaacacagtaacaatggaaacagaagctataatactgattcacggactaatcaatcagttgaaagaaacgggacagttattggtccaaaggctggatctccttggctctacatctatccaaaaggaatagaagaactcctgctatacaccaagaagaaatacaacaatcctacaatctacatcacagaaaacggtgtcgatgaaattaacaatgtaaacataccacttcaagaagccttagtcgacaataccagaatagaattctaccggcaacacctattccatattaaaagagccctcgaggaaggaactaatgtacgagggtactttgcatggtcactattggacaatttcgagtggatggatggttatactgtgagatttggcattaattacatcgactacagggatggtttgaaaagatatccaaagagttccagcaaatggttccagaatttccttcataagtga

SEQ ID NO: 19859 - protein, 503 aa, Sorghum bicolor
  misc_feature: Useful for making plants with modulated biomass
  misc_feature: Functional homolog of the protein sequence given in SEQ ID NO 14616
  misc_feature: Useful for making plants with altered cell wall content and/or composition
  misc_feature: Functional homolog of the protein sequence given in SEQ ID NO 14615
  misc_feature: Useful for making plants with altered carbohydrate content
  misc_feature: Functional homolog of the protein sequence given in SEQ ID NO 14324
  misc_feature: Ceres ANNOT ID no. 8737798
  misc_feature (32)..(481): SWISSPROT Homolog: EC 3.2.1.21 Beta-glucosidase
  misc_feature (28)..(503): Pfam ID: Glyco_hydro_1 Pfam Description: Glycosyl hydrolase family 1
MSRLALLLLFALPFLVVVSAVKASSNVSRSQFPKGFLFGTASSAYQYEGAVREGGRGPSIWDTYTHTHPEKIADGSNGDMAIDSYHRYQEDVKIMKDIGFNAYRFSISWTRILPNGKLSGGVNMEGIKYYNNFINKLISEGIQPFVTLFHWDSPQALEQQYGGFLSQLIVEDFRDYANICFREFGDRVKHWITFNEPWSFSINGYASGILAPGRCSAWENSGCSTGDSGREPYIVAHNQLLAHAAAVQVYKGKYQEKQKGSIGITLVSNWMIPYTNSKGDKDAAKRALEFMYGWFMDPLTKGDYPLSMRTLVGNRLPRFTKEQSKAIHGSFDFIGLNYYTARYVQNTKHSNNGNRSYNTDSRTNQSVERNGTVIGPKAGSPWLYIYPKGIEELLLYTKKKYNNPTIYITENGVDEINNVNIPLQEALVDNTRIEFYRQHLFHIKRALEEGTNVRGYFAWSLLDNFEWMDGYTVRFGINYIDYRDGLKRYPKSSSKWFQNFLHK

SEQ ID NO: 19860 - DNA, 1731 bp, Sorghum bicolor
  misc_feature: Ceres ANNOT ID no. 8737854
  misc_feature: Encodes the peptide sequence at SEQ ID NO 19861
atgggaagctcatccaactcaagtcctgcgttgagtgagactaagaacacaacaccgtcagtatacacagaagatggaactgttgacttcaggggaaaccgtgcagttagagccaccacagggggaaggaaaaccgccgccatactgcttgtgagctacgcgcttatgaatttcgcattctatggggtggccgtggacctggttgttttcatgcgaagggtgctccatcaagagaatgccacagctgccagcttcatcagtatgtggaccggcacggtctacatcttctctctgtttggtgcattcctcagcgactcctacatgggccgttaccgcacctgcgtcatgtttcagatcatctttctcatcgggctggtactgctatcgttttcctcattattcttgctggtggagccctctaggtgtggtgacaaccaacagcataggccatgccagccgccgtcgcagctcggcgttgtgatgttctatatctcaacattcacgactgcatttgggatcggaggacactatatggagcgacgctccaagctctccttcttcagctacttctacctggcgctcaacatcggctccctcttctccgactccttcttggcgttctacgaggacaagggcatgtgggtcatgggcttcggggtctccgctgtcgctgttgccctcgggcttctgctctttctccttggcacgccgtactaccgccactgcaaacaatctggcaacccgctcacacgcatggcgcaggtgttcgtcgctgcattctgcaagcggcacttgcagccaccacctggcgaggtcctccatgaggttgagggtgaggattcagagactcagggcatccgcaaactccttcacagcgatcaactcaggtgtcttgataaggcggcgatagttaccgaggaggactaccacgctggtaaagccaagaacccgtggaggttgtgcactgtgacgcaagtggaggaggtgaagtgcatcttgagcttaattcccatatggatgtgcaccatcatcttctcggttgagttcacacagatggcgtccacattcgtggagcaaggcacagccatggacaccaacctctttggcaacttctatatgcctgcagcaagcatgtctatgtttgacatcgccagcgtgatcctctctgtctttgcctacaacttcttctttgtgcccatggcgacatggttcacaaagaaccctgctgggatcactgagctccagcgcatggggactggtctggtcatcgcgctagttggcatgcttgctgcagcaattgttgaggtctaccgactgcgtcgtgttctggcaaaggaccaaccgagccccatgagtgtcctttggcaggctccacaatatatgctcattggggcttcagaagtcttcatgtacatagggcaactggatttcttcaatgagcagaccccggacagcatgaagtgttttgggagctctctatgcatggcttccatatcactcggaaactatgccagcatgctgatggtcagtgcagtcactagcatcaccaatcggcaaaacaagaatgggtggatcacaaaaaatcttaattatggccaccttgaacggttcttccttcttctcgctgtgctctcggtcatagactttattttctttgcattattttcgatgatgtacaagggtattcagtttcaggggagggagaaagacatctctcccaattataactag

SEQ ID NO: 19861 - protein, 576 aa, Sorghum bicolor
  misc_feature: Useful for making plants with altered carbon content
  misc_feature: Useful for making plants with altered nitrogen content
  misc_feature: Functional homolog of the protein sequence given in SEQ ID NO 14559
  misc_feature: Ceres ANNOT ID no. 8737854
  misc_feature (111)..(498): Pfam ID: PTR2 Pfam Description: POT family
MGSSSNSSPALSETKNTTPSVYTEDGTVDFRGNRAVRATTGGRKTAAILLVSYALMNFAFYGVAVDLVVFMRRVLHQENATAASFISMWTGTVYIFSLFGAFLSDSYMGRYRTCVMFQIIFLIGLVLLSFSSLFLLVEPSRCGDNQQHRPCQPPSQLGVVMFYISTFTTAFGIGGHYMERRSKLSFFSYFYLALNIGSLFSDSFLAFYEDKGMWVMGFGVSAVAVALGLLLFLLGTPYYRHCKQSGNPLTRMAQVFVAAFCKRHLQPPPGEVLHEVEGEDSETQGIRKLLHSDQLRCLDKAAIVTEEDYHAGKAKNPWRLCTVTQVEEVKCILSLIPIWMCTIIFSVEFTQMASTFVEQGTAMDTNLFGNFYMPAASMSMFDIASVILSVFAYNFFFVPMATWFTKNPAGITELQRMGTGLVIALVGMLAAAIVEVYRLRRVLAKDQPSPMSVLWQAPQYMLIGASEVFMYIGQLDFFNEQTPDSMKCFGSSLCMASISLGNYASMLMVSAVTSITNRQNKNGWITKNLNYGHLERFFLLLAVLSVIDFIFFALFSMMYKGIQFQGREKDISPNYN

SEQ ID NO: 19862 - DNA, 1446 bp, Sorghum bicolor
  misc_feature: Ceres ANNOT ID no. 8737988
  misc_feature: Encodes the peptide sequence at SEQ ID NO 19863
atgccgccgatccgggtgctgacggcgctagaccaggcgcgcacgcagtactaccacttcaaggccatcgtcatcgccggcatgggcctcttcaccgactcgtacgacctcttctgcatcgcgcccgtcatgaagctcatcggccgtgtctactacgcgcctgctgcgcaccccagcaggtacgtcgacgacgatggccgccgccccggcccgggcgtcacgccgcccgccgtggtgtccgccactgtgggcgtggcgctgctgggcgccgtggccgggaacctggtgttcggcggcctgggcgaccgcgtgggccggcgccgcgtctacggcgcgtcgctgctcctcatgctgtgcgcctccgcggggagcggcttctccgtgtgccgcacccgcggctgcgcgctcgccagcctctgcctcttccgcttcctcctcggcgtcgccgtcggcggcgactacccgctctccgccaccatcatgtccgagttcgccaaccgccgcacgcgtggcgccttcatcgctgccgtcttctccatgcagggcttcgggatcctcgccagctccgcggtcaccatggccgtcgccgccgcgttcgaccgctacacgggacgccgcgccccgttcgacgacacgcccgaggccgccgacctcgcctggcggatcatactcatgatcggagccgtacccgccgccgtcaccttctactggaggatggccatgcccgagacggccagcagcacgctgttccagtcccagatctaccgaccgtggttcccgccggctgagcacgcgaacgcgttccaggaggccttcaacgtggccaagttccaggccatcatcgccgttgcgtccaccatcccgggctacttcgtggccgtgctcctcatcgaccgcgtgggccgacgccggctccagatggccgggttcttcctcatggccgtcttcctcttcgcgctcgccggaccgtacgaccgctactggcgcggccacgccacggacgcctggtacaaggtgctctacgcgctcaccttcttctccgcgaacctcgggcccaacaccaccaccttcatcctgcccgccgagctctttccggcgagattccgatccacgtgccacgggatatctggcgcggcggggaaactcggcgcgctcgtcggcgccatcggcttcctgtgggcgtcacaggaccgggacaggagcaaagtgctggcagggtacgagccaggcatcggcatgatgtacgccctgattgtccttggcgggatctgcctgctcggcctcgccgtcacctacttgttcacgccggagaccatgaggcggtcgctggaggagaacgagagccaagctgcggaaggcgacgccggccagggcttccaggaacttggtgagctaccaaagagcccggcatccatgatgtatacgaacagccattggtgcacgtaa

SEQ ID NO: 19863 - protein, 481 aa, Sorghum bicolor
  misc_feature: Useful for making plants with modulated phosphate use efficiency
  misc_feature: Functional homolog of the protein sequence given in SEQ ID NO 14749
  misc_feature: Ceres ANNOT ID no. 8737988
  misc_feature (26)..(388): Pfam ID: MFS_1 Pfam Description: Major Facilitator Superfamily
MPPIRVLTALDQARTQYYHFKAIVIAGMGLFTDSYDLFCIAPVMKLIGRVYYAPAAHPSRYVDDDGRRPGPGVTPPAVVSATVGVALLGAVAGNLVFGGLGDRVGRRRVYGASLLLMLCASAGSGFSVCRTRGCALASLCLFRFLLGVAVGGDYPLSATIMSEFANRRTRGAFIAAVFSMQGFGILASSAVTMAVAAAFDRYTGRRAPFDDTPEAADLAWRIILMIGAVPAAVTFYWRMAMPETASSTLFQSQIYRPWFPPAEHANAFQEAFNVAKFQAIIAVASTIPGYFVAVLLIDRVGRRRLQMAGFFLMAVFLFALAGPYDRYWRGHATDAWYKVLYALTFFSANLGPNTTTFILPAELFPARFRSTCHGISGAAGKLGALVGAIGFLWASQDRDRSKVLAGYEPGIGMMYALIVLGGICLLGLAVTYLFTPETMRRSLEENESQAAEGDAGQGFQELGELPKSPASMMYTNSHWCT

SEQ ID NO: 19864 - DNA, 1074 bp, Sorghum bicolor
  misc_feature: Ceres ANNOT ID no. 8737994
  misc_feature: Encodes the peptide sequence at SEQ ID NO 19865
atggcggcggcgagtgaagcggcgtatggcggaggcgtgcagaaggggtccctgcagcagcaccaggcgccgcagcctagccccggctcggtcttctacacccctgacggcatcgccgtctacgcgaaaccggccatcccgccgttctaccaacagtccgcgggcagcaatgccatcgtgccggcggctccggggctagctcattcctccgccacttctgagcccttcaagcgcaagcgcgggcgcccgcgcaagtacggccccgcggacggcgccgtgcccctggctatcgtgcccccgtcgcagccacccactgctgctgccccagctgcctctgaggcgtcacccacgattcctcctggcttcgctccaagcccgcagggtggtggcgtggtgagtccccaggcctcaccggcgccgcagccgccggcggcgtcaggtgctcccgctgtcaagaagcggggccggccgccgggcccctccagcaagaagcaacagccgcaggcggcagcgcctggaccaggctgggctggatggaagcctcatattttcacagtccaagctggagaggatgtagcatcaagagtcatgtcattttctgggaatggatgggcagtttgtatcctcacagccaatggcgctgtatctaatgtgaccctgcgtcaaggagagtcttctggtggaacagtaacttatgagggccgttttgagattctctctttggctgggtcatatcttctgtcagaaagtgctggcatgagcagtcgaacaggtggacttagtgtttctcttgctggtcctgatgggcgtgttttaggtggtgctgtagcaggacctctaactgcagcttcgccagttcaggtggtcattgggagctttctggctgatacaaaaatggagcttgaccctggatcagcacccgaaaaacatgcttttggaagatttccaactgccagcagtccatctaggggtactgaatccttgggtgggcatgcaagcccaccaaacaccacaggctccttcagcaccagcacacagccaccaggcttcccaagcttccccccgtggaaatga

SEQ ID NO: 19865 - protein, 357 aa, Sorghum bicolor
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
  misc_feature: Ceres ANNOT ID no. 8737994
MAAASEAAYGGGVQKGSLQQHQAPQPSPGSVFYTPDGIAVYAKPAIPPFYQQSAGSNAIVPAAPGLAHSSATSEPFKRKRGRPRKYGPADGAVPLAIVPPSQPPTAAAPAASEASPTIPPGFAPSPQGGGVVSPQASPAPQPPAASGAPAVKKRGRPPGPSSKKQQPQAAAPGPGWAGWKPHIFTVQAGEDVASRVMSFSGNGWAVCILTANGAVSNVTLRQGESSGGTVTYEGRFEILSLAGSYLLSESAGMSSRTGGLSVSLAGPDGRVLGGAVAGPLTAASPVQVVIGSFLADTKMELDPGSAPEKHAFGRFPTASSPSRGTESLGGHASPPNTTGSFSTSTQPPGFPSFPPWK

SEQ ID NO: 19866 - DNA, 1446 bp, Sorghum bicolor; identical to SEQ ID NO: 19862
  misc_feature: Ceres ANNOT ID no. 8737990
  misc_feature: Encodes the peptide sequence at SEQ ID NO 19867

SEQ ID NO: 19867 - protein, 481 aa, Sorghum bicolor; identical to SEQ ID NO: 19863
  misc_feature: Useful for making plants with modulated phosphate use efficiency
  misc_feature: Functional homolog of the protein sequence given in SEQ ID NO 14749
  misc_feature: Ceres ANNOT ID no. 8737990
  misc_feature (26)..(388): Pfam ID: MFS_1 Pfam Description: Major Facilitator Superfamily

SEQ ID NO: 19868 - DNA, 1101 bp, Sorghum bicolor
  misc_feature: Ceres ANNOT ID no. 8737995
  misc_feature: Encodes the peptide sequence at SEQ ID NO 19869
atggaggaagggctcgggcttcccggccgtggaggaagggaaccgcggcggacttcccggccgtggaggacaaaacctccatatcgcacaaaacctccaccacgcgaccgcaagtaccgcggcgtccggcagcggccctggggcaagtacgcggcggagatccgcgacccgaagcggcgtggctcgcgcgtgtggctcggcacgtacgacgcgcccgtcgaggccacgcgcgcctacgaccgcgccgcgttccggatgtgcgccgccaaggccatcctcaacttccccaacgaggtcggcacccgcggcgctgacctttgggccgcgccagcgacgatggagggtggtcaggacgaccccgaggtcgaggtggtcgcggtggtgaacaaggtggtgaagatcgaggcgccgccaccgccgtcgacccaggtgtcctcaacctcaccgtcgtccgtgtctacacccgagaccaccgcctcatcggacgccccggactcgcgacgaccttccctgtcgtctggcgacgtcctggttcgccagcagaagcaatctcgtcgccgcaacagctcccagtatcctttcctctgcaactcacttgatgtcaacaagaggccaaagccttgtaagaagatagaatctacccctgtaaaggcaaaaaccacaactccaaaaattatacttcacgatcctaaacggactgacaacagtcagttggatgcacttcctgacaagctctcaaaactaaaaaagtggaagaccatcgccgagtctgtggtgattaatggggcggaagagaaattctttgagaaatcaactaagcattgggttggcgttgcattagccactgatcttgaagtcctcaagctgctaagttgtgccactggatccttctcttggacgatggttcatgatgttaggaaagctgtcctaattgtgcaattgcaaccttataatttttcttttattttagatgaaaaaaattggtgctgcactgagctttctaccactttggttgtttccatggatgtcaagaatctgctacttattatgtcgagttcagagtttatttcaaaaaaattacctgatcatttgttatgctga

SEQ ID NO: 19869 - protein, 366 aa, Sorghum bicolor
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 162 in the 10/714,887 US patent application
  misc_feature: The sequence is a functional homolog of SEQ ID NO 162 in the 11/435,388 US patent application
  misc_feature: The sequence is a functional homolog of SEQ ID NO 30 in the 10/903,236 US patent application
  misc_feature: Useful for making plants with altered lignin content
  misc_feature: Functional homolog of the protein sequence given in SEQ ID NO 13219
  misc_feature: Ceres ANNOT ID no. 8737995
  misc_feature (37)..(89): Pfam ID: AP2 Pfam Description: AP2 domain
MEEGLGLPGRGGREPRRTSRPWRTKPPYRTKPPPRDRKYRGVRQRPWGKYAAEIRDPKRRGSRVWLGTYDAPVEATRAYDRAAFRMCAAKAILNFPNEVGTRGADLWAAPATMEGGQDDPEVEVVAVVNKVVKIEAPPPPSTQVSSTSPSSVSTPETTASSDAPDSRRPSLSSGDVLVRQQKQSRRRNSSQYPFLCNSLDVNKRPKPCKKIESTPVKAKTTTPKIILHDPKRTDNSQLDALPDKLSKLKKWKTIAESVVINGAEEKFFEKSTKHWVGVALATDLEVLKLLSCATGSFSWTMVHDVRKAVLIVQLQPYNFSFILDEKNWCCTELSTTLVVSMDVKNLLLIMSSSEFISKKLPDHLLC

SEQ ID NO: 19870 - DNA, 933 bp, Sorghum bicolor
  misc_feature: Ceres ANNOT ID no. 8738097
  misc_feature: Encodes the peptide sequence at SEQ ID NO 19871
atggccggaatggatcctggcggcggcggcgggactgcgtcgcactacctggaactcctccgcgcgcagcagctgcagcaccagcagccgtcggcgccgctatccccttcctcccacgtcaagatggagcgctccgcgccgtcgccggagaacgtcgatcccggcggggatcagcccgccttggagggcagcggggggtccggtgggccgatgaggaagccgcgcgggcggccgccggggtccaagaacaagcccaagccgcccatcatcataacgcgggacagccccaacgcgctccactcccacgtcctcgaggtcgccgccggcgccgacatcgtcgagtgcgtctcggagtacgcgcgccgccgctgccgcggcgtatgcgtgctcagcggcggcggcgccgtctccaacctcgcgctacgccagcccggcgccgagcccccgggcagcctcgtcgccaccctgcgcgggcagttcgagatcctgtcgctcacgggcacggtgctgccgccgcccgcgcccccgggagccagcagccttagcgtgtacgtcgccggcgggcaggggcaggtgatgggcgggagcgtggtcggccagctcatcgccgccggacccgtagtcctcatggccgcgtcgttcgcgaacgccgtctacgagcggctgccgctggaggctgaggaggaagaggcggccacggcagccgcagccgctgctgctgccacagagacccaaggcgcagcggagccggcggaaggacagccacagcaacaggaggcgtcgcagtcttctggtgtgacgggtggcgatggcggtggcggtggcattggccatggcatgtcgctgtatgatcttggagggaacgcggctggctaccagttgcccggagagaacttcggcacctggagcggtggtatgaggccgccattttga

SEQ ID NO: 19871 - protein, 310 aa, Sorghum bicolor
  misc_feature: The sequence is a functional homolog of SEQ ID NO 87 in the 10/669,824 US patent application
  misc_feature: The sequence is a functional homolog of SEQ ID NO 89 in the 10/669,824 US patent application
  misc_feature: Ceres ANNOT ID no. 8738097
MAGMDPGGGGGTASHYLELLRAQQLQHQQPSAPLSPSSHVKMERSAPSPENVDPGGDQPALEGSGGSGGPMRKPRGRPPGSKNKPKPPIIITRDSPNALHSHVLEVAAGADIVECVSEYARRRCRGVCVLSGGGAVSNLALRQPGAEPPGSLVATLRGQFEILSLTGTVLPPPAPPGASSLSVYVAGGQGQVMGGSVVGQLIAAGPVVLMAASFANAVYERLPLEAEEEEAATAAAAAAAATETQGAAEPAEGQPQQQEASQSSGVTGGDGGGGGIGHGMSLYDLGGNAAGYQLPGENFGTWSGGMRPPF

SEQ ID NO: 19872 - DNA, 1287 bp, Sorghum bicolor
  misc_feature: Ceres ANNOT ID no. 8738399
  misc_feature: Encodes the peptide sequence at SEQ ID NO 19873
atggcgtcctcggtgggtcatataggcggccatcaccgtcggctgttggacacggcaggcccgccggcagcaccgccagggaaagcagcggtcaacaggtcgagctcaagcccggacacaacacggataatggtgggcgtgctggtaacggtcatcttctgcacgctgctctactgcatctactgctggagatggcggaagcgtaacgccatcaggaggtcgctgattcagaggctcgggccgcggtcgagctcggacttgccgctcattgacctcacctccatcctagcggccactgagaatttcgccgaggccaaaaagctcggcgagggagggttcggaccagtctacagaggcgtgctgagcggcggctcagaggtcgccgtcaagcgtttgtccgcgcggtcgcggcagggtgcggcggagttccggaacgaggtggagctgattgccaagctgcagcaccgcaacctggtgcgcatgctgggctggtgtgccgagcgcgacgagaagctacttgtctacgagtacctccccaacggcagcctcgacgccttcatcttcgatcggagaaagagagtgcagttgggctggagcacacgctacaacgtcatccttggcatcgctcgtggcctcctctacctccacgaggattccctcctcaagatcgtccaccgggacctcaaggccagcaatgtgctccttgacgacaagatgaaccccaagatctccgactttggcatggccaagatcttcgaggagtcaggtactggcatcaacatgatcggacgcgtcgttggaacctatgggtacatggcgcccgagctcgcgttggagggcgtgttctcagtgaagtctgacgtctttagcttcggagtgctcctcctagagatcctaagcgggcagcggaatggtgcactataccttgaggagcacgaccaatctctcatccgaggcgcatggaagctgtggatccaagacgctgcggccgagttcatggacccgtctcttggccgatcctactcaagggacgaggcgtggcggtgctaccacgtcggcctgctctgcgtgcagggaaaccccgaggtccgtcccaccatgtccagtgtcctcctcatgctcatcagcgaccatatggagctcccagcaccagacaagccaccgttgttcacaaggcacagtagcataccgttcccggcaatgccactctcaatcaggatagagtcaagggtgtctcctcctcattccatcaatgatgtcaccatcactgcaatcaaaccgcgatga

SEQ ID NO: 19873 - protein, 428 aa, Sorghum bicolor
  misc_feature: Useful for making plants with altered cell wall content and/or composition
  misc_feature: Functional homolog of the protein sequence given in SEQ ID NO 14140
  misc_feature: Ceres ANNOT ID no. 8738399
  misc_feature (87)..(377): SWISSPROT Homolog: EC 2.7.11.1 Non-specific serine/threonine protein kinase
  misc_feature (102)..(374): Pfam ID: Pkinase Pfam Description: Protein kinase domain
MASSVGHIGGHHRRLLDTAGPPAAPPGKAAVNRSSSSPDTTRIMVGVLVTVIFCTLLYCIYCWRWRKRNAIRRSLIQRLGPRSSSDLPLIDLTSILAATENFAEAKKLGEGGFGPVYRGVLSGGSEVAVKRLSARSRQGAAEFRNEVELIAKLQHRNLVRMLGWCAERDEKLLVYEYLPNGSLDAFIFDRRKRVQLGWSTRYNVILGIARGLLYLHEDSLLKIVHRDLKASNVLLDDKMNPKISDFGMAKIFEESGTGINMIGRVVGTYGYMAPELALEGVFSVKSDVFSFGVLLLEILSGQRNGALYLEEHDQSLIRGAWKLWIQDAAAEFMDPSLGRSYSRDEAWRCYHVGLLCVQGNPEVRPTMSSVLLMLISDHMELPAPDKPPLFTRHSSIPFPAMPLSIRIESRVSPPHSINDVTITAIKPR

SEQ ID NO: 19874 - DNA, 1248 bp, Sorghum bicolor
  misc_feature: Ceres ANNOT ID no. 8738467
  misc_feature: Encodes the peptide sequence at SEQ ID NO 19875
atggctcatcttggtggccaccgccggctgttgggaacggccccggctccggccggggacggggcgtcccacggctcgagctccagccctgacgcgatgcggatcatggtgggcgtgctggtgacggtcatcgtctgcacgctgctctactgcgtctactgctggcggtggcggaagcgcaatgccatccggagatccctgctggacagcctatggccgcggtcgagctcggacctgccgctcatggacctcgcctccatcctcgctgccaccgacaacttctccaaggccaacaagctcggcgagggcggcttcggcccggtctacagaggcgtgctgagcggcggctccgagatcgccgtgaagcgtttgtcggcgcggtcgcggcagggcgcggcggagttccgtaacgaggtggagctgatcgccaagctgcagcaccgcaacctggtgcgcctgctgggctggtgcgccgagcgcgacgagaagctactggtgtacgagtacctccccaaccgcagtctcgacgccttcctcttcgatcggagcaagagcgcgcagcttgggtggagcacccggcacaacgtcatcctgggcatcgcgcgcggcctgctgtacctccacgaggactcgctgctcaaggtggtccaccgggacctcaaggccagcaacgtgctcctcgaccacaagatgagccccaagatctccgacttcggcatggccaagatcttcgaggacgactccgacgggatcaacacgggccgcgtcgtcgggacctacgggtacatggcgccagagttcgcgttggagggcgtcttctcggtgaagtccgacgtgttcagcttcggagtcctcctgctggagatcctgagcgggcagcggaacggcgccttgtacctcgaggagcaccagcagtccctcatccaagatctgtggagtgaagatcgcgcgggcgagttcatggacccgtcgctggggcgatcctactccaaggacgaggcgtggcggtgctaccacgtcggcctgctctgcgtgcaggagaaccccgacgtccggccgaccatgtccaacgtcctgctcatgctcatcagcgaccacatgaagctccctgagccagccatgccgcccctcttcacgcggctcaggaacatctccctgatggcgccgccactcacgacgaaaaccgagtccacgatgtctccgctgtccatcaacgatgtctccatcacaatgatcgaaccgcgctga

SEQ ID NO: 19875 - protein, 415 aa, Sorghum bicolor
  misc_feature: Useful for making plants with altered cell wall content and/or composition
  misc_feature: Functional homolog of the protein sequence given in SEQ ID NO 14140
  misc_feature: Ceres ANNOT ID no. 8738467
  misc_feature (79)..(365): SWISSPROT Homolog: EC 2.7.11.1 Non-specific serine/threonine protein kinase
  misc_feature (94)..(362): Pfam ID: Pkinase Pfam Description: Protein kinase domain
MAHLGGHRRLLGTAPAPAGDGASHGSSSSPDAMRIMVGVLVTVIVCTLLYCVYCWRWRKRNAIRRSLLDSLWPRSSSDLPLMDLASILAATDNFSKANKLGEGGFGPVYRGVLSGGSEIAVKRLSARSRQGAAEFRNEVELIAKLQHRNLVRLLGWCAERDEKLLVYEYLPNRSLDAFLFDRSKSAQLGWSTRHNVILGIARGLLYLHEDSLLKVVHRDLKASNVLLDHKMSPKISDFGMAKIFEDDSDGINTGRVVGTYGYMAPEFALEGVFSVKSDVFSFGVLLLEILSGQRNGALYLEEHQQSLIQDLWSEDRAGEFMDPSLGRSYSKDEAWRCYHVGLLCVQENPDVRPTMSNVLLMLISDHMKLPEPAMPPLFTRLRNISLMAPPLTTKTESTMSPLSINDVSITMIEPR

SEQ ID NO: 19876 - DNA, 2058 bp, Sorghum bicolor
  misc_feature: Ceres ANNOT ID no. 8738520
  misc_feature: Encodes the peptide sequence at SEQ ID NO 19877
atggctgggtcggggaagactgttgtttggttcaggagagacctcaggatccacgataacccggccttggcagctgcggcgaaagagggctctgtcctccctctcttcatatggtgtcctgctgactacgagcagtattaccctggaaggtgctcccggtggtggctcaagcagtcccttgcccaccttgggaagtcactagagttgctcgggtgcccactcgtgctgatccgtgcggaggacagcactcttgcaactcttttggagtgcgtccattgcatcagtgccactagagtcgtttataatcgtctctacgaccctatttcacttgtgcttgacgacaaaatcaagaatgagctttcagcccatggcatatctgtccaaagtttcaatggtgatctactttacgagccgtgggatgtttatgatgagaatgggcaggcatttacatcctttaacaagtactgggagaaatgcatgaatgttcctattgagatatcacaatatcttgcacctacgaggctggtggcagcgccaggtctagcgaatgttcgctgttgttcaattgatgatctaggtcttgaatctagtaaggatgtggaatcaagcaatgctttgctaagcagggcctggtctcctggctggcgcaatgcagagaatatgcttgaggaatttttgtcatgtggtctcctagaatattcaaaacacggtatgaaggttgggggaactacaacgtcattattgtcaccatatctccatttcggggagttgagtgtaaggaaggtttatcaacttgttacaatgcatcatgtcaagtggcaaaatgaaggaaaatctgaagctgaggagagtgttcgattgttcctaagatcaattggttttcgggaatattcacggtacttatgttttaacttcccattcacgcacgagagatcatttctgggtaacttgaagcattatccctggctattggatgaggaccgtttcaaatcttggagacagggaatgactggatacccattagtagatgctggcatgagagaactctgggctactggttggacacataatcggataagagtgattgtttcaagtttcgctgtaaaatgtctacagataccctggatttggggaatgaagtacttttgggatgtgcttctggatgcagacctagaaagtgatattcttggttggcagtatatatctgggagtttgcctgatggacatgagctcagccgtcttgataatccagaggttcagggtcaaaagtacgatccagatggtgaatatgtaagaacttggattcctgaacttgctagaatgccaacagaatggatccattgtccatggagtgctcctaactctatattacaagttgctggagttgagttgggctttaactaccctaagcccatagtagaacttcatatggcgcgggaatgcttagatgacgccatctccacaatgtggcaactggacacagctgcaaaacttgctgcactagatggtgaagttgtggacgacaatctgaataatatcaggagttttgatatcccaaaggttgttttgaagaagaaattatctccaagcacttcatcgatgaacaaaagggtgctgtctactaatggcaagaacgaaaagtcacagcctactgaagtgaaggccccgtacaaacagattattcgagatgatatgatcaatgcctcaaacatggatgacaccggctctactgctaacttgcaagtgacaaggaaaagatctcgcagtgatagtgctttcaatgttccgtcatcttcatcctcactagtcatggaatcacggattcatgataatgacagttgttctgttcggtattcaggctacctccagcagacagcagacagggatgacactgataagttttccaaaaggttgaagataacgacagtgaagatagtggtacgagcatctctaggccatccaagagacctgcttagcactagcgcattgaagatgttgcaaatctctgatgggaactatttgccgtcacatgtaattttttgggtgcttttttattga

SEQ ID NO: 19877 - protein, 685 aa, Sorghum bicolor
  misc_feature: Useful for making plants with modulated light quality response
  misc_feature: Useful for making plants with modulated light quality sensitivity
  misc_feature: Functional homolog of the protein sequence given in SEQ ID NO 13499
  misc_feature: Useful for making plants with modulated low light sensitivity
  misc_feature: Useful for making plants with modulated nitrogen use efficiency
  misc_feature: Functional homolog of the protein sequence given in SEQ ID NO 13918
  misc_feature: Ceres ANNOT ID no. 8738520
  misc_feature (1)..(487): SWISSPROT Homolog: EC 4.1.99.3 Deoxyribodipyrimidine photo-lyase
  misc_feature (212)..(490): Pfam ID: FAD_binding_7 Pfam Description: FAD binding domain of DNA photolyase
  misc_feature (5)..(176): Pfam ID: DNA_photolyase Pfam Description: DNA photolyase
MAGSGKTVVWFRRDLRIHDNPALAAAAKEGSVLPLFIWCPADYEQYYPGRCSRWWLKQSLAHLGKSLELLGCPLVLIRAEDSTLATLLECVHCISATRVVYNRLYDPISLVLDDKIKNELSAHGISVQSFNGDLLYEPWDVYDENGQAFTSFNKYWEKCMNVPIEISQYLAPTRLVAAPGLANVRCCSIDDLGLESSKDVESSNALLSRAWSPGWRNAENMLEEFLSCGLLEYSKHGMKVGGTTTSLLSPYLHFGELSVRKVYQLVTMHHVKWQNEGKSEAEESVRLFLRSIGFREYSRYLCFNFPFTHERSFLGNLKHYPWLLDEDRFKSWRQGMTGYPLVDAGMRELWATGWTHNRIRVIVSSFAVKCLQIPWIWGMKYFWDVLLDADLESDILGWQYISGSLPDGHELSRLDNPEVQGQKYDPDGEYVRTWIPELARMPTEWIHCPWSAPNSILQVAGVELGFNYPKPIVELHMARECLDDAISTMWQLDTAAKLAALDGEVVDDNLNNIRSFDIPKVVLKKKLSPSTSSMNKRVLSTNGKNEKSQPTEVKAPYKQIIRDDMINASNMDDTGSTANLQVTRKRSRSDSAFNVPSSSSSLVMESRIHDNDSCSVRYSGYLQQTADRDDTDKFSKRLKITTVKIVVRASLGHPRDLLSTSALKMLQISDGNYLPSHVIFWVLFY

SEQ ID NO: 19878 - DNA, 939 bp, Sorghum bicolor
  misc_feature: Ceres ANNOT ID no. 8738585
  misc_feature: Encodes the peptide sequence at SEQ ID NO 19879
atggcaagagctttccacgccgcgtcaccggctaccgtccctgactcgccgtcgccgctcccgtcaaagaacgccggcggcggcctcgccaacttccaatggctgctcaggaagcgcgccaacaaggtgcagcagggccggcccgtcgccgtcgaccaagtggccgacgacggctgtgacgacgacgagtgcgcctccatgttcgccggcgccacgccctacatcggcccgatcgctggcgctggtcctgttactccagacgacgcgccagcaggcaggaagcgccgcagcgaggcgctgtcgcggctccggtcggcgatcctggcggtgctagcgcgagcgcggcgcgggcgtgggagacggccgctggggtcctgcgacaccgtcacgggcaccatcttcggccgtcgccgcggccgcgtgcacctcgcgctgcagactgacccgcgcgcaccgcccgctctcatggttgagctcgccgcctactccaccggcgcgctcgtcagggagatggcctcgggactcgtccgccttgctctcgagtgcgagaaggagaaggcacccgcaccgcctctgcaaacaggtgaccgtcatcaccagagacggccacggcagcaggcggcggcactggtggaggaggctacctggcgcgcgtattgcaacggccgcaagtgcggctacgcggtgcgccgggactgcggcgcggacgagtggcgggtgctgcgtgccgtggagcccgtctcagttggcgccggcgtgctccccgacggcaacaacatgagcacggaagccaccgccgccgccggcgagggcgacctcatgtacatgagggccaagttcgagcgggtggtggggtccagggactcggaggcattctacatggtaaaccccgacggcggtggcgggcccgagctcagcatctaccttctcagggtctag

SEQ ID NO: 19879 - protein, 312 aa, Sorghum bicolor
  misc_feature: Useful for biocontainment applications
  misc_feature: Functional homolog of the protein sequence given in SEQ ID NO 14434
  misc_feature: Useful for making plants with modulated flowering time
  misc_feature: Functional homolog of the protein sequence given in SEQ ID NO 14560
  misc_feature: Ceres ANNOT ID no. 8738585
MARAFHAASPATVPDSPSPLPSKNAGGGLANFQWLLRKRANKVQQGRPVAVDQVADDGCDDDECASMFAGATPYIGPIAGAGPVTPDDAPAGRKRRSEALSRLRSAILAVLARARRGRGRRPLGSCDTVTGTIFGRRRGRVHLALQTDPRAPPALMVELAAYSTGALVREMASGLVRLALECEKEKAPAPPLQTGDRHHQRRPRQQAAALVEEATWRAYCNGRKCGYAVRRDCGADEWRVLRAVEPVSVGAGVLPDGNNMSTEATAAAGEGDLMYMRAKFERVVGSRDSEAFYMVNPDGGGGPELSIYLLRV

SEQ ID NO: 19880 - DNA, 96 bp, Sorghum bicolor
  misc_feature: Ceres ANNOT ID no. 8738708
  misc_feature: Encodes the peptide sequence at SEQ ID NO 19881
atgtacaaagtccagtggaatcagtgcaccgaagaggaggctatttgtaaaagagaagaggatctaagaaaagcatacccgctttggtttgagtaa

SEQ ID NO: 19881 - protein, 31 aa, Sorghum bicolor
  misc_feature: The sequence is a functional homolog of SEQ ID NO 1584 in the 10/374,780 US patent application
  misc_feature: The sequence is a functional homolog of SEQ ID NO 1586 in the 10/374,780 US patent application
  misc_feature: The sequence is a functional homolog of SEQ ID NO 1585 in the 10/374,780 US patent application
  misc_feature: The sequence is a functional homolog of SEQ ID NO 1583 in the 10/374,780 US patent application
  misc_feature: Ceres ANNOT ID no. 8738708
MYKVQWNQCTEEEAICKREEDLRKAYPLWFE

SEQ ID NO: 19882 - DNA, 603 bp, Sorghum bicolor
  misc_feature: Ceres ANNOT ID no. 8739636
  misc_feature: Encodes the peptide sequence at SEQ ID NO 19883
atggcgggcatgggcttcttcaccgatgtctatgacctcttctgcatctcgctcgtcaccaagctgctcgaccacgtctactacaccgaccccaccaagccggatcccggcacgctgccgcccaacgtcgcggccacgatgaacagagtcgcactgtgcgggacttggctcagtgacaggcttggctggaagagcgtctacggcatgacactgctgctcatggtggtctgctcccttgcctccatgttctcgttcgggagcacggccgctggtgtcatggccatgctctgcttcttttgtttctggctcggctcggcatcggcagcgactacccgctcagcgccaccatcatgtccgaggacgccaacaagaagacccgcagcaggttcatcgccaccgtcttcgccatgcaaggattcagcatcctcgctggcgtcatcatcacggcaggaacgcctcgcagaggccgcctccgacatgtccatggtgctgcaggtggagatcgaggcggaggcagaggcggaggcggaggcagagaagctggatgagatcaccagcgataaggaatacggcctcttctatgcctgcgctcggagacattaa

SEQ ID NO: 19883 - protein, 200 aa, Sorghum bicolor
  misc_feature: Useful for making plants with modulated phosphate use efficiency
  misc_feature: Functional homolog of the protein sequence given in SEQ ID NO 13402
  misc_feature: Useful for making plants with modulated carbohydrate content
  misc_feature: Functional homolog of the protein sequence given in SEQ ID NO 13408
  misc_feature: Ceres ANNOT ID no. 8739636
MAGMGFFTDVYDLFCISLVTKLLDHVYYTDPTKPDPGTLPPNVAATMNRVALCGTWLSDRLGWKSVYGMTLLLMVVCSLASMFSFGSTAAGVMAMLCFFCFWLGSASAATTRSAPPSCPRTPTRRPAAGSSPPSSPCKDSASSLASSSRQERLAEAASDMSMVLQVEIEAEAEAEAEAEKLDEITSDKEYGLFYACARRH

SEQ ID NO: 19884 - DNA, 1272 bp, Sorghum bicolor
  misc_feature: Ceres ANNOT ID no. 8740735
  misc_feature: Encodes the peptide sequence at SEQ ID NO 19885
atggcttctgacagtagcttctactttgttcccttgctcctcctgttgatgctcttgctggtctctcctaccgccactgcagcacagccctcttccgagcctggcggcaatgccactgctgcaaggctgaggccggggaaggagctgctcaggcacaagaggatcagggctctgctgaccaagcttaacaagcctgctctcaagacaatccagagtccggatggtgatatcatagactgtgttccctctcacctacagcctgcatttgaccacccaaagctcaggggccaaaagattctggatccaccggagaggcccaagaactgcaacttcacccttggcggcagcagagtcagcgaggtggtagtgcaggcgtggcatgccactggcgaggcgtgtccggaggggacggtgccgatacggcggacgacggagaaggatctcctcagggccagctctctcaggaggtacggcaggaagcctgtgcgccgaggcgttcgccgggattccacaagcagcggtcatgagcatgcagttgggtatgtaaactctgaacattactatggggccaaggctagtgttaatgtgtggtcaccaagggtaggtgacccatccgagtttagcctgtcacagatctgggtcatctctggctctttcggcaatgatctcaacaccatcgaagctggatggcaggtaagccctgagctatacggagacagtaacccaagattcttcacctactggacaactgacgcgtaccaagaaactgggtgctacaaccacaattgccgcggattcgtgcagacgacgaacaagatcgcggttggggcggctatcaccccggaatcggtgtacaatggcaggcaatttgacattactctcatgatatggaaggatccaaagcacgggcactggtggctggagctgggcccgggcctcgtagtcgggtactggccgtcgtacctcttcagtcacctggctcgccacgccaacatggtgcagttcggcggtgaggtcgtcaacacccggccgtcggggtcgcacacggcgacacagatgggcagcggccacttccccagagagggcttcgaccgcgccgcctacttccggaacctgcaggtggtggactgggacaacaacctcatcccggcagccaacctgaaactcctcgccgatcaccccggatgctacgatatccagggaggctctaacagctactggggaagctacttctactacggagggccagggaggaacgtgaaatgtccctga

SEQ ID NO: 19885 - protein, 423 aa, Sorghum bicolor
  misc_feature: Useful for biocontainment applications
  misc_feature: Functional homolog of the protein sequence given in SEQ ID NO 14085
  misc_feature: Ceres ANNOT ID no. 8740735
MASDSSFYFVPLLLLLMLLLVSPTATAAQPSSEPGGNATAARLRPGKELLRHKRIRALLTKLNKPALKTIQSPDGDIIDCVPSHLQPAFDHPKLRGQKILDPPERPKNCNFTLGGSRVSEVVVQAWHATGEACPEGTVPIRRTTEKDLLRASSLRRYGRKPVRRGVRRDSTSSGHEHAVGYVNSEHYYGAKASVNVWSPRVGDPSEFSLSQIWVISGSFGNDLNTIEAGWQVSPELYGDSNPRFFTYWTTDAYQETGCYNHNCRGFVQTTNKIAVGAAITPESVYNGRQFDITLMIWKDPKHGHWWLELGPGLVVGYWPSYLFSHLARHANMVQFGGEVVNTRPSGSHTATQMGSGHFPREGFDRAAYFRNLQVVDWDNNLIPAANLKLLADHPGCYDIQGGSNSYWGSYFYYGGPGRNVKCP

SEQ ID NO: 19886 - DNA, 1719 bp, Sorghum bicolor
  misc_feature: Ceres ANNOT ID no. 8740887
  misc_feature: Encodes the peptide sequence at SEQ ID NO 19887
atgaagtccggcgagcggccgaagctggtgcggggcctccggcaggagtctcggcggttccgcctgctagtcatcgtcgtcggattcttcctcgtctccctgaccttcgtcgtcatctccaagcccgacgccatcctattcagcctgaacggcaagctaccggtggaccaggcgccgacatccatcctgatccagcagaaggttaactcgcccccagccaccacggttaagacctccaccgacgcactccgtggagaccctagagtggttgatgacgaagctgatccaagaccgcaagggttcaaaggcgaggaggaagagagccgggtcctgagcgagccggacccgaccagcgggatgacggagctgacccctaacaaggacggcagcggccgtaaatccgacgaggataagttaggcggcggcggtgacggcgaggggaaaaggagggaggagcgtgggcacgaggcggacaagcataaagtcacgctcccaaccgtttccaattacactattcatgacaccgaggacacggaaactgccaaaaaagatgatacaagttatgaccagcaggggagcaagcccctgtgtgatttctcaaattttagagcaaatgtgtgcgagatgcgtggtgatgttagagttcacccaaatgctacagaaatcatgttcatggagcctggccattcgcagagagatgagctgtggaaaattaagccataccctcggaaaggagacgagttctgccttagccatatcactgagctgacagtaaaatcaagcaaagtggccccagagtgcaccaagtaccatgacatgcctgctgtgatcttttccctgacaggctatactggaaatctgttccatgacttcactgacgtgatggtccctcttttcacgacagcaagtgagtttaatggagaagttcagttccttataacggacatggcactttggtggacaatcaagtaccacactgtgcttcagaagctgtccaagtaccctgtcattgatttcagcaaggatgaccaggtgcactgcttcaagcatgtcattgtcggcctccatgcttacatggaattcacgatagactcgtcgaaggctccacacaactattcaatggttgattttaacagattcatgcgcggagcttactcactgggcagggacaccgttaccgtgcttggagagtaccctaaggtcaagccaaggttgctcatcatcaagaggcaccgtacaaggatgttccttaaccttgatgagatcgttgcaatggctgaggagctcggctttgaggtggttatcgatgaggccaatgtgagctctgatatctccaagttcgccaggctggttaacacggtggacgttatgatgggtgtccatggagctgggcttacaaactgcgtgttcttgccacagaatgccacactgattcagattgtgccgtggggagggttggaatgggtatcccgtactgatttcggcaacccggcagagctgatggggctgcactacaagcaatacagcatcggcgtggacgagagcagcctcacggagcaatatccgagggaccatgagatcttcaagaatcctattgctttccataagaacgggtttgacttcatcaggcaaaccttcatggacaagcaaaacgtgaagctggattgcaagaggttcaggcctattctattggaggcactggataacctcaacccataa

SEQ ID NO: 19887 - protein, 572 aa, Sorghum bicolor
  misc_feature: Useful for making plants with altered carbohydrate content
  misc_feature: Functional homolog of the protein sequence given in SEQ ID NO 14534
  misc_feature: Ceres ANNOT ID no. 8740887
MKSGERPKLVRGLRQESRRFRLLVIVVGFFLVSLTFVVISKPDAILFSLNGKLPVDQAPTSILIQQKVNSPPATTVKTSTDALRGDPRVVDDEADPRPQGFKGEEEESRVLSEPDPTSGMTELTPNKDGSGRKSDEDKLGGGGDGEGKRREERGHEADKHKVTLPTVSNYTIHDTEDTETAKKDDTSYDQQGSKPLCDFSNFRANVCEMRGDVRVHPNATEIMFMEPGHSQRDELWKIKPYPRKGDEFCLSHITELTVKSSKVAPECTKYHDMPAVIFSLTGYTGNLFHDFTDVMVPLFTTASEFNGEVQFLITDMALWWTIKYHTVLQKLSKYPVIDFSKDDQVHCFKHVIVGLHAYMEFTIDSSKAPHNYSMVDFNRFMRGAYSLGRDTVTVLGEYPKVKPRLLIIKRHRTRMFLNLDEIVAMAEELGFEVVIDEANVSSDISKFARLVNTVDVMMGVHGAGLTNCVFLPQNATLIQIVPWGGLEWVSRTDFGNPAELMGLHYKQYSIGVDESSLTEQYPRDHEIFKNPIAFHKNGFDFIRQTFMDKQNVKLDCKRFRPILLEALDNLNP

SEQ ID NO: 19888 - DNA, 3174 bp, Sorghum bicolor
  misc_feature: Ceres ANNOT ID no. 8741359
  misc_feature: Encodes the peptide sequence at SEQ ID NO 19889
atgtcgtcgtcctggtcatcggcgtcgaagacacccgtcaattcaacgaggcggccgtcgagcgggcgcctcccgagtatctccaacgacgtagacgttgaggacgagccggagttcacctccaccatgtccggtggcggcagcgactatgccaactacactgtcctcatgccgcccacccctgacaaccagccgtatagcggcggaggcggagcgccgtcctctgcgtccgctggtggtaccaggccggacgatctgccgttgccgccgtatggcccttcggcgtcctctaagctcgtcaaccggcgtggtgttgccggcgcggacgacggcgtggggcccggcagcggcaagatggaccggcggctgtccacggcgcgcgtgccggcgccgtccaagtcgctgcttgtgcggagccagaccggggacttcgaccacaaccggtggctgttcgagaccaagggaacgtacggcatcgggaacgcgtactggccgcaggacagcaacgcgtatggcgtcgacgaggacggcggcgtgggcagcgctcccgtcaagatggaggacctcgttgacaagccgtggaagccactcagccgaaaggtggccatccctcccggcattcttagcccctacaggctgctggtgctggtgcggttcatctcgttgttcctgttcctgatctggcgtgtgacgaaccccaacctggacgcgctatggctgtgggggatctccatcgtgtgcgaattctggttcgccttctcgtggctgctggaccagatgccaaagctgaatcccatcaaccgtgccgtcgacctcagcgcgctccgggagaagttcgagtcggtgacgccgtccaaccccaccggccggtccgacctccccgggctcgacgtcttcatctccactgccgacccctacaaggagccgcccctcaccacggccaactcgctgctctccatcctcggcacggagtaccccgtggagaagctcttcgtctacatctcggacgacggcggcgcgctgcttaccttcgaagccatggcggaggcctgcgagttcgccaaggtttgggtgcccttctgccgcaagcactcgatcgagccacgcaacccggacgcgtacttcaaccagaagggcgaccccaccaagggcaagaagcggccagactttgtcaaggaccgccggtggattaagcgcgagtacgacgagttcaaggtccgcatcaacggcctcgccgacctcatccgccggcgtgccaacgcaatgaatgctcgcgagcgtaagatcgcccgcgacaaggctgccgccgcctcctctgatgccccagtcgccgacgcccccaccgtcaaggccacctggatggcggacggcacccactggcccggcacctggctcgactccgcccctgaccacgccaagggcgaccatgcaagcatcgtgcaggtgatgatcaagaacccgcactacgacgtggtgcacggcgacgccgggtcgcacccgtacttggacttcaccggcgtggacgtgcgcatcccgatgttcgtgtacctctcgcgggagaagcgtccggggtacgaccacaacaagaaggcgggcgccatgaacgccatggtgcgcgcgtcggcgatcctctccaatgggcccttcatgctcaacttcgactgcgaccactacatctacaactgcatggccatccgcgaggccatgtgctacatgctcgaccgtggcggtgaccgcatatgctacatccagttcccgcagcgcttcgagggcatcgacccctccgaccgctacgccaaccacaacaccgtcttcttcgacggcaacatgcgcgcgctcgacggcctacagggccccatgtacgtcggcaccggctgcctcttccggcggtacgccgtctacgccttcaacccgccgcgcaccaacgagtaccgcggcatctacggccaggtcaaggtgcccatcgacccgcacggtcactctgcacccggcgccgccgaggagctccgcccgctgtcggagcacccggaccacgaggcgccgcagcggttcggcaagtccaagatgttcatcgagaccatcgccgtcgccgagtaccagggccggccgctgcaggaccacccgtcggtccagaacgggcggccgcctggcgcgctgctgatgccgcgcccgccgctggacgcggccaccgtggcggagtccgtgtctgtgatctcgtgctggtacgaggacggcaccgagtggggactgcgagtggggtggatctacggctcggtgacggaggacgtggtgaccgggtaccgcatgcacaaccgcgggtggcgctccgtgtactgcatcacccggcgcgacgcgttccgcggcacggcacccatcaacctcaccgaccggctccaccaggtcctccggtgggcgacggggtcggtggagatcttcttctccaagaacaacgcgctgctggcgtcccagcggctcaagttcctgcagcgcttatcgtacctcaacgtcggcatctacccgttcacctcactcttcctcatcatgtactgcctcctgccggcgctgtccctcttctccggccagttcatcgtggcgacgctggacccgacattcctgtgctacctcctgctcatcaccatcacgctgatgctgctgtgcctgctggaggtgaagtggtccggtatcggcctggaggagtggtggcgcaacgagcagttctgggtgatcggcggcacgtcggcgcacctggccgcggtgctgcagggcttgctgaaggtgatcgcgggcatcgagatctccttcacgctgacggccaaggcggcggcggaggacgacgatgaccccttcgcggagctgtacctcgtgaagtggacgtcgctctttatcccaccgttggcagtgatcgggatcaacatcatcgcgctcgtcgtcggcgtgtcccgcaccgtgtacgcggagatcccgcagtacagcaagctgctgggcggcggcttcttcagcttctgggtgctggcgcactactacccgttcgccaaggggctcatgggccgccgcggacgcacaccgaccctcgtctacgtctgggcggggctcatctccatcaccgtctccctgctctggatcaccatcagcccgcccgacgacaggatcacccagggcggcatcgaggtgtga

SEQ ID NO: 19889 - protein, 1057 aa, Sorghum bicolor
  misc_feature: Useful for making plants with altered cell wall content and/or composition
  misc_feature: Functional homolog of the protein sequence given in SEQ ID NO 14750
  misc_feature: Useful for making plants with modulated plant growth and development
  misc_feature: Functional homolog of the protein sequence given in SEQ ID NO 13629
  misc_feature: Ceres ANNOT ID no. 8741359
  misc_feature (488)..(1051): SWISSPROT Homolog: EC 2.4.1.12 Cellulose synthase (UDP-forming)
  misc_feature (196)..(1057): Pfam ID: Cellulose_synt Pfam Description: Cellulose synthase
MSSSWSSASKTPVNSTRRPSSGRLPSISNDVDVEDEPEFTSTMSGGGSDYANYTVLMPPTPDNQPYSGGGGAPSSASAGGTRPDDLPLPPYGPSASSKLVNRRGVAGADDGVGPGSGKMDRRLSTARVPAPSKSLLVRSQTGDFDHNRWLFETKGTYGIGNAYWPQDSNAYGVDEDGGVGSAPVKMEDLVDKPWKPLSRKVAIPPGILSPYRLLVLVRFISLFLFLIWRVTNPNLDALWLWGISIVCEFWFAFSWLLDQMPKLNPINRAVDLSALREKFESVTPSNPTGRSDLPGLDVFISTADPYKEPPLTTANSLLSILGTEYPVEKLFVYISDDGGALLTFEAMAEACEFAKVWVPFCRKHSIEPRNPDAYFNQKGDPTKGKKRPDFVKDRRWIKREYDEFKVRINGLADLIRRRANAMNARERKIARDKAAAASSDAPVADAPTVKATWMADGTHWPGTWLDSAPDHAKGDHASIVQVMIKNPHYDVVHGDAGSHPYLDFTGVDVRIPMFVYLSREKRPGYDHNKKAGAMNAMVRASAILSNGPFMLNFDCDHYIYNCMAIREAMCYMLDRGGDRICYIQFPQRFEGIDPSDRYANHNTVFFDGNMRALDGLQGPMYVGTGCLFRRYAVYAFNPPRTNEYRGIYGQVKVPIDPHGHSAPGAAEELRPLSEHPDHEAPQRFGKSKMFIETIAVAEYQGRPLQDHPSVQNGRPPGALLMPRPPLDAATVAESVSVISCWYEDGTEWGLRVGWIYGSVTEDVVTGYRMHNRGWRSVYCITRRDAFRGTAPINLTDRLHQVLRWATGSVEIFFSKNNALLASQRLKFLQRLSYLNVGIYPFTSLFLIMYCLLPALSLFSGQFIVATLDPTFLCYLLLITITLMLLCLLEVKWSGIGLEEWWRNEQFWVIGGTSAHLAAVLQGLLKVIAGIEISFTLTAKAAAEDDDDPFAELYLVKWTSLFIPPLAVIGINIIALVVGVSRTVYAEIPQYSKLLGGGFFSFWVLAHYYPFAKGLMGRRGRTPTLVYVWAGLISITVSLLWITISPPDDRITQGGIEV

SEQ ID NO: 19890 - DNA, 648 bp, Sorghum bicolor
  misc_feature: Ceres ANNOT ID no. 8741546
  misc_feature: Encodes the peptide sequence at SEQ ID NO 19891
atggtgaagccgggcaagaaaacgagcagggggcgccagaaaattgagatccgccgcatcgagaagaaggagagccgccaggtgacccagtgcaagcgcaagggcgggctcctaaagaaggcctcggagctccacctcctgtgcggcgcccatgtcgccgtcatcgtcttcaagagaacggagcccgagggaaaggaggtggccgtcgcgccccgcggcaaacgcgacgacggcggcggcggcggcattgccttcgcgatgggcaccccctccgtcgaccacgtcctccgcctgctccacgccgacgagggccggctcaccgcgctccagcaggacgtgggcgccgtcgccgccgagcgtgccgtcacggaggcgagagcgcgggagacggagcagaccagggcgctcgtggaggccgagaaggcgcggaacgacgccatcggggagaaggtgctgcaggccgtggaggtgtccgggaggcggttctggtgggaggtggacgtcggggtgctcggcgaggccgagctgccggtcttcacttcgcagctccagcgcctcagggacagcgtgcagctccaagccaacagatcgcagacctctgctacgcccggcggcggtggcgcggcgccgtggcaacagctgggatag

SEQ ID NO: 19891 - protein, 215 aa, Sorghum bicolor
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1949 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8741546
  misc_feature (18)..(69): Pfam ID: SRF-TF Pfam Description: SRF-type transcription factor (DNA-binding and dimerisation domain)
MVKPGKKTSRGRQKIEIRRIEKKESRQVTQCKRKGGLLKKASELHLLCGAHVAVIVFKRTEPEGKEVAVAPRGKRDDGGGGGIAFAMGTPSVDHVLRLLHADEGRLTALQQDVGAVAAERAVTEARARETEQTRALVEAEKARNDAIGEKVLQAVEVSGRRFWWEVDVGVLGEAELPVFTSQLQRLRDSVQLQANRSQTSATPGGGGAAPWQQLG

SEQ ID NO: 19892 - DNA, 1053 bp, Sorghum bicolor
  misc_feature: Ceres ANNOT ID no. 8741624
  misc_feature: Encodes the peptide sequence at SEQ ID NO 19893
atggagggcgatctgcgttggtgctgtggtagcagcagcaacgactgggacctacacgccgtggtgcgcctcgccagctgcagtggtggcagccgcagccgcgtcacctcgccgtcgccgtgggcctcggacgaatcattctcctgcctgcccccgccgccgcagtcacagaaggacgaggtgacgacggacgccgcagcgttgcagcagcccctgatcagccctgccgtcgacgacctctgcggcctgcagcaggccttcttggccgccacgccgcagccaagaagcgaagcgccgccgccgcagccgccggcgaaaccacgaacttcctaccgcaataacgacggcggcgttggcggcggaccgacacgatccaagagaaagaagaagaagagccaggtgaccagcaaggaggtgacgcgggtgcctgtgggcacgtctgcggacccctgggcgtggcgcaagtacgggcagaagccgatcaaggggtcgccgtacccgcgcggctactaccggtgcagcaccgacaaggactgcagggcgcggaagcaggtggagcgctgccgcaccgacgcctctaccctcatcgtcagctacaccggcgagcacagccacccagtcccactccaccgcaacgccctcgccggcaccacgcgcaacaagccgcagccagcaccgtccacctccccagccgagcagcctccagctgcgtcgccgatcgtgggagtggagtacgaggaggacgacacagtcgccgccagtgtgctgctcgaggatgccgagacggagggagaggaagacgtgctgtcgttgttcctcgagctcgctccgagtcccagcaacggcagtggctccaaggacgtcatggtatccacggagctccacaatggcagaggctcgcagaaagtcgtggcactctcgaagctccacgagttccgacatccagcaacgacgagcagcagcagaacgagcgatggcttaggggcggctccggcggccatgaacgtgacccacgagaactgccctttctcaggactccgactcacgacgtag

SEQ ID NO: 19893 - protein, 350 aa, Sorghum bicolor
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8741624
  misc_feature (147)..(207): Pfam ID: WRKY Pfam Description: WRKY DNA -binding domain
MEGDLRWCCGSSSNDWDLHAVVRLASCSGGSRSRVTSPSPWASDESFSCLPPPPQSQKDEVTTDAAALQQPLISPAVDDLCGLQQAFLAATPQPRSEAPPPQPPAKPRTSYRNNDGGVGGGPTRSKRKKKKSQVTSKEVTRVPVGTSADPWAWRKYGQKPIKGSPYPRGYYRCSTDKDCRARKQVERCRTDASTLIVSYTGEHSHPVPLHRNALAGTTRNKPQPAPSTSPAEQPPAASPIVGVEYEEDDTVAASVLLEDAETEGEEDVLSLFLELAPSPSNGSGSKDVMVSTELHNGRGSQKVVALSKLHEFRHPATTSSSRTSDGLGAAPAAMNVTHENCPFSGLRLTT

SEQ ID NO: 19894 - DNA, 990 bp, Sorghum bicolor
  misc_feature: Ceres ANNOT ID no. 8741685
  misc_feature: Encodes the peptide sequence at SEQ ID NO 19895
atgtcgccttccaccaggagctgttcatggcttgttcttgttcccctgatcctctcgattcttctcgcgtgcactgccaacggcgaccatctaaaggtgggctactacgacaatacgtgccccaacgtgcagcagatcgtgcactccgtgatggcgtccagggtcgacgccgaccagtcgatggcgcccgccgtgctccgcctcttcttccacgactgcttcgtcgacgggtgcgacggctccgtcctactggacgggacgcccttctccgggagcgagaaggacgccaagcccaacgccaactcgctccggggcttcgacgtgatcgacgagatcaagtcccacgtcgagcatgcctgcccggccacggtctcctgcgccgacatcctcgcgctcgcctcccgcgacgccgtcgcgctgctcgggggcccgacgtgggaagtgcagctcggccgcagggactcgcgcggcgccaacaggaccgccgccgagtacggtctcccagccccgaactccaccctcgccgagctcattggcctgttcaggcaccacggcctcgacgcgcgcgacatggcggcgctctccggcgcgcacaccatcggcacggcgcggtgccaccactacaggaaccgagcctacggctacggcggcgagggcggcgccgccgccatcgaccccgcgttcgcggagcggcgcaggcagacgtgccagtccgcttatgacgcgccggcgccgttcgacgagcagaccccgatggggttcgacaacgcctactaccgggacctcgtggcgcggcgcggcctcctcacctccgaccaggcgctctacggcggcggtggaccgctggacaatctggtggaaatgtacagcacggacggcaaggcgttcgccaaggattttgccagggcaatggtgaagatgggcaaaataccaccgccaccacagatgcaggtggaggtcagactcagctgcagtaacatcaactggtga

SEQ ID NO: 19895 - protein, 329 aa, Sorghum bicolor
  misc_feature: Useful for making plants with altered carbohydrate content
  misc_feature: Functional homolog of the protein sequence given in SEQ ID NO 13713
  misc_feature: Useful for making plants with altered cell wall content and/or composition
  misc_feature: Functional homolog of the protein sequence given in SEQ ID NO 13958
  misc_feature: Ceres ANNOT ID no. 8741685
  misc_feature (31)..(328): SWISSPROT Homolog: EC 1.11.1.7 Peroxidase
  misc_feature (47)..(292): Pfam ID: peroxidase Pfam Description: Peroxidase
MSPSTRSCSWLVLVPLILSILLACTANGDHLKVGYYDNTCPNVQQIVHSVMASRVDADQSMAPAVLRLFFHDCFVDGCDGSVLLDGTPFSGSEKDAKPNANSLRGFDVIDEIKSHVEHACPATVSCADILALASRDAVALLGGPTWEVQLGRRDSRGANRTAAEYGLPAPNSTLAELIGLFRHHGLDARDMAALSGAHTIGTARCHHYRNRAYGYGGEGGAAAIDPAFAERRRQTCQSAYDAPAPFDEQTPMGFDNAYYRDLVARRGLLTSDQALYGGGGPLDNLVEMYSTDGKAFAKDFARAMVKMGKIPPPPQMQVEVRLSCSNINW

SEQ ID NO: 19896 - DNA, 1068 bp, Sorghum bicolor
  misc_feature: Ceres ANNOT ID no. 8742135
  misc_feature: Encodes the peptide sequence at SEQ ID NO 19897
atgcatccaggaggtggaccactgtcggtgccaccaggcttccgcttccatccgaccgacgaggagctcctctactactacctgaggaagaaggttgcttatgagcccatagatcttgatgtcataagggagattgatctcaataagcttgagccctgggatctcaaagaaaggtgcagaataggcaccgggcctcagaacgagtggtacttcttcagccataaggacaagaagtacccaacggggacgaggacgaaccgcgccacgacggcggggttctggaaggcgactgggcgagacaaggccatcttccttggcaacgccaggaggatcggcttgaggaagaccctggtgttctacatcggcagggcgccacacggcaagaagacagactggatcatgcacgagtaccgccttgacgaagaaaacgttgagattcaggaagagggatgggtggtgtgtagggttttcaagaagaagagctatcaccagagaggcctcaatccggctgaaatggccttactggaggacgatgagctccagcctttccctgttcctatccccggcagctccctgccaacagagcacaagaacaaccctcacctcatgcaatatgacttcccttccttcgacccttccatgcagctcccacagctaatgagcgccgaccagcccgtgccaaccctcctccccagccatcccggtcccggcgtcgccatggccatgagctcactcgacgttgagtgctcgcagaataatctgaccaagctcacagccaacggcagcgacgggatgctccacgtccacggtggtggtgctggaggtggtgtggaccgcttcgctggcacgacagattggtcgatcctagacaagctcctcgcctcgcaccagaacctcgaccagctcttccatggcaaggtcaccgcggcatctgcctccccgccaatggcggcataccatcagcagctcatggaactcggtgggtcgtcgtcgtcgtcgtccttgcagaggcttccactgcagtacctcggcggcgagacggccgatctcctcaggttccccaagtag

SEQ ID NO: 19897 - protein, 355 aa, Sorghum bicolor
  misc_feature: Useful for making plants with altered carbohydrate content
  misc_feature: Functional homolog of the protein sequence given in SEQ ID NO 13622
  misc_feature: Useful for making plants with altered cell wall content and/or composition
  misc_feature: Useful for making plants with altered lignin content
  misc_feature: Functional homolog of the protein sequence given in SEQ ID NO 14527
  misc_feature: The sequence is a functional homolog of SEQ ID NO 160 in the 10/666,642 US patent application
  misc_feature: The sequence is a functional homolog of SEQ ID NO 634 in the 10/412,699 US patent application
  misc_feature: The sequence is a functional homolog of SEQ ID NO 638 in the 11/435,388 US patent application
  misc_feature: The sequence is a functional homolog of SEQ ID NO 132 in the 10/225,066 US patent application
  misc_feature: The sequence is a functional homolog of SEQ ID NO 1508 in the 10/666,642 US patent application
  misc_feature: The sequence is a functional homolog of SEQ ID NO 1924 in the 10/412,699 US patent application
  misc_feature: The sequence is a functional homolog of SEQ ID NO 2186 in the 10/374,780 US patent application
  misc_feature: The sequence is a functional homolog of SEQ ID NO 564 in the 11/435,388 US patent application
  misc_feature: Useful for biocontainment applications
  misc_feature: Functional homolog of the protein sequence given in SEQ ID NO 13623
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: Ceres ANNOT ID no. 8742135
  misc_feature (10)..(140): Pfam ID: NAM Pfam Description: No apical meristem (NAM) protein
MHPGGGPLSVPPGFRFHPTDEELLYYYLRKKVAYEPIDLDVIREIDLNKLEPWDLKERCRIGTGPQNEWYFFSHKDKKYPTGTRTNRATTAGFWKATGRDKAIFLGNARRIGLRKTLVFYIGRAPHGKKTDWIMHEYRLDEENVEIQEEGWVVCRVFKKKSYHQRGLNPAEMALLEDDELQPFPVPIPGSSLPTEHKNNPHLMQYDFPSFDPSMQLPQLMSADQPVPTLLPSHPGPGVAMAMSSLDVECSQNNLTKLTANGSDGMLHVHGGGAGGGVDRFAGTTDWSILDKLLASHQNLDQLFHGKVTAASASPPMAAYHQQLMELGGSSSSSSLQRLPLQYLGGETADLLRFPK

SEQ ID NO: 19898 - DNA, 1089 bp, Sorghum bicolor
  misc_feature: Ceres ANNOT ID no. 8742133
  misc_feature: Encodes the peptide sequence at SEQ ID NO 19899
atggtgtgcatcttagatcttaggttttgtaaggaagaatgcatcgaggaagtggactcggtgccaccaggcttctgcttccatctgaccgacgaggagctcctctactactacctgaggaagaaggtttcttatgagcccatagatcttgatgtcataagggagattgatctcaataagcttgagccctgggatctcaagctaactcacacaaatcttatatggaacatggcagaaaggtgcagaataggcaccgggcctcagaacgagtggtacttcttcagccacaaggacatgaagtacccaacagggacaaggacgaaccgcgccacaacagtggggttctggaaggcaactgggcgggacaagggcatcttccttggtaactccaggaggatcagcttgaggaagaccctggtgtcctacattggcagggcgccacatggcaagaagaccgactggatcatgcacgagtatcgccttgacgaagagaacattgagattcatgaagatggatgggtagtatgtagggttttcaagaagaactatcgtcaaggaggccccaacccagctgaggccttgtttagtttgcaaaaaaatgcggacgacgatgagatccagcatttcccagttccaatccctggctccctgccaacagaacataggaacaaccctcacctcatgcaatataacttcccttccttcgacccttccctgcagctcccacagctgatgagcgccgaccagcacgtgccaaccctcctccgcagccagcctggtgttgccatgcccatgagctcactcgacgttgagtgctcgcaaaacctgacaaagctgacatccaacagcagcgacgggatgctcaacggtggtgattggttgatcctagacatgctccttatcttgcaccagaacctcgaccagctgtttcacaacaaggttaccgcggcatcttcctccccaatgacggcatactatcagcagttcatggaactcggtagctcatcctccttgcacaggcttccagtgcagtacaccggcagcgaagcggccgatttctcaggttcccaagtagttggatcgacctaa

SEQ ID NO: 19899 - protein, 362 aa, Sorghum bicolor
  misc_feature: Useful for making plants with altered carbohydrate content
  misc_feature: Functional homolog of the protein sequence given in SEQ ID NO 13622
  misc_feature: Useful for making plants with altered cell wall content and/or composition
  misc_feature: Functional homolog of the protein sequence given in SEQ ID NO 14132
  misc_feature: Useful for making plants with altered lignin content
  misc_feature: Functional homolog of the protein sequence given in SEQ ID NO 14527
  misc_feature: Useful for biocontainment applications
  misc_feature: Functional homolog of the protein sequence given in SEQ ID NO 13623
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Ceres ANNOT ID no. 8742133
  misc_feature (21)..(162): Pfam ID: NAM Pfam Description: No apical meristem (NAM) protein
MVCILDLRFCKEECIEEVDSVPPGFCFHLTDEELLYYYLRKKVSYEPIDLDVIREIDLNKLEPWDLKLTHTNLIWNMAERCRIGTGPQNEWYFFSHKDMKYPTGTRTNRATTVGFWKATGRDKGIFLGNSRRISLRKTLVSYIGRAPHGKKTDWIMHEYRLDEENIEIHEDGWVVCRVFKKNYRQGGPNPAEALFSLQKNADDDEIQHFPVPIPGSLPTEHRNNPHLMQYNFPSFDPSLQLPQLMSADQHVPTLLRSQPGVAMPMSSLDVECSQNLTKLTSNSSDGMLNGGDWLILDMLLILHQNLDQLFHNKVTAASSSPMTAYYQQFMELGSSSSLHRLPVQYTGSEAADFSGSQVVGST

SEQ ID NO: 19900 - DNA, 1257 bp, Sorghum bicolor
  misc_feature: Ceres ANNOT ID no. 8742197
  misc_feature: Encodes the peptide sequence at SEQ ID NO 19901
atggcattattcgcattgtcgtctctgaaaccaacaagcaggcttgtcatcatctgtgccctcctctgcatcttcctgctgtcttcagaggtgagcttggtgcggcaggccacagcactgggcatcaactacgggcaggtcgggaacaacctgccggcgccgccgcaggtggtgcagctcctctcgtcgctgcgcatcggcaaggtccgcatctacgacgtgaacccgcaggtgctgacggcgttcgcgggcacgggcatcgagctgatcgtgacggtcccggacgacctggtccccggcatggccgggagcgcgtcgcaggcgctgcagtggctgagcgccagcgtgcggccctacttcccggcggcgcgcgtgacggggatcgccgtcggcaacgaggtgttcacgggcgacgacgagcagctcaaggccagccttgtccccgccatgcgcaacctgcacgcggcgctggcgcagctgggcatggacgcgtacgtgcgcgtgtccaccgccaactccctcgccgtgctcgccacctcctacccgccgtcgcagggcgtcttcacgcaggccgccgcgccatacatggcgcagctcctgcggttcctcgccgagaccagcgcacccttctggatcaatgcttacccctactttgcctacaaggacgacccaacaaaggtgtcgcttgactacgcgctttcgaacccgtcgcacgtgggcgcggtggatccgttcacgaagctgcagtacacgagcatgctgtacgcgcaggtggacgcggtgaccttcgcggcggcgcggctgggctacggcaacgtgccggtgcacgtgtcggagacggggtggccgtcgaagggcgacgccgacgaggccggcgccaccgtggagaacgcgcggcagtacaaccggaacctgctgatgcggcaggtgagcggcgagggcacgccgctgcggcccaggctccggctcgaggtctacctcttcgcgctcttcaacgaggacatgaaaccggggccgacgtcggagaggaactacggactgtaccagccggacatgagcatggtctacaacgtcggactctcgcagctctccaccaccaacgccgcctcgctctccctcgccacgtcgccggcagccaggaccacggtgagggcttccttccttcttgcaacttctgaatatccaatccgatgggtcaacatttatattatactactgatgacaaagcaaccctatataagtatgtacatctactga

SEQ ID NO: 19901 - protein, 418 aa, Sorghum bicolor
  misc_feature: Useful for making plants with altered cell wall content and/or composition
  misc_feature: Functional homolog of the protein sequence given in SEQ ID NO 14751
  misc_feature: Useful for making plants with altered carbohydrate content
  misc_feature: Functional homolog of the protein sequence given in SEQ ID NO 14606
  misc_feature: Ceres ANNOT ID no. 8742197
  misc_feature (21)..(359): SWISSPROT Homolog: EC 3.2.1.39 Glucan endo-1,3-beta-D-glucosidase
  misc_feature (40)..(360): Pfam ID: Glyco_hydro_17 Pfam Description: Glycosyl hydrolases family 17
MALFALSSLKPTSRLVIICALLCIFLLSSEVSLVRQATALGINYGQVGNNLPAPPQVVQLLSSLRIGKVRIYDVNPQVLTAFAGTGIELIVTVPDDLVPGMAGSASQALQWLSASVRPYFPAARVTGIAVGNEVFTGDDEQLKASLVPAMRNLHAALAQLGMDAYVRVSTANSLAVLATSYPPSQGVFTQAAAPYMAQLLRFLAETSAPFWINAYPYFAYKDDPTKVSLDYALSNPSHVGAVDPFTKLQYTSMLYAQVDAVTFAAARLGYGNVPVHVSETGWPSKGDADEAGATVENARQYNRNLLMRQVSGEGTPLRPRLRLEVYLFALFNEDMKPGPTSERNYGLYQPDMSMVYNVGLSQLSTTNAASLSLATSPAARTTVRASFLLATSEYPIRWVNIYIILLMTKQPYISMYIY

SEQ ID NO: 19902 - DNA, 837 bp, Sorghum bicolor
  misc_feature: Ceres ANNOT ID no. 8742299
  misc_feature: Encodes the peptide sequence at SEQ ID NO 19903
atggcatccaagaatcaagttgatctcgagtcccagaagcccgcgccggcgactgctgacgccgtcgttgcatcggcggctcccataaccgtaactgccctgccggtttcttctggtggagcttcatcagtggggagaaactcaggctccgtcgtcgtcggcgtctccgacggtcggcacgtggcgccggagacccagccactcctcctggctgagctgccgaacggcgacagccacgacgacgagggactgggagacgacgacggtggggctaccagtaccaccggcgacgaggcgacgaggctggagcgagcaatggcgaaggcattccggagcaccgcagagctggccaagcacctccccaccggcgcggttcttgtcttcgaggtgctgtcgcccgtgttcaccaacggcggcaagtgcgacgacgtgaaccgcgtcatgacggcctggctcgtggggctctgcgccgcggggtgcttcttcctctgcttcacggacagcttccacgacgccaagggcaccgtgcggtacgtggtggccactcgccgcggggtgtgggtcatcgacggcacgccgccgccgtcgccggagaaagccgccgagaaacgagtcaagttcatcgacttcttccacgcgttcatgtccctcgtcgtcttcatgtccgtggccatgttcgataggaatgttggggcgtgcttcaaccctgtcatgtcctacgacacgcggcaggtgctgactgccgtgccgcttgccggagggctcgtcgggacgctgctcttcgccacattcccgtcgacacggcacgggatcggattcccggtccccgccgcctga

SEQ ID NO: 19903 - protein, 278 aa, Sorghum bicolor
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13254
  misc_feature: Ceres ANNOT ID no. 8742299
MASKNQVDLESQKPAPATADAVVASAAPITVTALPVSSGGASSVGRNSGSVVVGVSDGRHVAPETQPLLLAELPNGDSHDDEGLGDDDGGATSTTGDEATRLERAMAKAFRSTAELAKHLPTGAVLVFEVLSPVFTNGGKCDDVNRVMTAWLVGLCAAGCFFLCFTDSFHDAKGTVRYVVATRRGVWVIDGTPPPSPEKAAEKRVKFIDFFHAFMSLVVFMSVAMFDRNVGACFNPVMSYDTRQVLTAVPLAGGLVGTLLFATFPSTRHGIGFPVPAA

SEQ ID NO: 19904 - DNA, 957 bp, Sorghum bicolor
  misc_feature: Ceres ANNOT ID no. 8742571
  misc_feature: Encodes the peptide sequence at SEQ ID NO 19905
atgggcacgtcgtcgttggcgagaagcgttgctcttcttactctgctctgcctgcttcttacctgtcatgggaagctctccaccaagttctacgccaagtcgtgcccgggcgtggccgccatcgtccggtcggtgacggcgcaggcagtcgccaaggagcccaggatgggcgcgtccatcatccgcctcttcttccacgactgcttcgtcaatggttgtgacgcgtccatcctcctggatgacacgccgacgttcaccggcgagaagaacgccggagccaacgtcaactccgtccgcgggtacgaggtcatcgacgccatcaagacgcaggtcgaagcagcctgcaaggccaccgtctcgtgcgccgacatcgtcgccttggcgtctcgtgacgccgtaaacttgctcggaggcccaacatggaacgtgcagctcggccggacggactcgcgcacggcgagccagagcgcggccaacgccaacctcccaggcccgggctccagcgcggcgtccctcgtcgccgcgttcgcggccaaggggctctcggcgcgcgacatgacggcgctctccggcgcgcacaccgtggggcgggcgcggtgcgtcttcttccgcgggcgcatctacggcgagcccaacatcaacgccaccttcgcggcggtgcggcagcagacgtgcccgcagaccggcggcgacggcaacctcgcgccgttcgacgaccagacgcccgacgcgttcgacaacgcctactacgcgaacctggtggcgcggcgcgggctgctgcactcggaccaggagctcttcaacggcgggacacaggacgcgctggtgaggaagtacagcggcaatggccgcatgttcgccaacgacttcgcgaaggcgatggtcaagatgggcggccttgcgccggcggccggaacgcccacggaggtcagattgaactgccggaaggtgaactaa

SEQ ID NO: 19905 - protein, 318 aa, Sorghum bicolor
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13606
  misc_feature: Ceres ANNOT ID no. 8742571
  misc_feature (25)..(318): SWISSPROT Homolog: EC 1.11.1.7 Peroxidase
  misc_feature (42)..(282): Pfam ID: peroxidase Pfam Description: Peroxidase
MGTSSLARSVALLTLLCLLLTCHGKLSTKFYAKSCPGVAAIVRSVTAQAVAKEPRMGASIIRLFFHDCFVNGCDASILLDDTPTFTGEKNAGANVNSVRGYEVIDAIKTQVEAACKATVSCADIVALASRDAVNLLGGPTWNVQLGRTDSRTASQSAANANLPGPGSSAASLVAAFAAKGLSARDMTALSGAHTVGRARCVFFRGRIYGEPNINATFAAVRQQTCPQTGGDGNLAPFDDQTPDAFDNAYYANLVARRGLLHSDQELFNGGTQDALVRKYSGNGRMFANDFAKAMVKMGGLAPAAGTPTEVRLNCRKVN

SEQ ID NO: 19906 - DNA, 945 bp, Sorghum bicolor
  misc_feature: Ceres ANNOT ID no. 8742561
  misc_feature: Encodes the peptide sequence at SEQ ID NO 19907
atggcggctcctaccttgatgcaatgcttggtcgccatttccctcctctcctgtgtcgcccacgcacagctctcgaccacgttctatgcatcctcctgccccaacctgcagagcatcgtgcggagggcgatgatccaggccctcagcaatgaccagaggatgggcgcctctctgctcaggctcttcttccacgactgctttgttcaaggttgcgacggctcgatccttctcgacgccggaggggagaagacggccggccccaacgccaattcggcgcgcggctttgaggtcatcgacaccatcaagaccaacgtggaggccgcgtgccccggcgtcgtgtcgtgcgccgacatccttgcccttgccgcgcgagacggaaccaatctgctcggcgggccgacctggaacgtgccgctgggccggcgggactcgacgacggcgagcgcgtcccttgccaacagcaacctcccgcagtcgacggcgagcctgggtacgctcatctcgctgttcagcaggcagggcctgtcggcgcgcgacatgacggcgctgtcgggcgcgcacaccatcgggcaggcccggtgcaccaccttccgcagccgcatctacggcgacaccaacatcaacgcctccttcgcggcggcgctccggcagcagacgtgcccgcagtccggcggcgacggcaacttggcgcccatggacgtgcagacgccgacgaggttcgacacggactactacaccaacctgctgtcgcaacggggcctgttccactcggaccaggagctcttcaacggcgggtcgcaggacgcgctggtgaggcagtacagcgccaacccctcgctcttcaacagcgacttcatggcggccatgattaagatgggcaacgttggggtgctaaccggcaccgccggacagatcaggcgcaactgccgagtcgtcaacagctag

SEQ ID NO: 19907 - protein, 314 aa, Sorghum bicolor
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13662
  misc_feature: Useful for making plants with modulated oxidative stress sensitivity
  misc_feature: Functional homolog of the protein sequence given in SEQ ID NO 13607
  misc_feature: Ceres ANNOT ID no. 8742561
  misc_feature (1)..(313): SWISSPROT Homolog: EC 1.11.1.7 Peroxidase
  misc_feature (40)..(277): Pfam ID: peroxidase Pfam Description: Peroxidase
MAAPTLMQCLVAISLLSCVAHAQLSTTFYASSCPNLQSIVRRAMIQALSNDQRMGASLLRLFFHDCFVQGCDGSILLDAGGEKTAGPNANSARGFEVIDTIKTNVEAACPGVVSCADILALAARDGTNLLGGPTWNVPLGRRDSTTASASLANSNLPQSTASLGTLISLFSRQGLSARDMTALSGAHTIGQARCTTFRSRIYGDTNINASFAAALRQQTCPQSGGDGNLAPMDVQTPTRFDTDYYTNLLSQRGLFHSDQELFNGGSQDALVRQYSANPSLFNSDFMAAMIKMGNVGVLTGTAGQIRRNCRVVNS

SEQ ID NO: 19908 - DNA, 564 bp, Sorghum bicolor
  misc_feature: Ceres ANNOT ID no. 8742582
  misc_feature: Encodes the peptide sequence at SEQ ID NO 19909
atggggagaccgagcaaggggcggcagcgcatcgagatccgccgcatcgaggatgccggccggctcgaggtcaccttctccaagcgcaagtccggcctgcaaaagaaggcctccgagctcttcctgctctgcggctcgccagtcgccctcgtcgtgttctccccgggcaaaaaggcgttcgctctgggcactccctctgtcgacgacgtccttcgccgccacgccccggtccccggcgaggagctggacgccaagatccttgcggtgcttcaggacacagacgatgcgagcgctgtcgccgaccgcgcggaggcagaggccattgtgcggcgaacggaggacaccagggcgcgttcggcgacggagaaggcgcggatggacgccatcgggaagtcggtgaggcaggccgcggcaaaggccgggagaaagttctggtgggaggcggactcagacgagctcggggaggatgagctgcctgaattcgtcaaggtgctccgcaggctcagggtcaacctgcagcgccatttggactcgctgtcggcccctgctaggcagctgcagtag

SEQ ID NO: 19909 - protein, 187 aa, Sorghum bicolor
  misc_feature: Useful for making plants with altered lignin content
  misc_feature: Functional homolog of the protein sequence given in SEQ ID NO 12944
  misc_feature: Ceres ANNOT ID no. 8742582
  misc_feature (14)..(64): Pfam ID: SRF-TF Pfam Description: SRF-type transcription factor (DNA-binding and dimerisation domain)
MGRPSKGRQRIEIRRIEDAGRLEVTFSKRKSGLQKKASELFLLCGSPVALVVFSPGKKAFALGTPSVDDVLRRHAPVPGEELDAKILAVLQDTDDASAVADRAEAEAIVRRTEDTRARSATEKARMDAIGKSVRQAAAKAGRKFWWEADSDELGEDELPEFVKVLRRLRVNLQRHLDSLSAPARQLQ

SEQ ID NO: 19910 - DNA, 942 bp, Sorghum bicolor
  misc_feature: Ceres ANNOT ID no. 8742567
  misc_feature: Encodes the peptide sequence at SEQ ID NO 19911
atggcggctcctaccttgatgcaatgcttggtcgccatttccctcctctcctgtgtcgcccacgcacagctctcgaccacgttctatgcgtcctcctgccccaagctgcagagcatcgtgcggaaggcgatgatccaggccctcagcaatgaccagaggatgggcgcctctctgctcaggctcttcttccacgactgctttgttcaaggttgcgacggctcgatccttctcgacgccggaggggagaagacggcaggccccaacgccaactcggtgcgcggctatgaggtcatcgacaccatcaagacgaacgtggaggccgcgtgccccggcgtcgtgtcgtgcgccgacatcctcgcccttgccgcgcgagaaggaacgaatctgctcggcgggccgacctggaacgtgccgctgggccggcgggactcgacgacggcgagcgcgtccctcgccaacagcaacctcccgccggcgacggccagcctgggcacgctcatctcgctgttcggcaggcagggcctgtcggcgcgcgacatgacggcgctgtcgggcgcgcactccatcgggcaggcccggtgcaccaccttccgcagccgcatctacggcgacaccaacatcaacgcctccttcgcggcgctccggcagcagacgtgcccgcagtccggcggcgacggcaacctggcgtccatcgacgagcagacgccgacgaggttcgacacggactactacaccaacctgatgttgcaacggggcctgttccactcagaccaggagctcttcaacggcgggtcgcaggacgcgctggtgaggcagtacagcgccagctcctcgctcttcaacagcgacttcgtggcggccatgattaagatgggcaacgttggggtgcttaccggcaccgctggacagatcaggcgcaactgccgggtcgtcaacagctag

SEQ ID NO: 19911 - protein, 313 aa, Sorghum bicolor
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13662
  misc_feature: Useful for making plants with modulated oxidative stress sensitivity
  misc_feature: Functional homolog of the protein sequence given in SEQ ID NO 13607
  misc_feature: Ceres ANNOT ID no. 8742567
  misc_feature (1)..(312): SWISSPROT Homolog: EC 1.11.1.7 Peroxidase
  misc_feature (40)..(276): Pfam ID: peroxidase Pfam Description: Peroxidase
MAAPTLMQCLVAISLLSCVAHAQLSTTFYASSCPKLQSIVRKAMIQALSNDQRMGASLLRLFFHDCFVQGCDGSILLDAGGEKTAGPNANSVRGYEVIDTIKTNVEAACPGVVSCADILALAAREGTNLLGGPTWNVPLGRRDSTTASASLANSNLPPATASLGTLISLFGRQGLSARDMTALSGAHSIGQARCTTFRSRIYGDTNINASFAALRQQTCPQSGGDGNLASIDEQTPTRFDTDYYTNLMLQRGLFHSDQELFNGGSQDALVRQYSASSSLFNSDFVAAMIKMGNVGVLTGTAGQIRRNCRVVNS

SEQ ID NO: 19912 - DNA, 1008 bp, Sorghum bicolor
  misc_feature: Ceres ANNOT ID no. 8742936
  misc_feature: Encodes the peptide sequence at SEQ ID NO 19913
atggaggcagctagatctagcgtgtcgctgttgtcaggcggatcttcccatctccatctcgtcgatccacgttggcgccttcgactccatgtgttcgtgacccgcctcatattgcaaaaaaatttcaggtgcgactcagcagtgctatctggattcttgctaatgtttcttgcgagcatcatgtggatgaagcttgtctcttatgcacatacaaattatgatataagggcattgtccaaaagtactgaaaagggtgctgcatatggaaattatgtcgatcctgagagtatgaaagatccaacctttaaaagtctagtgtacttcatgttggccccaacactttgttaccagccaacttatccccgaactacatgtattaggaagggttgggtgacccgacaacttataaagtgcctggtttttacaggcttgatgggcttcataattgagcaatatataaacccaattgtgaagaattccaaacatccactgaaagggaatttcttgaatgctatagaaagagtcttaaaactctcagtgccaacattatatgtatggctttgcatgttctattgcttttttcatttatggctgaacattctagctgaactcctctgtttcggtgaccgtgaattctacaaggactggtggaatgccaaaactgttgaagagcctgttcataaatggatcatcagacacatatattttccatgtataaggaaaggcttttccaggggtgtagctattctagtctcgtttctggtttcagctgtatttcatgagatatgtattgcggtgccgtgccacattttcaaattctgggcattttctgggatcatgtttcagataccgttggtattcttgacaagatatctccaggctacgttcaagaatataatggtgggcaacatgatattttggttcttcttcagtatagtcgggcagccgatgtgtgtccttttatactaccatgatgtcatgaacaggcaggcccaggcaagtagataa

SEQ ID NO: 19913 - protein, 335 aa, Sorghum bicolor
  misc_feature: The sequence is a functional homolog of SEQ ID NO 2 in US patent 7067718
  misc_feature: Ceres ANNOT ID no. 8742936
  misc_feature (51)..(334): SWISSPROT Homolog: EC 2.3.1.20 Diacylglycerol O-acyltransferase
  misc_feature (42)..(315): Pfam ID: MBOAT Pfam Description: MBOAT family
MEAARSSVSLLSGGSSHLHLVDPRWRLRLHVFVTRLILQKNFRCDSAVLSGFLLMFLASIMWMKLVSYAHTNYDIRALSKSTEKGAAYGNYVDPESMKDPTFKSLVYFMLAPTLCYQPTYPRTTCIRKGWVTRQLIKCLVFTGLMGFIIEQYINPIVKNSKHPLKGNFLNAIERVLKLSVPTLYVWLCMFYCFFHLWLNILAELLCFGDREFYKDWWNAKTVEEPVHKWIIRHIYFPCIRKGFSRGVAILVSFLVSAVFHEICIAVPCHIFKFWAFSGIMFQIPLVFLTRYLQATFKNIMVGNMIFWFFFSIVGQPMCVLLYYHDVMNRQAQASR

SEQ ID NO: 19914 - DNA, 1620 bp, Sorghum bicolor
  misc_feature: Ceres ANNOT ID no. 8742946
  misc_feature: Encodes the peptide sequence at SEQ ID NO 19915
atggagatggcaggcgccgcaggaacggcggagacatggttgccgtacgtcaccacggcggcgtcctgcgccgtcgccgtcttcttcctgctctacttctacgcgccacagtgggcggtcaggggcgtgccggggccgccggcgttgcctgtcgtggggcacctccctctgctcgcccggcacgggcctgacatcttcggcctcctcgccaagaaatatggccccatcttcaggttccatttggggaggcagcctctggtgatcgtcgctgacccggagctctgcagggaggttggcgtcagacagttcaagctcatccccaacaggagcttgccggcgccgatcgccggctcccctctccaccagaagggtctcttcttcaccagggacgaacggtggtcggcgatgaggaacacgatcatctcgctgtaccagccatcgcacctcgccggcctcgtccccaccatgcagcgctgcatcgagcgcgccgcggacgccatactggcgccgggtgtccagcagaacggcgacggcgacgtcgacgtcgacgtcgacttctccgacctctcgctcaagctggccacggacatcatcgggcaggcggcgttcggcgtggatttcggcctcacggcgagcggtgatcccggcggcgaggccgcggagttcatcagagagcacgtccactccacgacctccctgaagatggacctgtccgcgccgctctccgtcgcgctcggcctcgtcgcgcccgcgctgcagggcccggtacgccggctgctgagccgtgtcccggggacggccgactggaaggtcgcgcggaccaacgcgcggctccgcgcgcgggtggacgaggtcgtggcggcgcgggcgcgggcgcgcgagcgccgccgccacggcgaagcgaggacgaaggacttcctgtcagcggtgctcgacgcccgggaccgcagcgccgcgctccgggagctgctcacgccggaccacgtcagcgcgctcacctacgagcacctcctcgccgggtcggccaccacggcgttcacgctctcgtccgcagtgtacctcgtcgccggccacccggaggtagaggccaagctactggctgaggtcgacggtttcgggccgcgcggcgccgtgccgaccgccgacgacctgcaccaccggttcccctaccttgatcaggtcataatggaggccatgagattctacacagtctcgccattgatcgccagggtgacgtctcgacgaacagagctcggaggccacgagctcccaaagggcacgtggctgtggatggcgccgggcgtgctgtcccgcgacgccgccagcttcttcccggaccccggcgcgttccggccggagcggttcgacccggcgagcgaggagcagcgcgggcggcacccgtgcgcgcacatccccttcggcatcggcccgcgggcgtgcgtggggcagcggttcgcgctgcaggagctgaagctgtccatggtgcacctgtaccagcgcttcctcttccggcggtcgccgcagatggagtcgccgccggagctccagttcgggatcgtgctcaacttcaagaacggcgtcaaactcgtcgcagttgagcggtgcgctgccatgtcgtag

SEQ ID NO: 19915 - protein, 539 aa, Sorghum bicolor
  misc_feature: Useful for biocontainment applications
  misc_feature: Useful for making plants with modulated biomass
  misc_feature: Functional homolog of the protein sequence given in SEQ ID NO 14445
  misc_feature: Ceres ANNOT ID no. 8742946
  misc_feature (320)..(534): SWISSPROT Homolog: EC 5.3.99.5 Thromboxane-A synthase
  misc_feature (43)..(530): Pfam ID: p450 Pfam Description: Cytochrome P450
MEMAGAAGTAETWLPYVTTAASCAVAVFFLLYFYAPQWAVRGVPGPPALPVVGHLPLLARHGPDIFGLLAKKYGPIFRFHLGRQPLVIVADPELCREVGVRQFKLIPNRSLPAPIAGSPLHQKGLFFTRDERWSAMRNTIISLYQPSHLAGLVPTMQRCIERAADAILAPGVQQNGDGDVDVDVDFSDLSLKLATDIIGQAAFGVDFGLTASGDPGGEAAEFIREHVHSTTSLKMDLSAPLSVALGLVAPALQGPVRRLLSRVPGTADWKVARTNARLRARVDEVVAARARARERRRHGEARTKDFLSAVLDARDRSAALRELLTPDHVSALTYEHLLAGSATTAFTLSSAVYLVAGHPEVEAKLLAEVDGFGPRGAVPTADDLHHRFPYLDQVIMEAMRFYTVSPLIARVTSRRTELGGHELPKGTWLWMAPGVLSRDAASFFPDPGAFRPERFDPASEEQRGRHPCAHIPFGIGPRACVGQRFALQELKLSMVHLYQRFLFRRSPQMESPPELQFGIVLNFKNGVKLVAVERCAAMS

SEQ ID NO: 19916 - DNA, 513 bp, Sorghum bicolor
  misc_feature: Ceres ANNOT ID no. 8742935
  misc_feature: Encodes the peptide sequence at SEQ ID NO 19917
atggccgccgcctccgatcgcgccgtccccggcgccgacgcgaccgaggcgtcctccctccgcctccgccgcgccccctcagccgacgccggcgaccttgccgacgattcctcaggagaccggcgggagaacggcgagccgcaaccgccgcaggagcagcagcagcagcacgagatgctgtactaccgcgcgtcggcgcccgcccaccgccgcgtcaaggagagccccctcagctccgacgccatcttccggcagagccatgctggtcttctgaatctatgcatcgttgttctgattgcagtgaacagcagactcattattgagaatttaatgaagtatggcctattgataagagctggattttggtttagtgcaagatcgctgggtgactggccccttctaatgtgctgcctcactttaccagttttcccacttgttgccctcatggctgagaagctgattagaagaaagctcattggtgaacatgtaagtttgtcccataggattgtatag

SEQ ID NO: 19917 - protein, 170 aa, Sorghum bicolor
  misc_feature: The sequence is a functional homolog of SEQ ID NO 2 in US patent 7067718
  misc_feature: Ceres ANNOT ID no. 8742935
  misc_feature (71)..(170): SWISSPROT Homolog: EC 2.3.1.20 Diacylglycerol O-acyltransferase
MAAASDRAVPGADATEASSLRLRRAPSADAGDLADDSSGDRRENGEPQPPQEQQQQHEMLYYRASAPAHRRVKESPLSSDAIFRQSHAGLLNLCIVVLIAVNSRLIIENLMKYGLLIRAGFWFSARSLGDWPLLMCCLTLPVFPLVALMAEKLIRRKLIGEHVSLSHRIV

SEQ ID NO: 19918 - DNA, 813 bp, Sorghum bicolor
  misc_feature: Ceres ANNOT ID no. 8743009
  misc_feature: Encodes the peptide sequence at SEQ ID NO 19919
atgcagggagaccccgggtacgggtacggtggctatggcgccggcgggtacggcggctacggtgccggcgccggcgctggaggctacggctacgacattgccgccgccaacggcggcggaggcggctactactcggcgaccgaccggtaccctgccgcgcctgctgctgcctatgaggacccgctggctggtcagaggcagcacgacttcccggcgccgctcacagggctcgagttccagccgtcggacacctgccccaagaactacgtcatcttcgaccagacgtacgaccggagccgggtgatgttccacccgtctctggcaaacaacttcggctcctcccccgccggcggatacgactacggcagccactgctacggtggctacgaccagagctactaccccggcgagagcgcctaccacggctgcggcggtgacgatggcgccgtcggcggcggtgtctcggtccggcagaaggaggacaccgacgagatcgacgcgctgatgagcacggaggacggcgacgacgaggacgacgtgctcagcacgggccgcacgccgggctgccgcgctggtggctccccggactccacgtgctcgtccggcgggtatgctggcggcggccggaagcacgagaccggcggcggtgagaagaagaaggagcggatgaagaagatggtgcggacgctcaaggggatcatccccggtggcgaccggatggacacgccggccgtcctcgacgaggccgtcaggtaccttaagtcgctcaaggtggaggtcaagaaggccggcgcgcgtgggtcaagcagctag

SEQ ID NO: 19919 - protein, 270 aa, Sorghum bicolor
  misc_feature: Useful for making plants with altered carbohydrate content
  misc_feature: Functional homolog of the protein sequence given in SEQ ID NO 13941
  misc_feature: Ceres ANNOT ID no. 8743009
MQGDPGYGYGGYGAGGYGGYGAGAGAGGYGYDIAAANGGGGGYYSATDRYPAAPAAAYEDPLAGQRQHDFPAPLTGLEFQPSDTCPKNYVIFDQTYDRSRVMFHPSLANNFGSSPAGGYDYGSHCYGGYDQSYYPGESAYHGCGGDDGAVGGGVSVRQKEDTDEIDALMSTEDGDDEDDVLSTGRTPGCRAGGSPDSTCSSGGYAGGGRKHETGGGEKKKERMKKMVRTLKGIIPGGDRMDTPAVLDEAVRYLKSLKVEVKKAGARGSSS

SEQ ID NO: 19920 - DNA, 2178 bp, Sorghum bicolor
  misc_feature: Ceres ANNOT ID no. 8743088
  misc_feature: Encodes the peptide sequence at SEQ ID NO 19921
atgatgtccggcggcgtgctcttcctggccctgctggcggcggcggcggcgttggccatcatcgtcgccccgtccccagccaatgcggcggtgtcgtacgaccacagggcggtggtgatcaacgggcagcgccggatcctcatctccggctccatccactacccacgcagcacgccggagatgtggccggaccttctccagaaggccaaggacggcggcctcgacgtggtccagacctacgtcttctggaacgggcacgaaccccagcagggccagtactacttcggcgaccgctacgacctcgtccgcttcgtcaagctcgccaagcaggccggcctcttcgtgcacctccgcatcgggccctacgtctgcgccgagtggaacttcggcggcttccccgtgtggctcaagtacgtccccggcgtcagcttccgcaccgacaacgcgccgttcaaggcggcgatgcaggcgttcgtggagaagatcgtgtcgatgatgaaggcggaggggctcttcgagtggcagggcgggcccatcatcctcgcgcaggtggagaacgagtacgggcccatggagtccgtcatgggcggcggcgccaagccctacgccaactgggcggccaagatggccgtcgccaccggcgccggcgtgccctgggtcatgtgcaagcaggacgacgcaccggaccccgtgatcaacacctgcaatggcttctactgcgattacttcagccccaactccaacagcaagcctacaatgtggaccgaggcctggaccggctggttcacggcgttcggtggcgcggtgccacaccggccggtggaggacatggccttcgccgtggcgcgcttcatccagaagggcggctccttcgtcaactactacatgtaccatggaggcaccaacttcgaccgcacctccggcgggccgttcatcgccaccagctacgattacgatgcgccgatcgacgaatacggtctgctgaggcagccgaaatggggtcacctgagggacctgcacaaggccatcaagcaagccgagccggcgctggtctccggcgaccccaccatccagaccatcgggaactacgagaaggcgtacgtgtacaagtcgagcagcggcgcgtgcgcggcgttcctgtccaactaccacaccaacgcggcggcgcgggtggtgttcaacgggcggcgctacgacctcccggcgtggtccatcagcgtgctgccggactgcaggacggccgtgttcaacacggcgacggtgagctcgccgtcggcgccggcgaggatgacccccgcgggcggcttctcgtggcagtcgtacagcgaggccaccaactcgctggacgaccgcgccttcaccaaggacggcctggtggagcagctcagcatgacgtgggacaagtccgactacctgtggtacaccacctacgtgaacatcaactcgaacgagcagttcttgaagtccggacagtggccgcagctgaccatctactccgccggccacgccctgcaggtgttcgtcaacgggcagtcctacggcgccgcgtatggcggctacgacagcccgaagctgacatacagcgggtacgtgaagatgtggcagggcagcaacaagatctccatcctcagcgcagcagtcggcctccctaaccagggcacccactacgaggcgtggaacgtcggcgtgctcggtccggtgacgctgtccggcctcaacgagggcaagagggacctcagcaaccagaaatggacctaccagatcggcctgcacggcgagtcgctgggcgtgcactccgtcgccgggagctcgtccgtcgagtggggcagcgccgccgggaagcaacccttgacatggcacaaggcctacttcaacgcgccgtccggcaacgcgccggtggccctggacatgagcagcatggggaagggccaggcgtgggtgaacggccaccacatcggccggtactggtcgtacaaggccaccggcggcagctgcggcggctgcagctacgcggggacgtacagcgagaccaagtgccagaccggctgcggcgacgtctcgcagaggtactaccatgtcccgcgctcctggctcaaccccagcggcaacctgctggtggtgctcgaggagttcggcggcgacctgtccggcgtcaagctcgtcaccaggacgacatga

SEQ ID NO: 19921 - protein, 725 aa, Sorghum bicolor
  misc_feature: Useful for making plants with altered cell wall content and/or composition
  misc_feature: Functional homolog of the protein sequence given in SEQ ID NO 13590
  misc_feature: Useful for making plants with altered carbohydrate content
  misc_feature: Functional homolog of the protein sequence given in SEQ ID NO 13588
  misc_feature: The sequence is a functional homolog of SEQ ID NO 2 in US patent 7084321
  misc_feature: Ceres ANNOT ID no. 8743088
  misc_feature (20)..(725): SWISSPROT Homolog: EC 3.2.1.23 Beta-galactosidase
  misc_feature (37)..(343): Pfam ID: Glyco_hydro_35 Pfam Description: Glycosyl hydrolases family 35
MMSGGVLFLALLAAAAALAIIVAPSPANAAVSYDHRAVVINGQRRILISGSIHYPRSTPEMWPDLLQKAKDGGLDVVQTYVFWNGHEPQQGQYYFGDRYDLVRFVKLAKQAGLFVHLRIGPYVCAEWNFGGFPVWLKYVPGVSFRTDNAPFKAAMQAFVEKIVSMMKAEGLFEWQGGPIILAQVENEYGPMESVMGGGAKPYANWAAKMAVATGAGVPWVMCKQDDAPDPVINTCNGFYCDYFSPNSNSKPTMWTEAWTGWFTAFGGAVPHRPVEDMAFAVARFIQKGGSFVNYYMYHGGTNFDRTSGGPFIATSYDYDAPIDEYGLLRQPKWGHLRDLHKAIKQAEPALVSGDPTIQTIGNYEKAYVYKSSSGACAAFLSNYHTNAAARVVFNGRRYDLPAWSISVLPDCRTAVFNTATVSSPSAPARMTPAGGFSWQSYSEATNSLDDRAFTKDGLVEQLSMTWDKSDYLWYTTYVNINSNEQFLKSGQWPQLTIYSAGHALQVFVNGQSYGAAYGGYDSPKLTYSGYVKMWQGSNKISILSAAVGLPNQGTHYEAWNVGVLGPVTLSGLNEGKRDLSNQKWTYQIGLHGESLGVHSVAGSSSVEWGSAAGKQPLTWHKAYFNAPSGNAPVALDMSSMGKGQAWVNGHHIGRYWSYKATGGSCGGCSYAGTYSETKCQTGCGDVSQRYYHVPRSWLNPSGNLLVVLEEFGGDLSGVKLVTRTT

SEQ ID NO: 19922 - DNA, 468 bp, Sorghum bicolor
  misc_feature: Ceres ANNOT ID no. 8743195
  misc_feature: Encodes the peptide sequence at SEQ ID NO 19923
atgccgacgggtaggctgagcggcaacatcacgcaggactgggagccggtggttctgcgccggacgaagccgaaggcggccgacctcaagtcggcgaaggcggtgaaccaggcgctgcggtcgggcgcggccgtggagacggtgcgcaagtcggcggcgggcacgaacaagcacttcgcgtccacgaccgtggcgcccgcgcgcaagctggacgagacgacggagccggcggcggtggagcgcgtggcggccgaggtgcgcgcggcgatccagaaggcgcgcgtggccaaagggtggagccaggccgagctggcgaagcgcatcaacgagcgcgcgcaggtggtgcaggagtacgagagcggcaaggcggcgccggcccaggccgtgctcgccaagatggagcgcgccctcgaggtcaagctccgtggcaagggcgtcggcgcgcccctggcggctgccagcaaatga

SEQ ID NO: 19923 - protein, 155 aa, Sorghum bicolor
  misc_feature: Useful for making plants with altered alkaloid content
  misc_feature: Useful for making plants with modulated drought sensitivity
  misc_feature: Useful for making plants with modulated heat sensitivity
  misc_feature: Functional homolog of the protein sequence given in SEQ ID NO 14752
  misc_feature: Useful for making plants with altered lignin content
  misc_feature: Functional homolog of the protein sequence given in SEQ ID NO 14753
  misc_feature: The sequence is a functional homolog of SEQ ID NO 1 in US patent 7238857
  misc_feature: Ceres ANNOT ID no. 8743195
  misc_feature (12)..(82): Pfam ID: MBF1 Pfam Description: Multiprotein bridging factor 1
  misc_feature (90)..(144): Pfam ID: HTH_3 Pfam Description: Helix-turn-helix
MPTGRLSGNITQDWEPVVLRRTKPKAADLKSAKAVNQALRSGAAVETVRKSAAGTNKHFASTTVAPARKLDETTEPAAVERVAAEVRAAIQKARVAKGWSQAELAKRINERAQVVQEYESGKAAPAQAVLAKMERALEVKLRGKGVGAPLAAASK

SEQ ID NO: 19924 - DNA, 1536 bp, Sorghum bicolor
  misc_feature: Ceres ANNOT ID no. 8743191
  misc_feature: Encodes the peptide sequence at SEQ ID NO 19925
atggggagcgagagcaatcgcggcggtgcggcggaccggatggtggcggaggaggaggagaagaagaagcgcggggggcggctgttcgagatgccggagatcaggttcaccaagctcttcatcaatggctgcttcgtcgacgccgcctcaggccggacgtttgagacgagggacccgcgcacgggggacgtgatagccaccgtcgccgaggctgacaaagacgacgtggactcggcagtgagggcagccagggacgccttcgaccacggcgaatggccacgcatgtctggatccgaacgggggcggatcatggcgaggttcgctgacctggtggagcagcacgcggacgagctggcggcgctggagagcctggacgccgggaagcacccggccatcaccaaggccgtcgacatcggcaacgcggcgggcagcctgcggtacttcgccggcgcggcggacaagatccacgggctacacaccctccgcgagcccctgggcgtcgccgggatcatcatcccctggaacttcccctccaccatgttcgccatcaaggtcgccccggccctggccgccggctgcgccatggtcgtcaagcccgccgagcagacgccgctcagcgcgctcttcttcgcccagctcgccaagcgggctggagtccccgatggcgtcgtcaatgtcgtgccaggcttcggtccgacggcgggagctgcactcgcgtctcacatggacgttgacatggtgactttcactggatccacagaggttgggcgcctcataatgaaggcctccgcggagagcaacctgaagccggtttacctggagctcggcggcaagtcgccgctcatcatcttcgacgacgcggacgtcgacatggccgtcgagctcgccgtcagcgctaacttcttcaacaagggagaagcctgcgtggcggcgagccgtgtgtacgtgcaggaaggcatgtacagcagattcgaggagaagttggcagagaggatgaagagctgggtggtgggagaccctttcagtgacgctcgtgccaaccagggccctcaggtggacaaggcgcagtatgagagggtgctcagctacatcgaccatggcaagagagaaggggccactcttctgaccggaggaggaagaccagccgcctgtggtcacaaaggctactacattgagcccacggttttcaccaacgtcacggaggacatggtcatagccaaggaggagatcttcggccctgtcatgtgcctgatcaagttcaagacggtggaggaggcgatctggagggcgaacgacagtcggtacgggctgggcgccggggtggtgacgcgagacgtggacgtggcgaaccgggtggtgaggtcggtgcgcgccggggtggtgtgggtcaactgctacttcgccatgggcagcgactgccccttcggcggacgcaagatgagcgggttcggcaaggacgaaggcatgcacgcgctcgacaagtacctggccatcaagtccgtcgtcaccccgctgcgtgcctcgccatggatgtga

SEQ ID NO: 19925 - protein, 511 aa, Sorghum bicolor
  misc_feature: Useful for making plants with altered carbohydrate content
  misc_feature: Functional homolog of the protein sequence given in SEQ ID NO 13953
  misc_feature: Ceres ANNOT ID no. 8743191
  misc_feature: Up-regulated in root tissues in response to salicylic acid treatment
  misc_feature (25)..(511): SWISSPROT Homolog: EC 1.2.1.3 Aldehyde dehydrogenase (NAD(+))
  misc_feature (45)..(501): Pfam ID: Aldedh Pfam Description: Aldehyde dehydrogenase family
MGSESNRGGAADRMVAEEEEKKKRGGRLFEMPEIRFTKLFINGCFVDAASGRTFETRDPRTGDVIATVAEADKDDVDSAVRAARDAFDHGEWPRMSGSERGRIMARFADLVEQHADELAALESLDAGKHPAITKAVDIGNAAGSLRYFAGAADKIHGLHTLREPLGVAGIIIPWNFPSTMFAIKVAPALAAGCAMVVKPAEQTPLSALFFAQLAKRAGVPDGVVNVVPGFGPTAGAALASHMDVDMVTFTGSTEVGRLIMKASAESNLKPVYLELGGKSPLIIFDDADVDMAVELAVSANFFNKGEACVAASRVYVQEGMYSRFEEKLAERMKSWVVGDPFSDARANQGPQVDKAQYERVLSYIDHGKREGATLLTGGGRPAACGHKGYYIEPTVFTNVTEDMVIAKEEIFGPVMCLIKFKTVEEAIWRANDSRYGLGAGVVTRDVDVANRVVRSVRAGVVWVNCYFAMGSDCPFGGRKMSGFGKDEGMHALDKYLAIKSVVTPLRASPWM

SEQ ID NO: 19926 - DNA, 1344 bp, Sorghum bicolor
  misc_feature: Ceres ANNOT ID no. 8743205
  misc_feature: Up-regulated in root tissues in response to salicylic acid treatment
  misc_feature: Encodes the peptide sequence at SEQ ID NO 19927
atggcgacaatacaggagcacttcctgtttgtgaccgatccgatgcagagccacatcgacccggcgcggcgcctggcagtgcgcgtcgcggcggcaatgcccaacgcgcgcgtcaccttctccaccgccgtcagcggccaccgcgacatgttcccacacctgacgtcccccgacggcgaggtcgtccagggcgtcgtctcctacatcccctactcggacggcttcgacggcgggttcaagttcaacccggcggaggcgcacggcgtcggcgccggcgcgtacagggagcgcgcgcgcgaggtcgggtccgagacgctcgcctccgtcgtcgcccgcctcgccaggcgggggcaccccgtgacgcgcgtcgtgtacaccgcgctcgtcggttgggtccccgccgtcgcgcgcgcgcacggcgtccccgcggcgctgtactgggtgaagccggccacggtgttcgccgtgtactaccactacttccacggccacggcgcgctcctggactcctcctgctgcgcgagcgacgtcgcggaccctcacgccgccgccgtcgtccgcctgccgggcctcccgccgctgaaggccgacgcgctgccgtccttggcgtccatggcctcgccggggagccgcaactacctgacgctcgacatgctgcgcgacatcttcgtggcgctggacgagcacacgcccacggtgctcgtggacacgttcgacgcgctggagcccgaggcgctgcgcgcggtgccgcggttcaacctcgtcgccgtgggtccggtggtggtggaggagccgtgcaggccatgcgtggagctgttccagcccaacgacgccaccgcgtacgtggactggctggacacgaagccggcgcgctccgtggtgttcgtgtccttgggcagcgtcctctcgttgagcaagcggcaggacgaggagttgaggcgcggcctggaggccaccggccggccgtacctcctgtgcaaccagacgaaggtgctgtcgcacggcgccgtcgggtgcttcgtcacgcactgccggtgggactcgacgctggagagcatcacgggcggcgtgccgatggtggccgtgccgaggtgggcggaccagccgaccgtggcagcactagtggaggcgtccgcgggcgtgggcgtgcgtgcgtgggtggacggcgacggggtggtggggcgtggtgagctccggcggtgcgtcgagatggtcatgggaagcacggacagtgcttcggcagtgagggcacgagcagagtgctggggccaacgcgccaaggaggcggccgccgtcggggggacgtcgcagaggaatctccgtgcgtttgcgtccgggctgtga

SEQ ID NO: 19927 - protein, 447 aa, Sorghum bicolor
  misc_feature: Useful for making plants with altered carbohydrate content
  misc_feature: Functional homolog of the protein sequence given in SEQ ID NO 14682
  misc_feature: Ceres ANNOT ID no. 8743205
  misc_feature (318)..(443): SWISSPROT Homolog: EC 2.4.1.121 Indole-3-acetate beta-glucosyltransferase
MATIQEHFLFVTDPMQSHIDPARRLAVRVAAAMPNARVTFSTAVSGHRDMFPHLTSPDGEVVQGVVSYIPYSDGFDGGFKFNPAEAHGVGAGAYRERAREVGSETLASVVARLARRGHPVTRVVYTALVGWVPAVARAHGVPAALYWVKPATVFAVYYHYFHGHGALLDSSCCASDVADPHAAAVVRLPGLPPLKADALPSLASMASPGSRNYLTLDMLRDIFVALDEHTPTVLVDTFDALEPEALRAVPRFNLVAVGPVVVEEPCRPCVELFQPNDATAYVDWLDTKPARSVVFVSLGSVLSLSKRQDEELRRGLEATGRPYLLCNQTKVLSHGAVGCFVTHCRWDSTLESITGGVPMVAVPRWADQPTVAALVEASAGVGVRAWVDGDGVVGRGELRRCVEMVMGSTDSASAVRARAECWGQRAKEAAAVGGTSQRNLRAFASGL

SEQ ID NO: 19928 - DNA, 1455 bp, Sorghum bicolor
  misc_feature: Ceres ANNOT ID no. 8743213
  misc_feature: Encodes the peptide sequence at SEQ ID NO 19929
atgaaggccgggcctccgccgcacgttgccatgctagcgacgccggggatgggtcacctgatcccgctggcggagctggcgaagcgcctggcgtcgcggcacggcgcgacggcgacgctcatcaccttcgcgtccacggcgtcggcaacgcagcgcgcgctcctggcctcgctgccgcccgcggtgtcgtcgctctccctcccgcccgtcgacctctccgacctgccacggggcgccgccatcgagacgcgcatgtccgaggagtgcgcgcggtcgctccccgcgctcacgcgcctcctctccgagctcggggagaccatggccaccgccaccggcacccgcctcgtcgcgttcgtcgccgaccagttcgggatggactcattcgacgccgcgcgcgacgccggcgtgcggacgcgctgcctcttcatacccatgaacctccacgcgctctcgctcgtcctcgacctcccggacctcgcggcgtccgtccccggcgagttccgggacctcgccgagccggtgcgcctgcccggctgcgtgcccatcccggggtccgacgtaccctcgccgctgcaggacaggtccaacccttcgttctcggtgatggtgcaccttgccaagcgctaccgtgaagctgatgccatcctcgtcaactccttcgacgccgtcgagcccgaggtcgccgaggtgcttcgccagccagagtccggccggccacctgtgtaccctatcggtccactcatacggcagttcgtcggaagcgaagctgatggcgccggagcgcttccaccgtcaccgcgtgcggcgtgcctggagtggctcgaccggcagccggccaggtcggtcatcttcgtctcgttcgggtccggcggcgcgctgccaaaggaggagatgcacgagctcgcgctcgggctggagctcagcgggcagcggttcctctgggtggtgcgcagccccagcgacgagggcacgctcagcgacaactactacaacgcagagagcaagaaggaccccttcgtctacctcccggaagggttcctggagaggaccaaggacgtgggtctcctggtgccgtcgtgggcaccgcagacacaggtgcttgcacacagggccaccggaggtttcctgacgcactgcgggtggaactcgacgctagagagcctggtgcacggcgtgccgatggtggcctggccgttgttcgccgagcagcggcttaacgcggtgatgctggcggagggggtaggagcggcgatacggttgccggagaggaaggataaggagaccatcgcagcggtggtgagggagctgatggcaggggaagggaaaggtgccatggtgcgggtgaaggtggcggagctgcagaaggctgcggcagagggactccgtgacggtggcgccgccacggcggcgcttgacgaggtggtggagaagtgggaagctgatgaagcgaactag

SEQ ID NO: 19929 - protein, 484 aa, Sorghum bicolor
  misc_feature: Useful for making plants with altered carbohydrate content
  misc_feature: Functional homolog of the protein sequence given in SEQ ID NO 14172
  misc_feature: Ceres ANNOT ID no. 8743213
  misc_feature (7)..(479): SWISSPROT Homolog: EC 2.4.1.218 Hydroquinone glucosyltransferase
  misc_feature (8)..(482): Pfam ID: UDPGT Pfam Description: UDP-glucoronosyl and UDP-glucosyl transferase
MKAGPPPHVAMLATPGMGHLIPLAELAKRLASRHGATATLITFASTASATQRALLASLPPAVSSLSLPPVDLSDLPRGAAIETRMSEECARSLPALTRLLSELGETMATATGTRLVAFVADQFGMDSFDAARDAGVRTRCLFIPMNLHALSLVLDLPDLAASVPGEFRDLAEPVRLPGCVPIPGSDVPSPLQDRSNPSFSVMVHLAKRYREADAILVNSFDAVEPEVAEVLRQPESGRPPVYPIGPLIRQFVGSEADGAGALPPSPRAACLEWLDRQPARSVIFVSFGSGGALPKEEMHELALGLELSGQRFLWVVRSPSDEGTLSDNYYNAESKKDPFVYLPEGFLERTKDVGLLVPSWAPQTQVLAHRATGGFLTHCGWNSTLESLVHGVPMVAWPLFAEQRLNAVMLAEGVGAAIRLPERKDKETIAAVVRELMAGEGKGAMVRVKVAELQKAAAEGLRDGGAATAALDEVVEKWEADEAN

SEQ ID NO: 19930 - DNA, 1458 bp, Sorghum bicolor
  misc_feature: Ceres ANNOT ID no. 8743206
  misc_feature: Encodes the peptide sequence at SEQ ID NO 19931
atggagaacccacctcaccctcagcagcagcatttcctgttcgtcactaacccgatgcagggccacatcaacccaacccgccgcctcgccgcccgcgtcatggcgtccaacccggacgcgcgcgtcaccttctgcaccgccgtctccgggcaccgccgcatcttcccgtcactggcctcccccgacgaggagttcgtggacgccgcgggcgtgctgcacgctccctactccgacggctacgacgacgggttcaacccggccgtgcacgacgccggcacgtacagggcccgcgccaccgccgcggggcgcgagacgctgtccgccgtcgtggcgcgcctagccgcgcggggacggcccgcgacgcgcgtggtgtacacgttcctcgtgccgtgggtggccgacgtcgcgcgcgcgcacggcgtgcccgcggcgctcttctggatccagccggccgccgtgttcgccgtctactaccactacttccacggccacggcgcggcgctcgccgcgtgcgcgaacggcctcgacccggacgccacggtccgcctgccggggctgccgccgctcaagccccgcgcgctcccgtcggtcgtgtccgtcacctcgccggagcacagacaccacgtggtcctcgacatggtgcgcgagctcttcctgtccctcgacgagcacaggcccagggtgctcgtcaacacgttcgacgcgctggagcctgacgcgctccgcgcggtgccgcagctcgaggtcgacgccgtcgggcccgtggtgccggtgccggacgatgatgtgtctccggcatcacgcgcggacctgcagttgcactgccaccgcgacgcgaagccgtacacggagtggctggagacgaagccggcgcggtccgtggtgtacgtgtcgttcgggagcatcctcccggtgagcaagcggcaggaggaggagatgaggaaaggcctggaggcgaccggccgtccgtacctgtgggtggcgcggaaggccggcggcgacggtggtgcgagcccggcggacagcagcggcggcgccggcgcgcaggggatggtggtcgagtggtgcgaccaggtgcgcgtgctgtcgcacccggcggtggggtgcttcgtgacgcactgcgggtggaactcgacgctggagagcgtgacgcggggcgtgccgatggtggccgtgccgcagtggacggaccagcctacggtggcgtggctggtggacgcgtgcatgggcgccggcgtgcgcgcgcgcgtggacggcgaaggggtggtggagcgaggcgaggtgcagcggtgcgtggagatggtcatgggcgacgacggtgaggccgcggcggcggccatccgggcgcaggctggtcgttggagagaagtgtcgcgtcaggcggtggcccgcggcgggacgtcggagacgaatctccgagcgttcgcgttgggtacggctgctgtgaccgatgcctga

SEQ ID NO: 19931 - protein, 485 aa, Sorghum bicolor
  misc_feature: Useful for making plants with altered carbohydrate content
  misc_feature: Functional homolog of the protein sequence given in SEQ ID NO 14682
  misc_feature: Ceres ANNOT ID no. 8743206
  misc_feature (11)..(475): SWISSPROT Homolog: EC 2.4.1.121 Indole-3-acetate beta-glucosyltransferase
  misc_feature (11)..(469): Pfam ID: UDPGT Pfam Description: UDP-glucoronosyl and UDP-glucosyl transferase
MENPPHPQQQHFLFVTNPMQGHINPTRRLAARVMASNPDARVTFCTAVSGHRRIFPSLASPDEEFVDAAGVLHAPYSDGYDDGFNPAVHDAGTYRARATAAGRETLSAVVARLAARGRPATRVVYTFLVPWVADVARAHGVPAALFWIQPAAVFAVYYHYFHGHGAALAACANGLDPDATVRLPGLPPLKPRALPSVVSVTSPEHRHHVVLDMVRELFLSLDEHRPRVLVNTFDALEPDALRAVPQLEVDAVGPVVPVPDDDVSPASRADLQLHCHRDAKPYTEWLETKPARSVVYVSFGSILPVSKRQEEEMRKGLEATGRPYLWVARKAGGDGGASPADSSGGAGAQGMVVEWCDQVRVLSHPAVGCFVTHCGWNSTLESVTRGVPMVAVPQWTDQPTVAWLVDACMGAGVRARVDGEGVVERGEVQRCVEMVMGDDGEAAAAAIRAQAGRWREVSRQAVARGGTSETNLRAFALGTAAVTDA

SEQ ID NO: 19932 - DNA, 150 bp, Sorghum bicolor
  misc_feature: Ceres ANNOT ID no. 8743243
  misc_feature: Encodes the peptide sequence at SEQ ID NO 19933
atggcccaacagagtaggcaaagcaaagacccaatttgcatcggcgtggagtggaaacgtgtgattttgtgtttgtatgttgatgatatactaatctttggacccgttcttaatgtgattaaggaggtgaagtacttacgacaattttga

SEQ ID NO: 19933 - protein, 49 aa, Sorghum bicolor
  misc_feature: The sequence is a functional homolog of SEQ ID NO 1433 in the 10/374,780 US patent application
  misc_feature: The sequence is a functional homolog of SEQ ID NO 1519 in the 10/412,699 US patent application
  misc_feature: Ceres ANNOT ID no. 8743243
MAQQSRQSKDPICIGVEWKRVILCLYVDDILIFGPVLNVIKEVKYLRQF

SEQ ID NO: 19934 - DNA, 651 bp, Sorghum bicolor
  misc_feature: Ceres ANNOT ID no. 8743255
  misc_feature: Encodes the peptide sequence at SEQ ID NO 19935
atgccgacgagctcgaccaactccgccgcggcggcttcccctgccgtgtcaggcctcgactacgacgacaccgcgctcaccctcgccctcccgggctcctcctcctccgccgccgacccctccgccgccgccgaccgcaagcgcgcccacgccgaccacgacaagccgccctccccaaaggcgcgggccgtggggtggccgccggtgcgcgcgtaccggcgcaacgcgctgcgcgacgagcaggccgccaagctcgtgaaggtggccgtggacggcgcgccgtacctgcgcaaggtggacctcgcggcgcacgacgggtacgcggcgctgctccgcgcgctccacggcatgttcgcctcctgcctcggagccgacggggccgggagcctcgtcgacgccgccaccggcgccgagtacgtgcccacctacgaggacaaggacggcgactggatgctcgtcggagacgtccccttcaagatgtttgtggactcgtgcaagaggatccgcctcatgaagagctccgaggccggcagcctatgccacacaccccatggaaaaacttcatcagtttcaagtgccgctactgtcggccggacggtttcgtttttggacgccggcgagaaggcggcgctagcacttcgtcagctatag

SEQ ID NO: 19935 - protein, 216 aa, Sorghum bicolor
  misc_feature: The sequence is a functional homolog of SEQ ID NO 736 in the 10/374,780 US patent application
  misc_feature: The sequence is a functional homolog of SEQ ID NO 738 in the 10/374,780 US patent application
  misc_feature: The sequence is a functional homolog of SEQ ID NO 739 in the 10/374,780 US patent application
  misc_feature: The sequence is a functional homolog of SEQ ID NO 648 in the 11/479,226 US patent application
  misc_feature: The sequence is a functional homolog of SEQ ID NO 636 in the 11/479,226 US patent application
  misc_feature: The sequence is a functional homolog of SEQ ID NO 652 in the 11/479,226 US patent application
  misc_feature: The sequence is a functional homolog of SEQ ID NO 656 in the 11/479,226 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
  misc_feature: Ceres ANNOT ID no. 8743255
  misc_feature (19)..(183): Pfam ID: AUX_IAA Pfam Description: AUX/IAA family
MPTSSTNSAAAASPAVSGLDYDDTALTLALPGSSSSAADPSAAADRKRAHADHDKPPSPKARAVGWPPVRAYRRNALRDEQAAKLVKVAVDGAPYLRKVDLAAHDGYAALLRALHGMFASCLGADGAGSLVDAATGAEYVPTYEDKDGDWMLVGDVPFKMFVDSCKRIRLMKSSEAGSLCHTPHGKTSSVSSAATVGRTVSFLDAGEKAALALRQL

SEQ ID NO: 19936 - DNA, 2907 bp, Sorghum bicolor
  misc_feature: Ceres ANNOT ID no. 8743260
  misc_feature: Encodes the peptide sequence at SEQ ID NO 19937
atggcgccgccgccgccgccgccaccgccgcaggcgcaggcgcggcaccaccaccaccaccaccaggggccagccaacaagggcggcggccacgcggagcggacgaagcagccgctgcagagcagcgtgacgcagcccaaggcggagccaccggcggtggtggcggcggccgtgctgccggagggaggcaagcggtgcggaggaggaggaggagggaggcgccgcggcgggcgcggccgggccaaggcgccgccgggtgagtctcgtgctgcgctggcggtagcggtagcgccagcgccggcgcaggcgcctccgccgcgcacggtcattgggccgcccgtgccgagcaaggggctgtcgttctgccgccggccggggttcgggacggtgggtgcgcgctgcgtcgtcaaggctaaccacttcctcgccgagctcccggacaaggacctcacccagtatgatgtgaagatcacgccggaggtgagctcgcggaccgtgaaccgggccataatggcggagctggtccgcctctaccgcgcgtccgacctcggaatgcgactcccggcctacgacggccgcaagaatctctacaccgcgggcaccctcccgttcgactctcgcgagttcgtcgtgcgcctcaccgatgaggacgacggcaccggcgtgccgcctcgggagagggagtacagggtcgccatcaagttcgccgcgcgcgccgacctccaccacctcaggcagttcatcgccgggcggcaggcggacgcgccccaggaggccctacaggtactcgacatcgtgctccgcgagctcgccaaccagaggtacgtgtccatagggcggtccttctactcgccggacatcaggaggccgcagcggctaggcgacggcctgcagtcgtggtgtgggttctaccagagcatccggccgacacagatgggattgtcgcttaacatcgacatgtcgtccacggcgttcattgaacccctgccggtgatcgagttcgtggcccagatattaggaaaggatgtcatatcaaggccattatccgatgctaaccgaatcaagatcaagaaggcattgcgaggagtaaaagttgaggtcactcaccgggggaatgtaaggcgcaagtatcgcatttctgggttgacaactttcccaattgatgagcaaatgaatatgaaatctgtcgtggagtacttcaaggaaatgtatggtttcaccattcagcatcctcatcttccctgccttcaggttgggaaccaaaagaaggcgaactatctaccgatggaggcatgcaagatcgttgaaggccagagatacacgaagaggctgaatgaaaaacagatcacatcattgctgaaggttacatgccaaaggcctagagaacaggagatggatattctacagacagttcatcaaaatggatatgagcaagatccatatgcaaaggaatttgggatcaacattagtgagaagctaacctctgttgaagctcgagtccttcctgcaccttggttgaagtaccatgacactggaaaagagaaagagtgcttaccacaggttggtcaatggaacatggtaaacaagaaagtgataaatggatgcaaggtgagccattgggcgtgtataaacttctcaaggagtgttccagaaaacacagctaggggattttgccaggaattggcgcaaatgtgtcagatttcgggcatggaatttaacagtgagccagtgatgccattatattcagctagaccagaccaagtagtgaaggcacttaaaaatgtgtataatattgcattgaacaaactcaagggtaaagaacttgaacttcttttggctatcctccctgacaacaatggtccgttatatggtgacatcaaacgtatttgtgaaactgatttgggattgataacacaatgttgcttgaccaaacatgtttttaagatcagcaagcagtacttggcaaatgtctcactgaaaattaatgttaagatgggaggaagaaatactgtgctcctggatgcaataagttggaggattcctttggtcagtgacataccaactattatatttggtgcggatgtaacacatcctgaaactggggaggactcaagtccatcaattgctgccgttgttgcttctcaagattggccagaagttacaaagtatgctggattggtttgtgctcaggcacaccggcaagagctcattcaggacctttacaaaacatggcatgatcctcagagaggcactgtaacaggcggcatgatcagggagctcttaatatccttcaggaaggccactgggcagaagccattgagaataatattctacagggacggtgttagtgaaggccagttctaccaagttctcctttacgagttagatgccatccgtaaggcatgtgcgtccctagaaccaaattaccagcctcctgtaacatttgtggtagttcaaaaacgtcatcatacaagactttttgcaaataatcacaaagacagaagtagcatggacaagagtggaaatattttgccaggaaccgttgttgattctaagatatgccacccaacggagtttgatttctacctctgcagtcatgctggaattcagggaacaagtaggcctgctcactaccatgtcctctgggatgagaacaatttcacagcagacgaaatgcagacattgacaaacaacctttgctacacttatgcccggtgcacacgctcggtttctgttgtccctcctgcatactacgcacacctggcagcattccgggctcggttctacatggaaccagagatgtcagagaaccagacgtcaaagagctccaatagcacgaacggagtctcggtgaagcccctgcctgctgtgaaggagaaggtgaaaagggtgatgttctactgctga

SEQ ID NO: 19937 - protein, 968 aa, Sorghum bicolor
  misc_feature: The sequence is a functional homolog of SEQ ID NO 152 in the 10/225,066 US patent application
  misc_feature: The sequence is a functional homolog of SEQ ID NO 238 in the 10/374,780 US patent application
  misc_feature: The sequence is a functional homolog of SEQ ID NO 2086 in the 10/374,780 US patent application
  misc_feature: Ceres ANNOT ID no. 8743260
  misc_feature (610)..(931): Pfam ID: Piwi Pfam Description: Piwi domain
  misc_feature (329)..(459): Pfam ID: PAZ Pfam Description: PAZ domain
MAPPPPPPPPQAQARHHHHHHQGPANKGGGHAERTKQPLQSSVTQPKAEPPAVVAAAVLPEGGKRCGGGGGGRRRGGRGRAKAPPGESRAALAVAVAPAPAQAPPPRTVIGPPVPSKGLSFCRRPGFGTVGARCVVKANHFLAELPDKDLTQYDVKITPEVSSRTVNRAIMAELVRLYRASDLGMRLPAYDGRKNLYTAGTLPFDSREFVVRLTDEDDGTGVPPREREYRVAIKFAARADLHHLRQFIAGRQADAPQEALQVLDIVLRELANQRYVSIGRSFYSPDIRRPQRLGDGLQSWCGFYQSIRPTQMGLSLNIDMSSTAFIEPLPVIEFVAQILGKDVISRPLSDANRIKIKKALRGVKVEVTHRGNVRRKYRISGLTTFPIDEQMNMKSVVEYFKEMYGFTIQHPHLPCLQVGNQKKANYLPMEACKIVEGQRYTKRLNEKQITSLLKVTCQRPREQEMDILQTVHQNGYEQDPYAKEFGINISEKLTSVEARVLPAPWLKYHDTGKEKECLPQVGQWNMVNKKVINGCKVSHWACINFSRSVPENTARGFCQELAQMCQISGMEFNSEPVMPLYSARPDQVVKALKNVYNIALNKLKGKELELLLAILPDNNGPLYGDIKRICETDLGLITQCCLTKHVFKISKQYLANVSLKINVKMGGRNTVLLDAISWRIPLVSDIPTIIFGADVTHPETGEDSSPSIAAVVASQDWPEVTKYAGLVCAQAHRQELIQDLYKTWHDPQRGTVTGGMIRELLISFRKATGQKPLRIIFYRDGVSEGQFYQVLLYELDAIRKACASLEPNYQPPVTFVVVQKRHHTRLFANNHKDRSSMDKSGNILPGTVVDSKICHPTEFDFYLCSHAGIQGTSRPAHYHVLWDENNFTADEMQTLTNNLCYTYARCTRSVSVVPPAYYAHLAAFRARFYMEPEMSENQTSKSSNSTNGVSVKPLPAVKEKVKRVMFYC

SEQ ID NO: 19938 - DNA, 429 bp, Sorghum bicolor
  misc_feature: Ceres ANNOT ID no. 8743302
  misc_feature: Encodes the peptide sequence at SEQ ID NO 19939
atggagagcgacgaggagatcaggagggtgccggaggtcgggctggagctggccggcccgtcgacgtccggcagggagacgactgcggctgcgggcacggcggcgggcgctgccgggacgtcgtccgcgtcgcaggcggccaccagcgccgcccgccgccgcggccgtagccccgccgacaaggagcaccggcgcctcaaaaggttgcttcggaaccgggtgtcggcgcagcaagcacgggagaggaagaaggcgtacctgagcgagctggaggtgagggtcaaggacctggagaagaggaactcagagctggaggagaggctgtccacgctgcagaacgagaaccaaatgcttagacagatactgaagaacaccactgtaaacagaagaggcccaggtggcagcagtgctggtggagatagccaatag

SEQ ID NO: 19939 - protein, 142 aa, Sorghum bicolor
  misc_feature: The sequence is a functional homolog of SEQ ID NO 206 in the 10/225,066 US patent application
  misc_feature: The sequence is a functional homolog of SEQ ID NO 2356 in the 10/374,780 US patent application
  misc_feature: The sequence is a functional homolog of SEQ ID NO 827 in the 11/479,226 US patent application
  misc_feature: Useful for making plants with modulated light quality sensitivity
  misc_feature: Ceres ANNOT ID no. 8743302
  misc_feature (60)..(123): Pfam ID: bZIP_1 Pfam Description: bZIP transcription factor
MESDEEIRRVPEVGLELAGPSTSGRETTAAAGTAAGAAGTSSASQAATSAARRRGRSPADKEHRRLKRLLRNRVSAQQARERKKAYLSELEVRVKDLEKRNSELEERLSTLQNENQMLRQILKNTTVNRRGPGGSSAGGDSQ

SEQ ID NO: 19940 - DNA, 390 bp, Sorghum bicolor
  misc_feature: Ceres ANNOT ID no. 8743313
  misc_feature: Encodes the peptide sequence at SEQ ID NO 19941
atggaggaggtgacggagggagtgaacaatctggcgattacggagccgcacaagaagaacaggatccaggtctccaacaccaagaagccgctattcttttacgtcaacctcgccaagaggtacatgcagcagcacgaggaggtggagctctcggcccttggcatggccattgccactgtggttactgttgctgaaattctgaaaaataatgggctcgctgttgaaaagaagatcatgacatccacagttgatgtcaaggatgatacaagggcccgccctattcagaaagccaagatcgaaatagtgctgggcaagacggataaatttgatgagctgatggcggcagctgatgcggagagggaagctgctgaggcagaggaacagagctaa

SEQ ID NO: 19941 - protein, 129 aa, Sorghum bicolor
  misc_feature: Useful for making plants with modulated nitrogen use efficiency
  misc_feature: Functional homolog of the protein sequence given in SEQ ID NO 13593
  misc_feature: Ceres ANNOT ID no. 8743313
  misc_feature (18)..(87): Pfam ID: Alba Pfam Description: Alba
MEEVTEGVNNLAITEPHKKNRIQVSNTKKPLFFYVNLAKRYMQQHEEVELSALGMAIATVVTVAEILKNNGLAVEKKIMTSTVDVKDDTRARPIQKAKIEIVLGKTDKFDELMAAADAEREAAEAEEQS

SEQ ID NO: 19942 - DNA, 708 bp, Sorghum bicolor
  misc_feature: Ceres ANNOT ID no. 8743335
  misc_feature: Encodes the peptide sequence at SEQ ID NO 19943
atggtgcaatcaaagaagaagttccgcggcgtcaggcagcgccactggggctcctgggtctccgagatcaggcacccgctgcttaagaggagggtgtggctgggcaccttcgagacggcagaggaggcggcgcgggcgtacgacgaggccgccgtcctcatgagcggccgcaacgccaagaccaacttccccgtcccaaggaccgccaccggggagctggcccccgtgccggccgcgcgggacgcacgtggcggcggcggctcgtcctccgcggcagcagcgcccggcggcggcaccagcaacctgtcgcagatcctcagcgccaagctccgcaagtgctgcaagacgccgtcgccgtcgctcacctgcctccgcctcgacccggagaagtcccacattggcgtctggcagaagcgcgcgggcgcgcgcgccgactccagctgggtcatgaccgtccagctcaacaaggacgtgccgccgccggcgtcctcctccggcgaggagccggtgcccagcgacggaggcgcagcggccaccacgcccacgtccacttccacgtcgtccacggtcacgacgaccggctcgcctccacctgcgatgatgatggacgacgaggagaggattgcgctgcagatgatcgaggagctgctgggcagctcgcactcacatgggatgttccagggtgcagcgggcagcatcgtcatctga

SEQ ID NO: 19943 - protein, 235 aa, Sorghum bicolor
  misc_feature: The sequence is a functional homolog of SEQ ID NO 1302 in the 10/374,780 US patent application
  misc_feature: The sequence is a functional homolog of SEQ ID NO 1447 in the 10/412,699 US patent application
  misc_feature: The sequence is a functional homolog of SEQ ID NO 150 in the 11/375,241 US patent application
  misc_feature: The sequence is a functional homolog of SEQ ID NO 908 in the 10/666,642 US patent application
  misc_feature: Useful for making plants with modulated biomass
  misc_feature: Functional homolog of the protein sequence given in SEQ ID NO 14518
  misc_feature: The sequence is a functional homolog of SEQ ID NO 1444 in the 10/666,642 US patent application
  misc_feature: The sequence is a functional homolog of SEQ ID NO 146 in the 11/375,241 US patent application
  misc_feature: The sequence is a functional homolog of SEQ ID NO 1860 in the 10/412,699 US patent application
  misc_feature: The sequence is a functional homolog of SEQ ID NO 2106 in the 10/374,780 US patent application
  misc_feature: The sequence is a functional homolog of SEQ ID NO 272 in the 10/714,887 US patent application
  misc_feature: The sequence is a functional homolog of SEQ ID NO 272 in the 11/435,388 US patent application
  misc_feature: Ceres ANNOT ID no. 8743335
  misc_feature (6)..(57): Pfam ID: AP2 Pfam Description: AP2 domain
MVQSKKKFRGVRQRHWGSWVSEIRHPLLKRRVWLGTFETAEEAARAYDEAAVLMSGRNAKTNFPVPRTATGELAPVPAARDARGGGGSSSAAAAPGGGTSNLSQILSAKLRKCCKTPSPSLTCLRLDPEKSHIGVWQKRAGARADSSWVMTVQLNKDVPPPASSSGEEPVPSDGGAAATTPTSTSTSSTVTTTGSPPPAMMMDDEERIALQMIEELLGSSHSHGMFQGAAGSIVI

SEQ ID NO: 19944 - DNA, 1437 bp, Sorghum bicolor
  misc_feature: Ceres ANNOT ID no. 8743361
  misc_feature: Encodes the peptide sequence at SEQ ID NO 19945
atggcgaaattttgcccaaataatggtgccatacacgtaaccggcacaagcggcggcggcgtggggagagcagccgccgtgcccggccttggaggggcccagtccgtctatggaacttgctgcctcggtgccacgccccggcccggaaccgaagtgctcagcaaggcgctgcttgcctgcccctctcacgctgctggtgtccattgtggcagtctcctgtttgattcctgctcctcgctgatcgatttctggactgcgatgatggtgccgcgaacggtgctgctcctttgctgctgcctcctggcgttcttgccacttggtccgctagccgttgaagcttttgtagggggttatgggataaactacgggagaatagcaaacaacatcccttcccctgataaagtggtggagctcctgaggagagcaaagataaggaatgttaagatatatgacgccgaccacagcgttctcgatgcgttcaaagggtctgggatcaacctggtcattgcaatccccaatgagcttgtcaaggatatggctgcaaacacaagtcgttcgatggactggctaaatcaaaatgtgcagccttatctccctcagactcgcatcgttgggatcactgtgggaaatgaggtgctgggaggccaggatcaaagcttgtatcagccacttgttgatgctgtgaagaacgtgtatgatggactcaagaggctccacttggagagtaaaattgagcttttcacacctcattcggaagctgtttttgctacttcttatccaccctccgcatgtgtgttcaaggaagaactcatggcatacatgaaacctctcctcgacttctttgcaatgattggctcacctttttatgtgaacgcatacccctttttggcttacataagcgatccagaacatatcgatatcaattatgctctctttaaacccaacaagggaatagttgacccgaatactagcctgcactatgacaacatgtttgatgctcagatagatgcagcttatgctgctctacatgctgctggttatgatgacatggaggttcgggtggcagagactggctgggcttctagtggggatcaaaatgaagcaggagcttcatctgagaatgcaaggacatataatttcaatcttcgtaaacggctatttctgaggacgggaactcctctgaagccaaagagaccagtcaaagcatatatatttgccttgtttaatgagaatcagaaacctggagctggctctgagaggcattatgggctgttccttcctgatggaaggatttcatatgacattggtgtctcaggtctactaccttcttctgcatcctcatccatgctgttcattaagaaggttcgagctgggggttggattttacactattgggctacagttcttttatgtattttcattcttttggggccatag

SEQ ID NO: 19945 - protein, 478 aa, Sorghum bicolor
  misc_feature: Useful for making plants with altered carbohydrate content
  misc_feature: Functional homolog of the protein sequence given in SEQ ID NO 14514
  misc_feature: Useful for making plants with altered cell wall content and/or composition
  misc_feature: Functional homolog of the protein sequence given in SEQ ID NO 14515
  misc_feature: Ceres ANNOT ID no. 8743361
  misc_feature (111)..(435): SWISSPROT Homolog: EC 3.2.1.39 Glucan endo-1,3-beta-D-glucosidase
  misc_feature (118)..(437): Pfam ID: Glyco_hydro_17 Pfam Description: Glycosyl hydrolases family 17
MAKFCPNNGAIHVTGTSGGGVGRAAAVPGLGGAQSVYGTCCLGATPRPGTEVLSKALLACPSHAAGVHCGSLLFDSCSSLIDFWTAMMVPRTVLLLCCCLLAFLPLGPLAVEAFVGGYGINYGRIANNIPSPDKVVELLRRAKIRNVKIYDADHSVLDAFKGSGINLVIAIPNELVKDMAANTSRSMDWLNQNVQPYLPQTRIVGITVGNEVLGGQDQSLYQPLVDAVKNVYDGLKRLHLESKIELFTPHSEAVFATSYPPSACVFKEELMAYMKPLLDFFAMIGSPFYVNAYPFLAYISDPEHIDINYALFKPNKGIVDPNTSLHYDNMFDAQIDAAYAALHAAGYDDMEVRVAETGWASSGDQNEAGASSENARTYNFNLRKRLFLRTGTPLKPKRPVKAYIFALFNENQKPGAGSERHYGLFLPDGRISYDIGVSGLLPSSASSSMLFIKKVRAGGWILHYWATVLLCIFILLGP

SEQ ID NO: 19946 - DNA, 1077 bp, Sorghum bicolor
  misc_feature: Ceres ANNOT ID no. 8743381
  misc_feature: Encodes the peptide sequence at SEQ ID NO 19947
atgtctgcctttgtggggaaatacacagatgagctgatcaagaccgccaagtacctggcaacgccgggcaagggcatcctggcctccgacgagtcgacgggcaccatcggcaagcgcctgtccagcatcaacctcgagaacgtggagtcgaaccggcaggcgctccgcgagctgctcttcacggcgcccggcgtgttcgactacctctccggggtcatcctcttcgaggagacgctgtaccagaagacctccgacgggacgccgttcgtggacgtgatccgcgccgccggcgccgtcccggggatcaaggtggacaagggcaccgtcgagatcgcgggcaccaacggcgagaccgccgcgcagggcctcgactccctgggcgcgcgctgcgccaagtactacgcggccggcgcgcgcttcgccaagtggcgcgccgtgctcaaggtcggccccgcggagccctccgagctcgccgtcaggcagaacgccgagggcctcgcgcggtacgcgctcatctgccaggagtacgggctcgtgcccatcgtcgagcccgagatcctcaccgacggcggccacgacatcaagacctgcgccgccgtcaccgagcgcgtcctcgccgccgtctacaagtcgctcaacgaccacaaggtcctcctcgagggcacgctcctcaagaccaacatggtcacccccggttccgatagccccaaggttggcgcggaggtgataggggagtacacggtggcggcgctgcggcgcaccgtgccgccggcggtgcccggggtcgtgttcctgtcgggcgggcagagcgaggaggaggcgacgcagaacctggacgccatgaacaagctggaggtgctcaagccctggacgctgtccttctccttcggccgcgcgctgcagcagagcaccctcaagaagtggctcggcaagaaggagaacgtcgccgccgcgcaggccaccttcctcgtccggtgcaaggccaactccgaggccgggctgggcaagtacaccggctccggcgccggggacgccgccgcctctgaaagtttgtacgtcaaggggtacaagtactaa

SEQ ID NO: 19947 - protein, 358 aa, Sorghum bicolor
  misc_feature: Useful for making plants with modulated phosphate use efficiency
  misc_feature: Functional homolog of the protein sequence given in SEQ ID NO 12920
  misc_feature: Useful for making plants with modulated biomass
  misc_feature: Functional homolog of the protein sequence given in SEQ ID NO 13636
  misc_feature: Ceres ANNOT ID no. 8743381
  misc_feature (1)..(358): SWISSPROT Homolog: EC 4.1.2.13 Fructose-bisphosphate aldolase
  misc_feature (11)..(358): Pfam ID: Glycolytic Pfam Description: Fructose-bisphosphate aldolase class-I
MSAFVGKYTDELIKTAKYLATPGKGILASDESTGTIGKRLSSINLENVESNRQALRELLFTAPGVFDYLSGVILFEETLYQKTSDGTPFVDVIRAAGAVPGIKVDKGTVEIAGTNGETAAQGLDSLGARCAKYYAAGARFAKWRAVLKVGPAEPSELAVRQNAEGLARYALICQEYGLVPIVEPEILTDGGHDIKTCAAVTERVLAAVYKSLNDHKVLLEGTLLKTNMVTPGSDSPKVGAEVIGEYTVAALRRTVPPAVPGVVFLSGGQSEEEATQNLDAMNKLEVLKPWTLSFSFGRALQQSTLKKWLGKKENVAAAQATFLVRCKANSEAGLGKYTGSGAGDAAASESLYVKGYKY

SEQ ID NO: 19948 - DNA, 675 bp, Sorghum bicolor
  misc_feature: Ceres ANNOT ID no. 8743379
  misc_feature: Encodes the peptide sequence at SEQ ID NO 19949
atgtcgggcgtgttcggcagggtgttcgggaagtccaaggcgcagagccaggccaccgcgctggcctcgctcgacaagctcaacgagacacttgaaatgttggaaaagaaggaaaacttactagtgaaaaaggccaatcttgaggtcgagaaggccaagaattttaccaaagccaagaataaaagagccgcaatacagtgcttgaagaggaagaggctatacgagcaacagattgagcagcttggaaatttccagctcaggatacatgatcagatgattatgctggaagccgcaaaagctacaacagagaccgtggatgcattgagaactggagcatcggcaatgaaagctatgcataaatcaacaaatattgacgatgttgataaaaccatggatgaaatcaatgacaatatggagaacatgagacaaattcaggatctgttgtcagcgcctatgggagcagcagctgattttgatgaggatgaactggaagctgaacttgccgatctggagggggaggagttggaggcagagctgcttgcacctaccacaacagctccgtccacagctccagtgcgtgtacctactgctcagcagtccactaggccatctgcccagagtagcaaagctgaagatgacgagctggcagctctacaagcagaaatggctatgtaa

SEQ ID NO: 19949 - protein, 224 aa, Sorghum bicolor
  misc_feature: Useful for making plants with modulated nitrogen use efficiency
  misc_feature: Functional homolog of the protein sequence given in SEQ ID NO 14350
  misc_feature: Ceres ANNOT ID no. 8743379
  misc_feature (22)..(191): Pfam ID: Snf7 Pfam Description: Snf7
MSGVFGRVFGKSKAQSQATALASLDKLNETLEMLEKKENLLVKKANLEVEKAKNFTKAKNKRAAIQCLKRKRLYEQQIEQLGNFQLRIHDQMIMLEAAKATTETVDALRTGASAMKAMHKSTNIDDVDKTMDEINDNMENMRQIQDLLSAPMGAAADFDEDELEAELADLEGEELEAELLAPTTTAPSTAPVRVPTAQQSTRPSAQSSKAEDDELAALQAEMAM

SEQ ID NO: 19950 - DNA, 1272 bp, Sorghum bicolor
  misc_feature: Ceres ANNOT ID no. 8743405
  misc_feature: Encodes the peptide sequence at SEQ ID NO 19951
atgctcagctcactccaccaccaccactcctcctcctcctccgacaccgacaccaacaatggcaacaacaagaacggcagcagcggcgtcctcgcggcggcggtgccgtccgcgcgggacctcgtgctggcctgcgccgacctgctgcagcgcggggacctccaggccgcgcgccgcgccgcgggggtcctcctgtccgcggcgtccccgcgcgccgacgccgccgaccggctcgcctaccacttcgcgcgcgcgctcgcgctccgggcggatgtcagggccgccgccgtcgccgctggccgcgtcgtcgccccgggcttggtggcttccgccgctacttcctccgcctacctcgcgttcaaccagatcgcgcccttcctgcgcttcgcgcacctgacggcgaaccaggccatcctcgacgccgtcgagggcgcgcgccgaatccacatcctagacctggacgccgcgcacggcgtccagtggccgcctctcctgcaggcgatcgccgaacgcgccgacccggccgcgggaccgccggaggtgcgcatcaccggcgccggcgccgaccgcgacaccctcctccgcacgggcagccgcctccgcgccttcgcccgctccatccagctcccgttccacttcacgccgctcctgctctcctgcgccgctacccatcatcatcagcacgtcgccagcgggagcaccacgacgaccaccaattcgagcgcggcctcgagcctggagctgcacccggacgagacgctggctgtcaactgcgtcatgttcttgcacaagctaggcgggcaggacgagcttgccgccttcttgaagtgggtgaaggccatggcccccgccgtggtgaccgtcgcggagagggagacaatcggcgggggtttcgaccgcatcgacgacctgccacagcgggccgcggttgccatggaccactactcggccgtgttcgaggcgctcgaggcgactgtgccgccggggagccgggagcggctagcggtggagcaggaggtgctcggcagggagatcgacgccgcgctggatgcctccggtgggaggtggtggcgcgggctcgaacggtggggagccgcggcgcgcgccgccggattcgcggcgcggccgctcagcgcgttcgccgtgtcgcaggcgcggctgctgctgcggctgcactacccgtcggagggctacctcgtgcaggaggcgcgcggcgcgtgctttctcgggtggcagacgcggccactgctgtccgtgtcgtcgtggcagtag

SEQ ID NO: 19951 - protein, 423 aa, Sorghum bicolor
  misc_feature: Useful for making plants with modulated biomass
  misc_feature: Functional homolog of the protein sequence given in SEQ ID NO 14754
  misc_feature: The sequence is a functional homolog of SEQ ID NO 1326 in the 10/374,780 US patent application
  misc_feature: The sequence is a functional homolog of SEQ ID NO 1325 in the 10/374,780 US patent application
  misc_feature: Ceres ANNOT ID no. 8743405
  misc_feature (7)..(334): Pfam ID: GRAS Pfam Description: GRAS family transcription factor
MLSSLHHHHSSSSSDTDTNNGNNKNGSSGVLAAAVPSARDLVLACADLLQRGDLQAARRAAGVLLSAASPRADAADRLAYHFARALALRADVRAAAVAAGRVVAPGLVASAATSSAYLAFNQIAPFLRFAHLTANQAILDAVEGARRIHILDLDAAHGVQWPPLLQAIAERADPAAGPPEVRITGAGADRDTLLRTGSRLRAFARSIQLPFHFTPLLLSCAATHHHQHVASGSTTTTTNSSAASSLELHPDETLAVNCVMFLHKLGGQDELAAFLKWVKAMAPAVVTVAERETIGGGFDRIDDLPQRAAVAMDHYSAVFEALEATVPPGSRERLAVEQEVLGREIDAALDASGGRWWRGLERWGAAARAAGFAARPLSAFAVSQARLLLRLHYPSEGYLVQEARGACFLGWQTRPLLSVSSWQ

SEQ ID NO: 19952 - DNA, 1215 bp, Sorghum bicolor
  misc_feature: Ceres ANNOT ID no. 8743433
  misc_feature: Encodes the peptide sequence at SEQ ID NO 19953
atgggagacccctacaccaattttctcagaggctactactcccacttccctccctccaacgctcccccggtcacctccttccccagcagctacgcctcctcctacctccaccacccgcctcccccgccgtcccctcccatcagggaagccctccccctcctcagcaacctcacgccgtcgtcgtcgtcagcaaccaaccaccaccaccaccacggcggcggcgacgtccaggatcacaaggactgctgcaagcgcgccacctcgtgcagcgacgaccaagaggcggccgatcaggccgccgccggggaggtcacggtggccttgcacatcggcctgcccagccccagcccctccgattcggcggcggacggtggcgacagccaggagccagctgcagcggaagggaggagccagctgcagcagcaagaaggaggaggaggagaagaagaagaggaggaggaaggggaggaggacgccgccatggcggtgggctgcgcgtccatcgggatcgggaggctgacgaaagggcagtactggatccccaccccgtcgcagatcctcattgggcccacccagttctcctgccccgtctgctacaagaccttcaaccgatacaacaacatgcagatgcacatgtggggccacgggtcgcagtaccgcaagggcccggagtcgctgcggggcacgcagccgacggcgatgctgcggctgccgtgctactgctgcgcggcggggtgccggaacaacatcgaccacccgcgggcgcggccgctcaaggacttccgcacgctgcagacgcactaccgccggaagcacggcatcaagcccttcatgtgccgcaagtgcggcaaggccttcgccgtgcgcggcgactggcgcacccacgagaagaactgcggcaagctctggtactgcgcctgcggctccgacttcaagcacaagcgctccctcaaggaccacatccgcgccttcggcaggggacacgccgcctgcggcatcgactgcttcgacgacctcgacgacgacgaccgcgacccgtcctccgaggtcgaccacgccgcggcggcggccgccaacaataccactactactacatcgtccgccgccgccgccaatgctcaagctcaacatcatcaccaccacagcgtgtggaagccgccgccgccgccgccactgtcgtcgtcgagcagaggctccggcgacccactgctatag

SEQ ID NO: 19953 - protein, 404 aa, Sorghum bicolor
  misc_feature: The sequence is a functional homolog of SEQ ID NO 1076 in the 10/666,642 US patent application
  misc_feature: The sequence is a functional homolog of SEQ ID NO 1078 in the 10/666,642 US patent application
  misc_feature: The sequence is a functional homolog of SEQ ID NO 1490 in the 10/666,642 US patent application
  misc_feature: The sequence is a functional homolog of SEQ ID NO 2792 in the 10/374,780 US patent application
  misc_feature: The sequence is a functional homolog of SEQ ID NO 432 in the 10/225,066 US patent application
  misc_feature: The sequence is a functional homolog of SEQ ID NO 1079 in the 10/666,642 US patent application
  misc_feature: The sequence is a functional homolog of SEQ ID NO 630 in the 10/666,642 US patent application
  misc_feature: Ceres ANNOT ID no. 8743433
  misc_feature (277)..(299): Pfam ID: zf-C2H2 Pfam Description: Zinc finger, C2H2 type
MGDPYTNFLRGYYSHFPPSNAPPVTSFPSSYASSYLHHPPPPPSPPIREALPLLSNLTPSSSSATNHHHHHGGGDVQDHKDCCKRATSCSDDQEAADQAAAGEVTVALHIGLPSPSPSDSAADGGDSQEPAAAEGRSQLQQQEGGGGEEEEEEEGEEDAAMAVGCASIGIGRLTKGQYWIPTPSQILIGPTQFSCPVCYKTFNRYNNMQMHMWGHGSQYRKGPESLRGTQPTAMLRLPCYCCAAGCRNNIDHPRARPLKDFRTLQTHYRRKHGIKPFMCRKCGKAFAVRGDWRTHEKNCGKLWYCACGSDFKHKRSLKDHIRAFGRGHAACGIDCFDDLDDDDRDPSSEVDHAAAAAANNTTTTTSSAAAANAQAQHHHHHSVWKPPPPPPLSSSSRGSGDPLL

SEQ ID NO: 19954 - DNA, 216 bp, Sorghum bicolor
  misc_feature: Ceres ANNOT ID no. 8743470
  misc_feature: Encodes the peptide sequence at SEQ ID NO 19955
atggtgatgaacgcccaaatggtgttggacatgcttagggagaggaaggatgggaactggttcgacctggtgatcagcaatgtcatcatccccaacatggacggcttcaatctccttaagctcatcggcctagagatggatctccctgtcaccactaaagcccttggtcaaactcattttcccatttttatgcatggcattcttctaatcatgtag

SEQ ID NO: 19955 - protein, 71 aa, Sorghum bicolor
  misc_feature: The sequence is a functional homolog of SEQ ID NO 1410 in the 10/666,642 US patent application
  misc_feature: The sequence is a functional homolog of SEQ ID NO 476 in the 10/412,699 US patent application
  misc_feature: The sequence is a functional homolog of SEQ ID NO 172 in the 10/666,642 US patent application
  misc_feature: The sequence is a functional homolog of SEQ ID NO 2510 in the 10/374,780 US patent application
  misc_feature: The sequence is a functional homolog of SEQ ID NO 686 in the 10/412,699 US patent application
  misc_feature: The sequence is a functional homolog of SEQ ID NO 976 in the 10/225,066 US patent application
  misc_feature: The sequence is a functional homolog of SEQ ID NO 934 in the 10/666,642 US patent application
  misc_feature: The sequence is a functional homolog of SEQ ID NO 935 in the 10/666,642 US patent application
  misc_feature: The sequence is a functional homolog of SEQ ID NO 1452 in the 11/479,226 US patent application
  misc_feature: The sequence is a functional homolog of SEQ ID NO 148 in the 10/225,066 US patent application
  misc_feature: The sequence is a functional homolog of SEQ ID NO 2512 in the 10/374,780 US patent application
  misc_feature: The sequence is a functional homolog of SEQ ID NO 688 in the 10/412,699 US patent application
  misc_feature: The sequence is a functional homolog of SEQ ID NO 936 in the 10/666,642 US patent application
  misc_feature: The sequence is a functional homolog of SEQ ID NO 238 in the 10/666,642 US patent application
  misc_feature: The sequence is a functional homolog of SEQ ID NO 912 in the 10/412,699 US patent application
  misc_feature: Useful for making plants with altered lignin content
  misc_feature: Functional homolog of the protein sequence given in SEQ ID NO 13182
  misc_feature: The sequence is a functional homolog of SEQ ID NO 580 in the 10/666,642 US patent application
  misc_feature: The sequence is a functional homolog of SEQ ID NO 937 in the 10/666,642 US patent application
  misc_feature: Ceres ANNOT ID no. 8743470
MVMNAQMVLDMLRERKDGNWFDLVISNVIIPNMDGFNLLKLIGLEMDLPVTTKALGQTHFPIFMHGILLIM

SEQ ID NO: 19956 - DNA, 2073 bp, Sorghum bicolor
  misc_feature: Ceres ANNOT ID no. 8743460
  misc_feature: Encodes the peptide sequence at SEQ ID NO 19957
atggccggcgaatccacgtctcccggcagctcctcgccgtcgggaccggcggcgaagactggggaagaaatggccgcggacaccttcccagctgggctgcgcgtgctcgccgtcgaacacgaccgcgtctgcagcaagatcctagagaggcagctgaagtactgcaactacaacgcaacaatggtgacgaacgcccagacggcgttggacatgctcagggagaggaaagaatacgggaaccagttcgacctggtgatcagcaacgtcgccatgcccaagcccaacatggacggcttcaagctcctcgagctcatcggcctggagatggatctcccagtcatcatgctatccgcgaacagtgagacacaaactataatcaaagggataaagcatggagcctgtgattatatggtaaagccagtgcgcctcgaacagcttaggggcatatggacacatgtggtgaagaataggaagtttccatctggggatggtgataatgttgagaaggttggagcaaaccacgccaagaagtattcaaggaaaaacaaaaaggctgtggatgttgctgatgaggacaatgagagcacatcaacccagaagaagcaaagggtccagtggtgtggtgaactacaccggaagtttgtagaagctgtcaatcagattggcatggacagggctgttcctaagaagatattagaagtcatgaatgtggaaggcctaactaaacagaatgtcgccagtcatctgcagaagtaccgaatctttctcagaaagctcagggagggcacacttaagaattctaatccatttgctgatgaaactgaagcattgcggagaaacatgagcctcccatccttcattggctctccaagctcaagcaaccattgtgcaaaaatgaattcctcatctgcaattggaacgcaagcttcgctgcacacagggtcagttcaggtcatgagctctcagaaaaacctgggcattcctcaatcaaacatggaaccagttggccactgtgtcaacctgcccaaagatggtgtgcctatggcagtgcaggatatcagcagattcatctcttctggcaagtcctacgcacctgtatcgagtggatggctgccaggtgcaagccagtgctttccttctggtccttctggaagctcctttgcaaatagttcaaatggtgtggtgttgaacgcaagcaaacctttctttgttgatatatctgggggttcatttgcaaatatctcaaatgacagtccaccattgacctcgaacatgtccttttctttgtctcgttcctgcagctcctatgcgagtatattgcctggcaagattttggggtcaagcagaggtattccttttgaagacatatcagatggtgagatattggctcctcctggtcatttaccattgcagtctcctgacttggtgaaccagccttcgattcagtttcaatcatgttctgctggcaaatttaaccaggttgccagcgaagctcaccaaattgcaggacctagcaactcctcgaaagctgctgtgccgtcaaggttttctgatcttggtcataatgttggaacatctgaagatccttcacagggtaacattttcaagatcaaccagttgtcaagatttgcaggctcctctggacagatttcaactttcagaaatgagtataagaggaaaattgcaggaatcatgggaaacactgtaccaatggtaggtttcagagagcaggtggcaacatctagttttggaaacaacacacactctacagcgatgccgattggcaattctgctttggctagttcttcaagcacgagacctgaccttcagatagacaacaattctgccatgccgacccaggtgctgaatggcgatggtgcaagtgacaacctccatgtaggtagcactattcagcaagctgttagtgaccaagtgaataacatcaatgaattcgtcgtgggaacaagtgaggcacagaatgaggagagcgatgactgggatgatctccttgcttactttaatcaagtaagatactttctccacttttttatgcataaaatctgtctgtcttga

SEQ ID NO: 19957 - protein, 690 aa, Sorghum bicolor
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
  misc_feature: Ceres ANNOT ID no. 8743460
  misc_feature (30)..(201): SWISSPROT Homolog: EC 3.1.4.17 3',5'-cyclic-nucleotide phosphodiesterase
  misc_feature (33)..(151): Pfam ID: Response_reg Pfam Description: Response regulator receiver domain
  misc_feature (203)..(253): Pfam ID: Myb_DNA-binding Pfam Description: Myb-like DNA-binding domain
MAGESTSPGSSSPSGPAAKTGEEMAADTFPAGLRVLAVEHDRVCSKILERQLKYCNYNATMVTNAQTALDMLRERKEYGNQFDLVISNVAMPKPNMDGFKLLELIGLEMDLPVIMLSANSETQTIIKGIKHGACDYMVKPVRLEQLRGIWTHVVKNRKFPSGDGDNVEKVGANHAKKYSRKNKKAVDVADEDNESTSTQKKQRVQWCGELHRKFVEAVNQIGMDRAVPKKILEVMNVEGLTKQNVASHLQKYRIFLRKLREGTLKNSNPFADETEALRRNMSLPSFIGSPSSSNHCAKMNSSSAIGTQASLHTGSVQVMSSQKNLGIPQSNMEPVGHCVNLPKDGVPMAVQDISRFISSGKSYAPVSSGWLPGASQCFPSGPSGSSFANSSNGVVLNASKPFFVDISGGSFANISNDSPPLTSNMSFSLSRSCSSYASILPGKILGSSRGIPFEDISDGEILAPPGHLPLQSPDLVNQPSIQFQSCSAGKFNQVASEAHQIAGPSNSSKAAVPSRFSDLGHNVGTSEDPSQGNIFKINQLSRFAGSSGQISTFRNEYKRKIAGIMGNTVPMVGFREQVATSSFGNNTHSTAMPIGNSALASSSSTRPDLQIDNNSAMPTQVLNGDGASDNLHVGSTIQQAVSDQVNNINEFVVGTSEAQNEESDDWDDLLAYFNQVRYFLHFFMHKICLS

SEQ ID NO: 19958 - DNA, 168 bp, Sorghum bicolor
  misc_feature: Ceres ANNOT ID no. 8743471
  misc_feature: Encodes the peptide sequence at SEQ ID NO 19959
atgcttagggagaggaaggatgggaaccagttcaaactggtgatcagcaatgtcgtcatccccaacatggattgcttcaaactcctcaagctcatcaacctggagatggatctcccagtcatcagtaaagcccttgctcaaactcatttttctcatttttatgcatga

SEQ ID NO: 19959 - protein, 55 aa, Sorghum bicolor
  misc_feature: The sequence is a functional homolog of SEQ ID NO 935 in the 10/666,642 US patent application
  misc_feature: The sequence is a functional homolog of SEQ ID NO 1410 in the 10/666,642 US patent application
  misc_feature: The sequence is a functional homolog of SEQ ID NO 476 in the 10/412,699 US patent application
  misc_feature: The sequence is a functional homolog of SEQ ID NO 172 in the 10/666,642 US patent application
  misc_feature: The sequence is a functional homolog of SEQ ID NO 2510 in the 10/374,780 US patent application
  misc_feature: The sequence is a functional homolog of SEQ ID NO 686 in the 10/412,699 US patent application
  misc_feature: The sequence is a functional homolog of SEQ ID NO 976 in the 10/225,066 US patent application
  misc_feature: The sequence is a functional homolog of SEQ ID NO 936 in the 10/666,642 US patent application
  misc_feature: The sequence is a functional homolog of SEQ ID NO 934 in the 10/666,642 US patent application
  misc_feature: The sequence is a functional homolog of SEQ ID NO 1452 in the 11/479,226 US patent application
  misc_feature: The sequence is a functional homolog of SEQ ID NO 148 in the 10/225,066 US patent application
  misc_feature: The sequence is a functional homolog of SEQ ID NO 2512 in the 10/374,780 US patent application
  misc_feature: The sequence is a functional homolog of SEQ ID NO 688 in the 10/412,699 US patent application
  misc_feature: The sequence is a functional homolog of SEQ ID NO 937 in the 10/666,642 US patent application
  misc_feature: The sequence is a functional homolog of SEQ ID NO 238 in the 10/666,642 US patent application
  misc_feature: The sequence is a functional homolog of SEQ ID NO 912 in the 10/412,699 US patent application
  misc_feature: The sequence is a functional homolog of SEQ ID NO 580 in the 10/666,642 US patent application
  misc_feature: The sequence is a functional homolog of SEQ ID NO 1104 in the 11/479,226 US patent application
  misc_feature: The sequence is a functional homolog of SEQ ID NO 2404 in the 10/374,780 US patent application
  misc_feature: The sequence is a functional homolog of SEQ ID NO 550 in the 10/225,066 US patent application
  misc_feature: Useful for making plants with altered lignin content
  misc_feature: Functional homolog of the protein sequence given in SEQ ID NO 13182
  misc_feature: Ceres ANNOT ID no. 8743471
MLRERKDGNQFKLVISNVVIPNMDCFKLLKLINLEMDLPVISKALAQTHFSHFYA

SEQ ID NO: 19960 - DNA, 1356 bp, Sorghum bicolor
  misc_feature: Ceres ANNOT ID no. 8743475
  misc_feature: Encodes the peptide sequence at SEQ ID NO 19961
atggcttatccatctacctccgggatggtccaagcttcttcatccctccatggcagcatgagaagggatcctgaaggatatgacatgtcatccgatctggaccaagccctactcctctactttgatgggcagcaagctaagacatcaattcaagaacaacaaccgcagactctcaacatcttcccctcccagccaatgcatcatatcgagccatccccgaagggttccatggcttcttcttcagtggtggcagcacaggtcgctgctgccccttccaagaactcgcaggcgccgtcgttgatgggaggcggcgggccgcttgctgccgccggcaagagctccaaggcagcaatcaagagagaaggcggcaccgctggcggcaagcatggcgccgtgggagcttcgagctcggatcaggaggggccccggacgccggaccccaagacgctgcggaggctcgcgcagaatagggaggccgccaggaagagcaggctgaggaagaaggcttatattcagcagctagagtcaggcaggatcaggttggcacagctagagcaggagatgcagatggcaagaacccatcagggtgcactatggggtgcaggaactctaagcccagatgcggcgctgttcaacctggagtacgagcggtggcttggggagcacagcaaggtggtggcccggctgcgtgccgccgcggaggagcaccaccggccggacggcgaactgcgggcgtacgtggacgaggccgccgcccactacggcgcgctgatggggcacaaggcccgggtcgccggcgccgacccgctccacctcctctccggcctctggaagggcgccgccgagcgctgcttcctctggatcggcggcttccgcccctccgagctcgtcaaggtcgtggtccggcacgtggagccgctggcggcggagcaacaggcggcgggggcacgcgacgtggagcaggcggcgcggcgggcggaggaggcgctggacgccgagctggaggcgctgctccggtcgctctccgaggtcgtgtcctcggacgcgcagccgccgccgccggggatgatgtacggtggccagctctaccacccggccgacgtggccggctacatggggatgggccacatgcacgtcgccgtcgccatggacaaggtggcctcgctcgggaccatcctcagacaggcggacgagctgaggatgcaggcgttgcacgcactccggcagatcctgacggcgaggcaggcggcgcgctgcttcatcgccgccgacgactacttctgccgcctccgaacgctcagcacgctctggaccaccagccggacggccaatctggctagaggcccggccgggtag

SEQ ID NO: 19961 - protein, 451 aa, Sorghum bicolor
  misc_feature: The sequence is a functional homolog of SEQ ID NO 1494 in the 10/374,780 US patent application
  misc_feature: The sequence is a functional homolog of SEQ ID NO 1564 in the 10/412,699 US patent application
  misc_feature: Ceres ANNOT ID no. 8743475
  misc_feature (144)..(194): Pfam ID: bZIP_2 Pfam Description: Basic region leucine zipper
MAYPSTSGMVQASSSLHGSMRRDPEGYDMSSDLDQALLLYFDGQQAKTSIQEQQPQTLNIFPSQPMHHIEPSPKGSMASSSVVAAQVAAAPSKNSQAPSLMGGGGPLAAAGKSSKAAIKREGGTAGGKHGAVGASSSDQEGPRTPDPKTLRRLAQNREAARKSRLRKKAYIQQLESGRIRLAQLEQEMQMARTHQGALWGAGTLSPDAALFNLEYERWLGEHSKVVARLRAAAEEHHRPDGELRAYVDEAAAHYGALMGHKARVAGADPLHLLSGLWKGAAERCFLWIGGFRPSELVKVVVRHVEPLAAEQQAAGARDVEQAARRAEEALDAELEALLRSLSEVVSSDAQPPPPGMMYGGQLYHPADVAGYMGMGHMHVAVAMDKVASLGTILRQADELRMQALHALRQILTARQAARCFIAADDYFCRLRTLSTLWTTSRTANLARGPAG

SEQ ID NO: 19962 - DNA, 1182 bp, Sorghum bicolor
  misc_feature: Ceres ANNOT ID no. 8743504
  misc_feature: Encodes the peptide sequence at SEQ ID NO 19963
atggcggccaccgcggccgcgtcggggaccgggtcctccttcctctccccgcgccgcagtcgcagcgccgcctcctcgactgtccgcgccgccgcctcgcgcttccgctctccgagatccgtgctcggtagcgagcagctgcgggtggcgcaggaagggaagcggatgggcggggccgccgagcccagggccgccgtgtggacgccaaaggcgcccgcgccggaggccaggcttgccgcactgccaagggagccgcgggactccaggatgaagatcttctccggcacggccaaccgcccgctcgctcaggaaattgctgcttacctgggtgtagacctcggcaagatcctgatcaagcgttttgctgatggagaaatttatgtgcaactgcaagagagcgtgagaggatgtgatgtgttcttgatccagcccacatgctctcctgtcaacgaaaacctcatggagctcttcatcatgattgatgcctgccggcgggcttcagcacggtctattaccgttgttattccatactttggttatgctagagcagacagaaaggcacaagggcgtgagcccattactgccaaacttgctgcaaatttacttactgaagctggtagtgaccgtgtcattgtatgtgatatccattctacgcaagcgttggggtactttgatattcctgtggatcatatatatgggcagcctgtgattctggattacctggccagcaagacaatatctgaagatcttgtggttgtttctcctgatgtgggtggtgttgttagagcacgtgcattcgctaagaaattattgaacgcccgtttagctattgttgataaaagaagacagggtcacaacatgtcagaggtcatgaacttaattggtgatgtgaaaggaaaagtggctatcttgattgatgacatgattgacacagcagcagctttgttaaagcaggagggagcagaagctgtatatgcttgttgtacgcatgctgttttcagccctcccgcaattgaaaggctttctggaggtgtctttgaggaagttattgtgacaaactccatcctgctgccagaagacaaatgcttccctcagctgacggtgctttcaatggcgaaccttgtagccgaaacaatttggcatgttcatcgtgatggctccgtcagcagcatcttccaataa

SEQ ID NO: 19963 - protein, 393 aa, Sorghum bicolor
  misc_feature: Useful for making plants with modulated biomass
  misc_feature: Functional homolog of the protein sequence given in SEQ ID NO 13893
  misc_feature: Ceres ANNOT ID no. 8743504
  misc_feature (41)..(393): SWISSPROT Homolog: EC 2.7.6.1 Ribose-phosphate diphosphokinase
  misc_feature (225)..(350): Pfam ID: Pribosyltran Pfam Description: Phosphoribosyl transferase domain
MAATAAASGTGSSFLSPRRSRSAASSTVRAAASRFRSPRSVLGSEQLRVAQEGKRMGGAAEPRAAVWTPKAPAPEARLAALPREPRDSRMKIFSGTANRPLAQEIAAYLGVDLGKILIKRFADGEIYVQLQESVRGCDVFLIQPTCSPVNENLMELFIMIDACRRASARSITVVIPYFGYARADRKAQGREPITAKLAANLLTEAGSDRVIVCDIHSTQALGYFDIPVDHIYGQPVILDYLASKTISEDLVVVSPDVGGVVRARAFAKKLLNARLAIVDKRRQGHNMSEVMNLIGDVKGKVAILIDDMIDTAAALLKQEGAEAVYACCTHAVFSPPAIERLSGGVFEEVIVTNSILLPEDKCFPQLTVLSMANLVAETIWHVHRDGSVSSIFQ

SEQ ID NO: 19964 - DNA, 786 bp, Sorghum bicolor
  misc_feature: Ceres ANNOT ID no. 8743534
  misc_feature: Encodes the peptide sequence at SEQ ID NO 19965
atggtgagctcgctgcctctgttcttgctgctgctgctatctgcagccagcttcggcgacggcgtgaggctcggcaatggcggctacgaggactggaggctcggcaccgccacctacgtcaaggagtcccagtcgcaccctctcaacgacggtggtggcgcctgcggttacggcgacctggacatcttcaggtacggccggtacacggcggggctgagcgcggcgctgttcggccgcggcagcgcctgcggcggctgctacgagctccggtgcgtcaaccacatccagtggtgcctccggggcagccccacggtggtggtgacggccacggacttctgccccgccaacatgggcgtcgccgacgaggtggccggcggctggtgcaacttcccgcgggagcacctcgagctgtcggaggccgccttcctccgcgtcgccaaggccaaggccgacatcgtgcccgtgcagttccggagggtgagctgcgacagggcgggcggcatgcggttcaccatcaccggcagtgctcacttcctgcaggtgctgatcaccaacgtggcggcggacggcgaggtgacggccgtgaaggtgaaagggtcgaggacggggtggatcccgatgggacggaactggggccagaactggcagtgcgacgccgacctccgcggccagccactgtcgttcgaggtcaccggcgggaggggcaggacggtcaccgcctacagtgtcgcgccagcggactggatgttcgcgcagacgtttgagggaaagcagttcgccgagtag

SEQ ID NO: 19965 - protein, 261 aa, Sorghum bicolor
  misc_feature: Useful for making plants with altered cell wall content and/or composition
  misc_feature: Functional homolog of the protein sequence given in SEQ ID NO 14755
  misc_feature: Useful for making plants with altered carbohydrate content
  misc_feature: Functional homolog of the protein sequence given in SEQ ID NO 14464
  misc_feature: Ceres ANNOT ID no. 8743534
  misc_feature (168)..(245): Pfam ID: Pollen_allerg_1 Pfam Description: Pollen allergen
  misc_feature (69)..(157): Pfam ID: DPBB_1 Pfam Description: Rare lipoprotein A (RlpA)-like double-psi beta-barrel
MVSSLPLFLLLLLSAASFGDGVRLGNGGYEDWRLGTATYVKESQSHPLNDGGGACGYGDLDIFRYGRYTAGLSAALFGRGSACGGCYELRCVNHIQWCLRGSPTVVVTATDFCPANMGVADEVAGGWCNFPREHLELSEAAFLRVAKAKADIVPVQFRRVSCDRAGGMRFTITGSAHFLQVLITNVAADGEVTAVKVKGSRTGWIPMGRNWGQNWQCDADLRGQPLSFEVTGGRGRTVTAYSVAPADWMFAQTFEGKQFAE

SEQ ID NO: 19966 - DNA, 963 bp, Sorghum bicolor
  misc_feature: Ceres ANNOT ID no. 8743566
  misc_feature: Encodes the peptide sequence at SEQ ID NO 19967
atggcggcggcggcgaagagcgtatgcgtgaccggcgcgggcggcttcatcgcgtcgtggctcgtgaagctcctcctctcccgtggccaatacacggtccgcggcaccgtgcgcgaccctggtgctagcaagaatgctcatctcaaggcgctggaaggagctatggaaaggttgcagcttcttaaggttgatttgttggactacagcagtgttgcatcagcaattgccggctgtgagggtgtcttccatgtagctagtcctgttccttccggtcggtcctccaaccctgaggtggaggtcataggtcctgctgtattaggaacaaccaatgtgttaaaggcttgctatgaggcaaaagttaagcgagttgtggtggtgtcttctgttgcagctatattcagtaacccttactggcctaagggcaaggcctttgatgaagactgttggtcagatgaggattactgcaggaagaatgaggattggtattacctttccaaaactctgtccgaacgtgaggcttttgcttatgcagcaaaaacggggttggatgttgtaactatttgcccggccttggtatttggacccttgatgcagtctatattaaatgcgagtagtaaaatactccttaactatttcaaaggagatcgtgagaccattgaaaatagactcagaaatattgtggatgttcgtgatgttgctgatgctcttcttctggcatatgaaaaaccagaagcgtctggacgatacatctgcagctcacaaccaataaaagtttctgatatgataaacatattaaagactttatatccaacttacccttatcccaaaaactttgtggaaatggatgacaactccatatacagttctgagaaacttcagaagctagggtggaccttcaggcctatagaggagaccctccgcgaaagtgttgaatcctacaaagcatttggcatcctgaattga

SEQ ID NO: 19967 - protein, 320 aa, Sorghum bicolor
  misc_feature: Useful for making plants with altered carbohydrate content
  misc_feature: Functional homolog of the protein sequence given in SEQ ID NO 13643
  misc_feature: Useful for making plants with altered cell wall content and/or composition
  misc_feature: Useful for making plants with altered lignin content
  misc_feature: Functional homolog of the protein sequence given in SEQ ID NO 13345
  misc_feature: Ceres ANNOT ID no. 8743566
  misc_feature (2)..(319): SWISSPROT Homolog: EC 1.1.1.219 Dihydrokaempferol 4-reductase
  misc_feature (8)..(252): Pfam ID: Epimerase Pfam Description: NAD dependent epimerase/dehydratase family
MAAAAKSVCVTGAGGFIASWLVKLLLSRGQYTVRGTVRDPGASKNAHLKALEGAMERLQLLKVDLLDYSSVASAIAGCEGVFHVASPVPSGRSSNPEVEVIGPAVLGTTNVLKACYEAKVKRVVVVSSVAAIFSNPYWPKGKAFDEDCWSDEDYCRKNEDWYYLSKTLSEREAFAYAAKTGLDVVTICPALVFGPLMQSILNASSKILLNYFKGDRETIENRLRNIVDVRDVADALLLAYEKPEASGRYICSSQPIKVSDMINILKTLYPTYPYPKNFVEMDDNSIYSSEKLQKLGWTFRPIEETLRESVESYKAFGILN

SEQ ID NO: 19968 - DNA, 993 bp, Sorghum bicolor
  misc_feature: Ceres ANNOT ID no. 8743556
  misc_feature: Encodes the peptide sequence at SEQ ID NO 19969
atggacggcggcgacgcgggcaagacgaggacgatgaagaagacggtgtgcgtgacgggcgccggcggcttcgtcgcctcgtggctcgtgcagcgcctcctctccagaggcgactacctcgtgcgtggcactgttcgcgatccgagtgatcccaagaacgcgcacctgatggcgctggacggcgccggggagcgcctgcggctgttcaaggctgacttgttggaccgtgccagcgtcgccgccgccgttgctggctgcgacggcgtcttccacgtcgccagccccgtcccggccgtcgagcccaccaaccccgatgtggagatcatggctccggcggtgaccggcacgcagaacatgctggaggctagccacgcggccaacgtccgccgcgtcgtggtggtgtcgtcggtcgccgcggtgatcgcgaaccccaccagcatccccgatgacgccgtcgccgacgaagactgctggtcggacgaggactactgcagagccactaagaactggtactgcctttccaagacggtggccgaacgcgaggcactggcatacggcgagaggactgggatggacgtggtcaccgtctgtccgccgtgggttctgggtccgctgctgcagccgacggtgaacgccaccagcatgggtttcgtgaaatacctgaaaggagaaaacaccgatgagaagaggaggaacatggtggacgtgcgcgacgtcgcagacgctctggtcctgacgtacgagacgccggaggcggctggccggcgatacatctgtagcgcacacgccatgaaggtgtctgaaataatcagcctcgtcagcagcctgtacccagacctgaagctgcactaccccagggagtttgttcagaaggaagacgagaagggagtgagctccaagaggctgcaggcgctggggtggaaattcaggacggtggaggaaactctgagagacaccatcgactcgtacaaggctgctggaatcctcaactga

SEQ ID NO: 19969 - protein, 330 aa, Sorghum bicolor
  misc_feature: Useful for making plants with altered carbohydrate content
  misc_feature: Functional homolog of the protein sequence given in SEQ ID NO 13643
  misc_feature: Ceres ANNOT ID no. 8743556
  misc_feature (15)..(329): SWISSPROT Homolog: EC 1.1.1.219 Dihydrokaempferol 4-reductase
  misc_feature (16)..(260): Pfam ID: Epimerase Pfam Description: NAD dependent epimerase/dehydratase family
MDGGDAGKTRTMKKTVCVTGAGGFVASWLVQRLLSRGDYLVRGTVRDPSDPKNAHLMALDGAGERLRLFKADLLDRASVAAAVAGCDGVFHVASPVPAVEPTNPDVEIMAPAVTGTQNMLEASHAANVRRVVVVSSVAAVIANPTSIPDDAVADEDCWSDEDYCRATKNWYCLSKTVAEREALAYGERTGMDVVTVCPPWVLGPLLQPTVNATSMGFVKYLKGENTDEKRRNMVDVRDVADALVLTYETPEAAGRRYICSAHAMKVSEIISLVSSLYPDLKLHYPREFVQKEDEKGVSSKRLQALGWKFRTVEETLRDTIDSYKAAGILN

SEQ ID NO: 19970 - DNA, 969 bp, Sorghum bicolor
  misc_feature: Ceres ANNOT ID no. 8743557
  misc_feature: Encodes the peptide sequence at SEQ ID NO 19971
atggacatggacggcggcgacgccggcaagacgaggacgatgaagacggtgtgcgtgacgggcgccgggggcttcgtcgcctcgtggctcgtgcagcgcctcctatccagaggcgactacctcgtgcgtggcactgttgacgacccgagtgatcccaagaacgcgcacctgatggcgctggacggcgcggcggagcgcctgcggctattcaaggccgatttgctggaccgtgccagcgtcgccgccgccgttgctggctgcgacggcgtcttccacgtcgccagccccgtcccggccgtcgagcccaccaaccccgatgtggacatcctggctccggcggtgaccggcacgcagaacgtgctcgagggtagccacgcggccaacgtccgccgcgtcgtggtggtgtcgtcggtcgccgcggtgctcgcgaaccccagcgtccccgatggcgccatcgtcgacgaagactgctggtcggacgaggactactgcagagccactaagaactggtactgcgtttccaagacactggccgaacgcgaggcactggcatacagcgagaggaccgggatggacgttgtcaccgtctgtccgccgtgggttctgggtccgctgctgcagccgacggtgaacgccaccagagataacacctataagaagtggaggaacatggtggacgtgcgcgacgtcgcagatgctctcgtcctgacatacgagacaccggaggcgtctggccggcggcgatacatctgtagcgcgcacgccatgaaggtgtctgaaacggtcggcctcgtcagcagcctgttcccagatctgaagctgcaataccccagggagtttgttcagagggaagacgagaagggagtgagctccaagaggctgcaggcgctggggtggaagttcagggcggtggaggaaactctgagggacaccatcgactcgtacaaggctgctggaatcctcaactga

SEQ ID NO: 19971 - protein, 322 aa, Sorghum bicolor
  misc_feature: Useful for making plants with altered carbohydrate content
  misc_feature: Functional homolog of the protein sequence given in SEQ ID NO 13643
  misc_feature: Ceres ANNOT ID no. 8743557
  misc_feature (15)..(321): SWISSPROT Homolog: EC 1.1.1.219 Dihydrokaempferol 4-reductase
  misc_feature (17)..(252): Pfam ID: Epimerase Pfam Description: NAD dependent epimerase/dehydratase family
MDMDGGDAGKTRTMKTVCVTGAGGFVASWLVQRLLSRGDYLVRGTVDDPSDPKNAHLMALDGAAERLRLFKADLLDRASVAAAVAGCDGVFHVASPVPAVEPTNPDVDILAPAVTGTQNVLEGSHAANVRRVVVVSSVAAVLANPSVPDGAIVDEDCWSDEDYCRATKNWYCVSKTLAEREALAYSERTGMDVVTVCPPWVLGPLLQPTVNATRDNTYKKWRNMVDVRDVADALVLTYETPEASGRRRYICSAHAMKVSETVGLVSSLFPDLKLQYPREFVQREDEKGVSSKRLQALGWKFRAVEETLRDTIDSYKAAGILN

SEQ ID NO: 19972 - DNA, 333 bp, Sorghum bicolor
  misc_feature: Ceres ANNOT ID no. 8743569
  misc_feature: Encodes the peptide sequence at SEQ ID NO 19973
atggaggcggcggggaagagcgtgtgcgtgaccggcgccggcggcttcatcgcgtcgtggctggtgaagctcctcctctcccggggccagtacgccgtccgtggcaccgtgcgcgaccctggtaaggctctcagacctccctctcatcgatccgtcgccgatccatggtttcttagcttcgcggcgacgattcttgtgtacatgaggaacaactgcatcttcaggctaataccccctcaatcaagaactgcaaattcatcttcaagactgaattcaacttgcttctatgcagagcaagaagaaaatatttccccaggattcaagaatggatag

SEQ ID NO: 19973 - protein, 110 aa, Sorghum bicolor
  misc_feature: Useful for making plants with altered carbohydrate content
  misc_feature: Functional homolog of the protein sequence given in SEQ ID NO 13693
  misc_feature: Ceres ANNOT ID no. 8743569
  misc_feature (1)..(49): SWISSPROT Homolog: EC 1.1.1.219 Dihydrokaempferol 4-reductase
MEAAGKSVCVTGAGGFIASWLVKLLLSRGQYAVRGTVRDPGKALRPPSHRSVADPWFLSFAATILVYMRNNCIFRLIPPQSRTANSSSRLNSTCFYAEQEENISPGFKNG

SEQ ID NO: 19974 - DNA, 870 bp, Sorghum bicolor
  misc_feature: Ceres ANNOT ID no. 8743567
  misc_feature: Encodes the peptide sequence at SEQ ID NO 19975
atgaggatatatcttgtttgtgctctaggtgctagcaagaatgctcatctcaaggcgctggaaggagctggggaaaggttgcagcttcttaaggctgatttgttggactacaacagtgttgcatcagcaattgctggctgtgagggtgtcttccatgtagctagccctgtcccttccggtcggtcctccaaccctgaggtggaggtcataggtcctgctttaacaggtacaaccaatgtgttaaaggcttgctatgaggcaaaagttaggcgagtcgtggtggtgtcttcatgtgcagctgtgtttgctaatcctaactggccaaagggtaaggtctttgatgaagactgctggtcagatgaggattactgcaggaagaatgaggattggtatttcctttccaaaacactggcggaacgtggggcttttgcttatgcagcaaaaacagggttggacgttgtaactatttgtccgtcatatgtatttggacccttgatgcagcctatagtaaattcgagcagtaaagtcatccttaattatttcaaaggaaatctcgagactgttgaaaatagactcagaaatatggtggatgttcgtgatgttgctgatgctcttcttctagcttacgaaaactcagaagcgtctggacgatacatcagcagttcacatccaataaaagtttctgatatgataaacatattgaagaccttatatccaacttaccattatcccaaaaattttgtggaagtggatgactactctgtattcagttctaagaaattgcagaagctaggctggaccttcaggcctatagaggaaatcctccgtgacactgttgaatcctacaaagcatttggcatcctaaattga

SEQ ID NO: 19975 - protein, 289 aa, Sorghum bicolor
  misc_feature: Useful for making plants with altered cell wall content and/or composition
  misc_feature: Useful for making plants with altered lignin content
  misc_feature: Functional homolog of the protein sequence given in SEQ ID NO 13345
  misc_feature: Useful for making plants with altered carbohydrate content
  misc_feature: Functional homolog of the protein sequence given in SEQ ID NO 13643
  misc_feature: Ceres ANNOT ID no. 8743567
  misc_feature (13)..(288): SWISSPROT Homolog: EC 1.1.1.219 Dihydrokaempferol 4-reductase
  misc_feature (15)..(228): Pfam ID: Epimerase Pfam Description: NAD dependent epimerase/dehydratase family
MRIYLVCALGASKNAHLKALEGAGERLQLLKADLLDYNSVASAIAGCEGVFHVASPVPSGRSSNPEVEVIGPALTGTTNVLKACYEAKVRRVVVVSSCAAVFANPNWPKGKVFDEDCWSDEDYCRKNEDWYFLSKTLAERGAFAYAAKTGLDVVTICPSYVFGPLMQPIVNSSSKVILNYFKGNLETVENRLRNMVDVRDVADALLLAYENSEASGRYISSSHPIKVSDMINILKTLYPTYHYPKNFVEVDDYSVFSSKKLQKLGWTFRPIEEILRDTVESYKAFGILN

SEQ ID NO: 19976 - DNA, 813 bp, Sorghum bicolor
  misc_feature: Ceres ANNOT ID no. 8743573
  misc_feature: Encodes the peptide sequence at SEQ ID NO 19977
atggccagcagcaagtggtgggagcaggcggcactcgacttcccgtcgccgcagccgcaccaggcggtgcccatgccgccggcgctagctcccgcggttgcctcgccggagggcggcggcaagcagcagcagcagccgcagcaagcgggcgccggggcggcgggggccatcgtgccgctgcgtcggccgcggggccggccgctggggtccaagaacaagccgaagccgccggtgatcatcacgcgggacagcccggacgcgctgcactcgcacgtgctcgaggtggcgccgggcgccgacgtgtcggcgtgcgtggcggagtacgcgcggcgccggggccgcggcgtctgcgtcctgggcgcgtcgggcgcggtcggggacgtggccgtgcgcggcgccacggcgccgctccggggccggttcgagctcctctccgtcaccggcaccgtgctgcccccgccggcaccgcccgaggcgtcgggcctcgccgtgctcgtctccgccggccagggccaggtcctcggcggctgcgtcgttggcccgctcgtcgccgctggccccgtcaccatcttcgccgcgacgttcgccaacgcggtctacgagcgcctcccgctcgccgacgcccccgagctcgacgtcaagcccgacctctccaccgctacctcggctggcgggcaagatgtgcagcagcagcagcagcagcagccacagcttccaatggcgccctcccaccagcaacctccggcggccatgggcgccggcggctacgcggaccaccgctcgccgccgtacccgtggggaggcggcgtatga

SEQ ID NO: 19977 - protein, 270 aa, Sorghum bicolor
  misc_feature: The sequence is a functional homolog of SEQ ID NO 10 in the 10/669,824 US patent application
  misc_feature: The sequence is a functional homolog of SEQ ID NO 10 in the 10/870,198 US patent application
  misc_feature: The sequence is a functional homolog of SEQ ID NO 1399 in the 10/374,780 US patent application
  misc_feature: The sequence is a functional homolog of SEQ ID NO 1509 in the 10/412,699 US patent application
  misc_feature: The sequence is a functional homolog of SEQ ID NO 340 in the 11/435,388 US patent application
  misc_feature: The sequence is a functional homolog of SEQ ID NO 342 in the 10/714,887 US patent application
  misc_feature: The sequence is a functional homolog of SEQ ID NO 1400 in the 10/374,780 US patent application
  misc_feature: The sequence is a functional homolog of SEQ ID NO 1510 in the 10/412,699 US patent application
  misc_feature: The sequence is a functional homolog of SEQ ID NO 1402 in the 10/374,780 US patent application
  misc_feature: The sequence is a functional homolog of SEQ ID NO 1410 in the 10/374,780 US patent application
  misc_feature: The sequence is a functional homolog of SEQ ID NO 344 in the 11/435,388 US patent application
  misc_feature: The sequence is a functional homolog of SEQ ID NO 346 in the 10/714,887 US patent application
  misc_feature: The sequence is a functional homolog of SEQ ID NO 38 in the 10/669,824 US patent application
  misc_feature: The sequence is a functional homolog of SEQ ID NO 38 in the 10/870,198 US patent application
  misc_feature: The sequence is a functional homolog of SEQ ID NO 64 in the 10/669,824 US patent application
  misc_feature: The sequence is a functional homolog of SEQ ID NO 64 in the 10/870,198 US patent application
  misc_feature: The sequence is a functional homolog of SEQ ID NO 1412 in the 10/374,780 US patent application
  misc_feature: The sequence is a functional homolog of SEQ ID NO 1418 in the 10/374,780 US patent application
  misc_feature: The sequence is a functional homolog of SEQ ID NO 90 in the 10/669,824 US patent application
  misc_feature: The sequence is a functional homolog of SEQ ID NO 86 in the 10/669,824 US patent application
  misc_feature: The sequence is a functional homolog of SEQ ID NO 87 in the 10/669,824 US patent application
  misc_feature: Ceres ANNOT ID no. 8743573
MASSKWWEQAALDFPSPQPHQAVPMPPALAPAVASPEGGGKQQQQPQQAGAGAAGAIVPLRRPRGRPLGSKNKPKPPVIITRDSPDALHSHVLEVAPGADVSACVAEYARRRGRGVCVLGASGAVGDVAVRGATAPLRGRFELLSVTGTVLPPPAPPEASGLAVLVSAGQGQVLGGCVVGPLVAAGPVTIFAATFANAVYERLPLADAPELDVKPDLSTATSAGGQDVQQQQQQQPQLPMAPSHQQPPAAMGAGGYADHRSPPYPWGGGV

SEQ ID NO: 19978 - DNA, 504 bp, Sorghum bicolor
  misc_feature: Ceres ANNOT ID no. 8743583
  misc_feature: Encodes the peptide sequence at SEQ ID NO 19979
atggtgatggtgagcgttgcgagcccaagcccgagcccgagcccgatggtgcggtcggaggaggacctgggtccgccgtggctgcggccgctgctgggcacgagcttcttcgtgccgtgccggctgcacccggagctgagcaagaacgagtgcaacctcttctgcctcggctgcaccggcgacgccctctgcgcctactgcctgccggcgcaccgcgaccaccacgtcgtgcagatccggcggtcgtcgtaccacaacgtgatccgggtgtcggaggtggggaagctgatcgacatctcccacgtgcagacgtacgtgatcaacagcgccaagatcgtgttcctcaacggccggccgcaggccaggccaggcaagggcgtcaccaacacctgtgagatctgctgccggagcctcccggactcgttccgcttctgctccctcggatgcaagatcttttatctggcccagcgtagcaatgtagccccccaaagcaagtttttttag

SEQ ID NO: 19979 - protein, 167 aa, Sorghum bicolor
  misc_feature: The sequence is a functional homolog of SEQ ID NO 668 in the 10/666,642 US patent application
  misc_feature: The sequence is a functional homolog of SEQ ID NO 664 in the 10/666,642 US patent application
  misc_feature: Ceres ANNOT ID no. 8743583
  misc_feature (40)..(151): Pfam ID: PLATZ Pfam Description: PLATZ transcription factor
MVMVSVASPSPSPSPMVRSEEDLGPPWLRPLLGTSFFVPCRLHPELSKNECNLFCLGCTGDALCAYCLPAHRDHHVVQIRRSSYHNVIRVSEVGKLIDISHVQTYVINSAKIVFLNGRPQARPGKGVTNTCEICCRSLPDSFRFCSLGCKIFYLAQRSNVAPQSKFF

SEQ ID NO: 19980 - DNA, 2373 bp, Sorghum bicolor
  misc_feature: Ceres ANNOT ID no. 8743659
  misc_feature: Encodes the peptide sequence at SEQ ID NO 19981
atggcagttgagacatccaggacattgcaatggggatgtcattaccaaggcagctcttccatatgtgcatctcacagaactattttaaatgcagcatgctcctcgcaaccaaatgggagtgcccctccattagtcatagctcgtggtgggtactctgggctgttccctgattcaagccaattcgggtaccagtttgccctgtcgaatagtctgcctgaagttgttcttttctgtgatttacaactttcaagtgacaacgttggattctgcaagactggcttggcacttgatgactcaacgctaatagctaaggtcttccctaagaatgacaagacatacaaagtgaatggagacggcctgcacggatggttttcagtcgacttcacttcaaatcagctaatggacaatgtcacattgatccagaatgttctgtcccgcccaagcatatttgatggcaccatgggaattagccttattgatgatgtcgtagaactccaccctcctcaactttggattaatatacagtatggacagttcttcctagatcacaaattaaatatcgaagagtacatatcatctaaagcaaaagaatttggtgtcaattatgtctcctcacctgaagttggattcttgaaaagccttagtgggaagcttgggaaaagcaatgtgaagcttgtttttcggtttctcgatcaacaactcattgagccttccacaaaacaaccttatggaaccattctgaaggacttaaaatctgtcaaggcttttgcctcaggaattctcgtccccaagacttacatttggcctgtgaacaaggatcagtacttgcagccagctactactttggtgaaagatgctcatggcctagacttggaggtttatgcatttaagtttggcaatgatttcatttcaagttacaactacagctatgatcctagtgctgagtacttgcagtttattgatagttctgacttctctgttgatggtgtcctcactgacttcccatccacagcttcagcagccattgatgataccagaccactgatcatcacccacaatggtgcgtgtggcttattccctggctgcaccgaccttgcataccagcaagcagtggaagacggtgcagatataattgactgttcagtacagatgtcaaaggatgcagtgcccttttgcttggactccccggatcttacaaaagggacgacagcagcaacagtgttctcgacaaaagctgctactgtaaatgaaatacagaatgggtctggcatcttcgcatttgatcttctatcgagtgagatccaaactctaaagcctgatcttgttggcccatacaatcaagaaggactgaaaagaaatccagcagcaaagaacagtgggaaacttatgactttagttgatttcctggccttctcaaagagcaacaacatctctggtgtactagtcgatgttcgtaatgccccataccttgcaaccagaggcattgacattgtggatgctgtctccagcgcacttatcaatgccagctatgacaaagagaccaggcagcaggtgctcatcgcatcggacgattccgccgtgctcagagcattcaagaagttcccagcattcaagcgcgtcctccagatcggcaacgcaatcagcgatgtgtccaaggcatccgtggaggagatggccaagttcgcgagcgctgtgtccatcactcggggctcagttgtccaggcgcagggatcattcctcttgcggttcactgatgtgatcgacaagatgcatgccgcaaacctatcggtgtatgtcgggctgctcaggaacgagttcatgaaccttgggttcgacttctgggctaacccaatggttgagatcgtgacgtactcatctctgatggctgatgggattgtgaccgaattccctgcaacggcagcagagtacttcaggagcccatgcagtgacttcagtaagaacctgacctacacgatcatgcctgcaaagcctgggtctttgctcaaactgacagaccccagtgcactgcctccggcgcaggggccagcgccagtgctgaaacctgccgatgttgtggacccaccgctgccaccagtgaccatcagtacccctggagcttcagcatcttcgaatggttccagcactaccagtggtgcaagggtgtccactgcaagctctggtctttgcttgttggcaatcggactttctgtgttattggtaacgagctctaagggcctggccactgcaattcgtttagcacaaatttgggagaatgatacagaccattatgacatccttgactggaggaggtttacaactgtactgaagtggagtgatgtttaccagctaaggccctgtttagattggagatga

SEQ ID NO: 19981 - protein, 790 aa, Sorghum bicolor
  misc_feature: Useful for making plants with altered cell wall content and/or composition
  misc_feature: Functional homolog of the protein sequence given in SEQ ID NO 14038
  misc_feature: Ceres ANNOT ID no. 8743659
  misc_feature (352)..(639): Pfam ID: GDPD Pfam Description: Glycerophosphoryl diester phosphodiesterase family
MAVETSRTLQWGCHYQGSSSICASHRTILNAACSSQPNGSAPPLVIARGGYSGLFPDSSQFGYQFALSNSLPEVVLFCDLQLSSDNVGFCKTGLALDDSTLIAKVFPKNDKTYKVNGDGLHGWFSVDFTSNQLMDNVTLIQNVLSRPSIFDGTMGISLIDDVVELHPPQLWINIQYGQFFLDHKLNIEEYISSKAKEFGVNYVSSPEVGFLKSLSGKLGKSNVKLVFRFLDQQLIEPSTKQPYGTILKDLKSVKAFASGILVPKTYIWPVNKDQYLQPATTLVKDAHGLDLEVYAFKFGNDFISSYNYSYDPSAEYLQFIDSSDFSVDGVLTDFPSTASAAIDDTRPLIITHNGACGLFPGCTDLAYQQAVEDGADIIDCSVQMSKDAVPFCLDSPDLTKGTTAATVFSTKAATVNEIQNGSGIFAFDLLSSEIQTLKPDLVGPYNQEGLKRNPAAKNSGKLMTLVDFLAFSKSNNISGVLVDVRNAPYLATRGIDIVDAVSSALINASYDKETRQQVLIASDDSAVLRAFKKFPAFKRVLQIGNAISDVSKASVEEMAKFASAVSITRGSVVQAQGSFLLRFTDVIDKMHAANLSVYVGLLRNEFMNLGFDFWANPMVEIVTYSSLMADGIVTEFPATAAEYFRSPCSDFSKNLTYTIMPAKPGSLLKLTDPSALPPAQGPAPVLKPADVVDPPLPPVTISTPGASASSNGSSTTSGARVSTASSGLCLLAIGLSVLLVTSSKGLATAIRLAQIWENDTDHYDILDWRRFTTVLKWSDVYQLRPCLDWR

SEQ ID NO: 19982 - DNA, 453 bp, Sorghum bicolor
  misc_feature: Ceres ANNOT ID no. 8743720
  misc_feature: Encodes the peptide sequence at SEQ ID NO 19983
atgtcgaggaggaagaccagggagcccaaggaggagaatgttacccttggacccactgtccgtgaaggagagtatgtctttggtgttgctcacatctttgcatccttcaatgacaccttcattcatgtcactgatttgtctgggagggaaactctggttcggatcactggtggcatgaaggtcaaagctgatcgtgatgagtcgtcgccttatgctgctatgcttgcttctcaagatgttgcacagcgttgcaaggagcttggtatcactgcgctgcacattaagcttcgtgccactggaggcaacaagaccaagacccctggacctggtgctcagtctgctctcagggcccttgctcgttctgggatgaaaattggacgcattgaggatgttaccccggttcccactgacagcactcgcagaaagggtggtaggaggggaaggaggctgtag

SEQ ID NO: 19983 - protein, 150 aa, Sorghum bicolor; identical to SEQ ID NO: 18257
  misc_feature: Useful for making plants with modulated biomass
  misc_feature: Functional homolog of the protein sequence given in SEQ ID NO 14542
  misc_feature: Ceres ANNOT ID no. 8743720
  misc_feature (28)..(146): Pfam ID: Ribosomal_S11 Pfam Description: Ribosomal protein S11

SEQ ID NO: 19984 - DNA, 453 bp, Sorghum bicolor
  misc_feature: Ceres ANNOT ID no. 8743737
  misc_feature: Encodes the peptide sequence at SEQ ID NO 19985
atgtcgaggaggaagaccagggagcccaaggaggagaacgttacccttggacccactgtccgtgaaggagagtatgtctttggtgttgctcacatctttgcatccttcaatgacaccttcattcatgtcactgatttgtctgggagggaaactctggttcgcatcactggtggcatgaaggtcaaggctgatcgtgatgagtcatcgccttatgctgctatgcttgcttctcaagatgttgcacagcgttgcaaggagcttggtatcactgcgctgcacattaagcttcgtgccactggaggcaacaagaccaagacccctggacctggtgctcagtccgctctcagggctcttgctcgttctgggatgaaaattggacgcattgaggatgttaccccggttcccactgacagcactcgcagaaagggtggtcggaggggtaggaggctgtag

SEQ ID NO: 19985 - protein, 150 aa, Sorghum bicolor; identical to SEQ ID NO: 18257
  misc_feature: Useful for making plants with modulated biomass
  misc_feature: Functional homolog of the protein sequence given in SEQ ID NO 14542
  misc_feature: Ceres ANNOT ID no. 8743737
  misc_feature (28)..(146): Pfam ID: Ribosomal_S11 Pfam Description: Ribosomal protein S11

SEQ ID NO: 19986 - DNA, 1182 bp, Sorghum bicolor
  misc_feature: Ceres ANNOT ID no. 8743767
  misc_feature: Encodes the peptide sequence at SEQ ID NO 19987
atggtgccgccatttgctgtgtgtagacgaggtggtagttgggccagtaaagagtggcggagtcatagggatggcctcatgatgccgatttatgatctaacatgctatgattccaaactgttgttttactcatgttcagaaacacttaatgccactagtcctacgaaagccacagggaggcatcacaaacattcctcggtcctcaaagtgagatgctgggtagctactcatcaccaacataattccaatgcccaacggtttcaggcaactggcataggaattgcaaagatactgcatgccttctaccagttttgtcgaccacacacaatatttggaaccataataggcattacttcagtgtcgctcctgccagtgaagagcctagatgattttacgttgacagttctatggggatatcttgaggctttggccgctgcattatgtatgaacatttatgttgtagggctgaatcagctattcgacattgagattgacaaggtcaataagccaattctcccattggcttctggagagttttcagtgccaactgcagtgttattagtagtgtcatttttggtcatgagcattagcatcggggtaagatcaaagtctgctccattgatgtgtgctttacttgttagcttccttcttggaagtgcatattccattaatgttccatttctccggtggaagcaacatgcctttctagctgcattttgcataatctttgtgagggctgtattggttcaattagcattctttgcacacatgcagcaacatgttctcaagaggcccttggcaccaacaaggtcggtggtctttgcaacatgttttatgtgttgcttctctgcagtaatagcgctattcaaggatattcctgatgttgatggagatagatatttcggcattcagtcaatgactgtacggttaggccaacagagagtgtataggctctgcgttaatattctcatgacagcatacgcagctgctattttggtaggagcatcatctacaaacctatatcagaagattgtcattcttactggccatggcttgcttgcctccacactttggcaaagggcgcaacaatttgacattgcgaataaagaatgcatcacaccgttttatatgttcatttggaagttgttctacgccgagtattttcttataccatttgtatga

SEQ ID NO: 19987 - protein, 393 aa, Sorghum bicolor
  misc_feature: The sequence is a functional homolog of SEQ ID NO 2 in US patent 7154029
  misc_feature: Useful for making plants with altered tocopherol content
  misc_feature: Functional homolog of the protein sequence given in SEQ ID NO 14756
  misc_feature: Ceres ANNOT ID no. 8743767
  misc_feature (107)..(378): SWISSPROT Homolog: EC 2.5.1.62 Chlorophyll synthase
  misc_feature (109)..(393): Pfam ID: UbiA Pfam Description: UbiA prenyltransferase family
MVPPFAVCRRGGSWASKEWRSHRDGLMMPIYDLTCYDSKLLFYSCSETLNATSPTKATGRHHKHSSVLKVRCWVATHHQHNSNAQRFQATGIGIAKILHAFYQFCRPHTIFGTIIGITSVSLLPVKSLDDFTLTVLWGYLEALAAALCMNIYVVGLNQLFDIEIDKVNKPILPLASGEFSVPTAVLLVVSFLVMSISIGVRSKSAPLMCALLVSFLLGSAYSINVPFLRWKQHAFLAAFCIIFVRAVLVQLAFFAHMQQHVLKRPLAPTRSVVFATCFMCCFSAVIALFKDIPDVDGDRYFGIQSMTVRLGQQRVYRLCVNILMTAYAAAILVGASSTNLYQKIVILTGHGLLASTLWQRAQQFDIANKECITPFYMFIWKLFYAEYFLIPFV

SEQ ID NO: 19988 - DNA, 1746 bp, Sorghum bicolor
  misc_feature: Ceres ANNOT ID no. 8743771
  misc_feature: Encodes the peptide sequence at SEQ ID NO 19989
atggagactatggcaaaggcgatacaacatggagcttgtcactacatggtgaagccagtacgccctgaaatggtcaagaacatatggttgcatgtggtgaggaagagcaagagtaatataaggaacaaagtcaacaacagaaatgataatcctagtcaaatagggcaacctgtggatgatgaaaaggatgatgcaaagcacacaaggaagcattgcaagaagaacagaaaagatggagatggttctgaaaaggatgaggtcatatcgacccagaaaaagcaaagggttgagtggactagacagctacactccaagtttcttgaagccatcaatcacattggcatggacaacgctgttccgaagaaaatactcgaagtgatgaatgtagacggcatcactaaagagaacgttgcaagtcatctgcagaaatttcgtatgtacttgaaaaagcaaaaggagggcacactcaagtactcagcatttgtggatgaacaacaagcatggctgaatggcaagacacatgttaatagcaacatgagtgtaccagaatgttcatctacacaaatttcaaacgagcatccaccattgggcacaagcatgagctttccttcatcttgttctggcatttcctatgcaagcaaattgcgtgccagtattttgggatcaaacaaaggtattccatttgatcctgacagcttctttgaagaaatggcaggtggtgagctgttgcagtctcctgagttggcaaaccaccctttggctgaaattcaatcatcgtctactgaccaagtggctccttcgagtcatttaccattacagtcacctgaattggtgaacctaccatcaactcagatttggtcatcttctattggcatgttaaaccaagttgccagggagcctccccagtttactagtagaaactccaacaactactggacaactggtgtgtcgtccagcttccatgatggtcaaaatgttggaatgtctattggtccatcacaaagaaacaacatcttcatgaaccagttgccaggactagtagcctcttctcaaagtgttccatgttctagaaatgaatatcatcagaaccaaatggcaggagtcatggggacaacaccaatggtaagcttcaatgagcaggcaaccctagcaccattcaactttggaagcaacggaagctctacagtgatgccaattaacaactttgttccaggtagttctttaagcactagaccttcattgtctaaccttaagatctgtaattcactcatactaacccaaatgccaaatggtgggggtacaactggaaatctccctgaaggtggtaccgttggtcatcaaactgttggtgatcaagagaataacaagattcaactccccatgtcaacaagggaagtacagattgacatgccagtccagatgctgaatggtggggcaagtggcaatctacctaaaggtagcaacaccgatctgcatcctgctggtgatcaagtgaatagcaccaatgaacttcccactgcaggaacaagcgaggcacaaaatggagccattgataatatagatgccttttttgccgactgggttaaacaagtaggatctttttatatcaatttcctgtctacttatttcacaatatgttttacatgtgaaagtgatgactacttaagtgagaattatctaactcaacttcttttctcacaacaggatttactcaacgatgatgatgctttcttcaatgggatgtaa

SEQ ID NO: 19989 - protein, 581 aa, Sorghum bicolor
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: Ceres ANNOT ID no. 8743771
  misc_feature (95)..(145): Pfam ID: Myb_DNA-binding Pfam Description: Myb-like DNA-binding domain
METMAKAIQHGACHYMVKPVRPEMVKNIWLHVVRKSKSNIRNKVNNRNDNPSQIGQPVDDEKDDAKHTRKHCKKNRKDGDGSEKDEVISTQKKQRVEWTRQLHSKFLEAINHIGMDNAVPKKILEVMNVDGITKENVASHLQKFRMYLKKQKEGTLKYSAFVDEQQAWLNGKTHVNSNMSVPECSSTQISNEHPPLGTSMSFPSSCSGISYASKLRASILGSNKGIPFDPDSFFEEMAGGELLQSPELANHPLAEIQSSSTDQVAPSSHLPLQSPELVNLPSTQIWSSSIGMLNQVAREPPQFTSRNSNNYWTTGVSSSFHDGQNVGMSIGPSQRNNIFMNQLPGLVASSQSVPCSRNEYHQNQMAGVMGTTPMVSFNEQATLAPFNFGSNGSSTVMPINNFVPGSSLSTRPSLSNLKICNSLILTQMPNGGGTTGNLPEGGTVGHQTVGDQENNKIQLPMSTREVQIDMPVQMLNGGASGNLPKGSNTDLHPAGDQVNSTNELPTAGTSEAQNGAIDNIDAFFADWVKQVGSFYINFLSTYFTICFTCESDDYLSENYLTQLLFSQQDLLNDDDAFFNGM

SEQ ID NO: 19990 - DNA, 1638 bp, Sorghum bicolor
  misc_feature: Ceres ANNOT ID no. 8743776
  misc_feature: Encodes the peptide sequence at SEQ ID NO 19991
atggagactatggcaaaggcgatacaacatggagcttgtcactacatggtgaagccagtacgccctgaaatggtcaagaacatatggttgcatgtggtgaggaagggcaagagtaatctaaggaacaaagtcaacaccagaaatgataaacctagtcaaatagtgcaacctgtggatgatgagaatggtgaaaaggatgatgcaaagtacacaaggaagcattgcaagaagaacagaaaagatggagatggtgctgaaaaggatgaggtcatatcgacccagaaaaagcaaagggttgagtggactagacagctacactccaagtttcttgaagccatcaatcacattggcatggacaaggctgttccgaagaaaatactcgaagtgatgaatgtagacggcatcactaaagagaacgttgcaagtcatctgcagaaatttcgtatgtacttgaaaaagcaaaaagagggcacactcaagtactcagcatttgtggatgaacaacaagcatggctgaatggcaagacacatgttaatagcaacatgagtgtaccagaatgttcatctacacaaatttcaaacgagcatccaccattgggcacaagcatgagctttccttcatcttgttctggcatttcctatgcaagcaaattgcgtgccagtattttgggatcaaacaaaggtattccatttgatcctgacagcttctttgaagaaatggcaggtggtgagctgttgcagtctcctgagttggcaaaccaccctttggctcaaattcaatcattgtctactgaccaagtggctccttcgagtcatttaccattacagtcacctgaattggtgaaccaaccatcaactcagatttggtcatcttctattggcatgttaaaccaagttgccagggagcctccccagtttactagtagaaactccagcaactactggacaactagtgtgtcgtccagcttccatgatggtcaaaatgttggaatgtctattggtccatcacaaagaaacaacatcttcatgaaccagttgccaggactagtagcctcttctcacagtgttccatcttctagaaatgaatatcagaaccaaatggcaggagtcatggggacaacaccaatggtaagcttcaatgagaaggcaaccctagcaccattcaactttggaagcaacggaagctctacagtgatgccagttaacaactttgttccaggtagttctttaagcactagaccttcattgtctaaccttaagatctgtaattctctcatactaacccaaatgccaaatggtgggggtacaactggaaatctccctgaaggtggtaccgttggtcatcaaactgttggtgatcaagagaataacaagattcaactccccatgtcaacaagggaagtacagattgacatgccagtccagatgctgaatggtggggcaagtggcaatctacctaaaggtagcaacaccgatctgcatcctgctggtgatcaagtgaatagcaccaatgaacttcccactgcaggaacaagcgaggcacagaatggagccattgataatatagatgcctttttggccgactgggttaaacaagatttactcaacgatgatgatgctttcttcaatgggatgtaa

SEQ ID NO: 19991 - protein, 545 aa, Sorghum bicolor
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: Ceres ANNOT ID no. 8743776
  misc_feature (98)..(148): Pfam ID: Myb_DNA-binding Pfam Description: Myb-like DNA-binding domain
METMAKAIQHGACHYMVKPVRPEMVKNIWLHVVRKGKSNLRNKVNTRNDKPSQIVQPVDDENGEKDDAKYTRKHCKKNRKDGDGAEKDEVISTQKKQRVEWTRQLHSKFLEAINHIGMDKAVPKKILEVMNVDGITKENVASHLQKFRMYLKKQKEGTLKYSAFVDEQQAWLNGKTHVNSNMSVPECSSTQISNEHPPLGTSMSFPSSCSGISYASKLRASILGSNKGIPFDPDSFFEEMAGGELLQSPELANHPLAQIQSLSTDQVAPSSHLPLQSPELVNQPSTQIWSSSIGMLNQVAREPPQFTSRNSSNYWTTSVSSSFHDGQNVGMSIGPSQRNNIFMNQLPGLVASSHSVPSSRNEYQNQMAGVMGTTPMVSFNEKATLAPFNFGSNGSSTVMPVNNFVPGSSLSTRPSLSNLKICNSLILTQMPNGGGTTGNLPEGGTVGHQTVGDQENNKIQLPMSTREVQIDMPVQMLNGGASGNLPKGSNTDLHPAGDQVNSTNELPTAGTSEAQNGAIDNIDAFLADWVKQDLLNDDDAFFNGM

SEQ ID NO: 19992 - DNA, 1029 bp, Sorghum bicolor
  misc_feature: Ceres ANNOT ID no. 8743795
  misc_feature: Encodes the peptide sequence at SEQ ID NO 19993
atggacccgtgggtcgggcaccagccttccctgagcctggacctcaacgtcggcctgcttcctacggcgaggccggcggttccggccaagacgaccaaggtcttggtcgaggagaacttcatggccgtcaagaaagacccagaggtcgagaagctcgaggcggagctccggcgcgtcggcgacgagaacaagcggctgagcgagatgctgcgggcggtggtggccaagtacacggagctgaagggccaggtcaacgacatggtggccgccgccaaccacactgggtcctccacatcggagggcggctccgcggcctcgccatccaggaagcggatccggagcgccggcgacaacagcctcgacaccgccgcccaacaccaccacagccgcaagccatcgccgccgttgacggccagcgctcaggcccacgatcaggcggagtgcacatcggccgccgtcagcgtcaccgccgccgccttccggcgcgccgtgcgggaggagtgccggcccaaggtgtcccggcgatacgtccacgccgaccccgctgacctcagcctcgtggtgaaggacgggtaccaatggcggaagtacgggcagaaggtgaccaaggacaacccgtgcccgcgcgcctactaccggtgctccttcgcgccgtcgtgcccggtgaagaagaaggtgcagcgcagcgcggacgacagcaccgtcctggtggccacgtacgagggcgagcacaaccacggccagccgccgcagcacgacggaggcagggccgcgaggtcgacggcgacggcgcaggcgcaggtggcgagcgaggccgccgtgcgaccggtggcggcaccactgccgctgcagcacccgcaccagcagcagaagcaagaggcggcgacgacggtgccgtcgtcggaggtggcgaggaagaacctcgcggagcacatggcggtgaccctgaccagggatcccgggttcaaggcggcgctagtcagcgcgctctccggccggatcctcgagctctccccgaccagggattaa

SEQ ID NO: 19993 - protein, 342 aa, Sorghum bicolor
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8743795
  misc_feature (188)..(248): Pfam ID: WRKY Pfam Description: WRKY DNA -binding domain
MDPWVGHQPSLSLDLNVGLLPTARPAVPAKTTKVLVEENFMAVKKDPEVEKLEAELRRVGDENKRLSEMLRAVVAKYTELKGQVNDMVAAANHTGSSTSEGGSAASPSRKRIRSAGDNSLDTAAQHHHSRKPSPPLTASAQAHDQAECTSAAVSVTAAAFRRAVREECRPKVSRRYVHADPADLSLVVKDGYQWRKYGQKVTKDNPCPRAYYRCSFAPSCPVKKKVQRSADDSTVLVATYEGEHNHGQPPQHDGGRAARSTATAQAQVASEAAVRPVAAPLPLQHPHQQQKQEAATTVPSSEVARKNLAEHMAVTLTRDPGFKAALVSALSGRILELSPTRD

SEQ ID NO: 19994 - DNA, 1872 bp, Sorghum bicolor
  misc_feature: Ceres ANNOT ID no. 8743852
  misc_feature: Encodes the peptide sequence at SEQ ID NO 19995
atgggtgctccgttggcctcctggccatgggcaagcctcggctcctacaagtacctgttgtacgggcctgtggtggcgcaggcgtggagggagacggggagcctcctgccgctggcgctggggtcgtcgtggtgcctgcacctgctgctcctcctggcgctccgctcgctcaccttccagctctggttctcctacggcaacatgctcttcttcacccgccgccgccgcgtcgtcaaggacggcgtcgacttccgccagatcgacgccgagtgggactgggataacatggtgatcctgcagacgctaatcgcggcggcggtggtcggcagtccggcgttcccgggcgtgtcggaggtccgggtgtgggacccgcgcgggtggggtctggccttgctcctgcacgtgaccgtctcggagcccatcttctactggacccacagggcgctgcaccgggccccactcttcagccactaccacgcaaagcaccactcgtcccccgtcacgcagccgcttacggccgggttcggcacgccggtggaggcgctgctcctgacgctggcgatgggggccccgctggcaggggcgttcctggcgggcgcagggtccgtgagcctggtctacggctatgtcctcctcttcgactacctccggtgcatggggtacagcaacgtggaggtcatatcccacaagaccttcgccgccttcccgccgctcagatacctcatctacaccgccacgtatttaagcctgcaccacagggagaaggactgcaatttctgcctgttcatgcctctgttcgacgccctcggcgggaccatcagctccaaatcgtgggagcttcagaaacaggtcgaccaaggcatgaacgaccgggtgccggacttcgtgttcctggcgcacgtggtggacgtggtgtcgtcgatgcacgtgccgttcgcgttccggtcctgcagctcgctgccgtggtccacccacctcgtgctgctcccgctctggcccctcgccttcggcttcatgctcctccagtggttcttctccaagaccttcaccgtcaccttctacttcctccgcggccggctccaccagacgtggagcgtccccagatatggcttccagtatttcatcccgtcggcgaagaagggcatcaaccggcagatcgagctcgccatccttagggcagacaagatgggcgtcaaagtcatcagccttgctgcactgaacaagaacgaggctctcaacggcggcggcacgctgttcgtgagcaagcacccgaacctgagagtgagggtggtgcacggcaacaccctgacggcggctgtgatcctcaacgagatccccagcaacgtgagggaggtgttcctcaccggcgccacgtccaagctcggcagggccatcgcgctctacctctgcaggaagaagatcagggtcttgatgctgacgctttcgacggagaggttcctgaagatccagaaggaggcgccgtcagagttccagcagttcctcgtgcaggtcaccaagtatcaggcggcgcagagctgcaagacatggatcgtgggcaagtggctgtcgccgcgggagcagcggtgggcgccgccggggacgcacttccaccagttcgtggtgccgcccatcatcggcttccggcgggactgcacctacggcaagctggccgccatgaggctgcccaaggacgtgcaggggctgggctcctgcgagtacacgatggagcgcggggtggtgcacgcgtgccacgccggcggcgtcgtgcactgcctggaagggtgggagcaccacgaggtgggcgccatcgacgtcgaccggatcgacgtcgtgtggaaggcggcgctcaagcacgggctcacgccggcgtga

SEQ ID NO: 19995 - protein, 623 aa, Sorghum bicolor
  misc_feature: Useful for making plants with modulated nitrogen use efficiency
  misc_feature: Functional homolog of the protein sequence given in SEQ ID NO 13049
  misc_feature: Ceres ANNOT ID no. 8743852
  misc_feature (131)..(253): Pfam ID: FA_hydroxylase Pfam Description: Fatty acid hydroxylase
MGAPLASWPWASLGSYKYLLYGPVVAQAWRETGSLLPLALGSSWCLHLLLLLALRSLTFQLWFSYGNMLFFTRRRRVVKDGVDFRQIDAEWDWDNMVILQTLIAAAVVGSPAFPGVSEVRVWDPRGWGLALLLHVTVSEPIFYWTHRALHRAPLFSHYHAKHHSSPVTQPLTAGFGTPVEALLLTLAMGAPLAGAFLAGAGSVSLVYGYVLLFDYLRCMGYSNVEVISHKTFAAFPPLRYLIYTATYLSLHHREKDCNFCLFMPLFDALGGTISSKSWELQKQVDQGMNDRVPDFVFLAHVVDVVSSMHVPFAFRSCSSLPWSTHLVLLPLWPLAFGFMLLQWFFSKTFTVTFYFLRGRLHQTWSVPRYGFQYFIPSAKKGINRQIELAILRADKMGVKVISLAALNKNEALNGGGTLFVSKHPNLRVRVVHGNTLTAAVILNEIPSNVREVFLTGATSKLGRAIALYLCRKKIRVLMLTLSTERFLKIQKEAPSEFQQFLVQVTKYQAAQSCKTWIVGKWLSPREQRWAPPGTHFHQFVVPPIIGFRRDCTYGKLAAMRLPKDVQGLGSCEYTMERGVVHACHAGGVVHCLEGWEHHEVGAIDVDRIDVVWKAALKHGLTPA

SEQ ID NO: 19996 - DNA, 462 bp, Sorghum bicolor
  misc_feature: Ceres ANNOT ID no. 8743810
  misc_feature: Encodes the peptide sequence at SEQ ID NO 19997
atgcagatcttcgtcaagacgctcacggggaagaccatcacgctcgaggtcgagagcagcgacaccatcgacaatgtcaaggccaagatccaggacaaggagggcattccgcctgaccagcagaggctgatttttgctggtaagcaattggaggatgggcgaacattagctgattacaacattcaaaaggagtcgactctccatttggtcctgaggctcaggggtggaactatgatcaaggtgaagacactcactgggaaggaaatcgagattgacatcgagcccactgacacgatcgataggatcaaggagcgtgttgaggagaaagaaggcattccacctgttcagcagaggctcatttatgctgggaagcaacttgctgatgacaaaactgccaaggattacaacattgaaggtggttcagtgctccatcttgtgcttgctctgaggggtggccaatag

SEQ ID NO: 19997 - protein, 153 aa, Sorghum bicolor
  misc_feature: Useful for making plants with modulated nitrogen use efficiency
  misc_feature: Functional homolog of the protein sequence given in SEQ ID NO 13585
  misc_feature: Useful for making plants with modulated cold sensitivity
  misc_feature: Useful for making plants with modulated flowering time
  misc_feature: Functional homolog of the protein sequence given in SEQ ID NO 14303
  misc_feature: Ceres ANNOT ID no. 8743810
  misc_feature (6)..(74): Pfam ID: ubiquitin Pfam Description: Ubiquitin family
  misc_feature (82)..(150): Pfam ID: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGQ

SEQ ID NO: 19998 - DNA, 1047 bp, Sorghum bicolor
  misc_feature: Ceres ANNOT ID no. 8743794
  misc_feature: Encodes the peptide sequence at SEQ ID NO 19999
atggacccgtgggtcgggcaccagccttccctgagcctcgacctcaacgtcggcctgcttcctacggcgaggccggcggttccggcgaagtcgaccaaggtcttggtccaggagaacttcatggccgtcaagaaagacaaccgagaggtcgagaagctcgaggcggagctccggcgcgtcggcgaggagaacaggcggctgagcgagatgctgcgggcggtggtggccaagtacacggagctgaagggccaggtcgacgacatggtggtggccaccgccaaccacactgggtcctccacgtcggagggcggctccgcggcctcgccgtccaggaagcggatccggagcgccggcgacaacagcctcgacaccgccgcccaacaccaccacagacgcaagccgtcgccgccgttggcggctgccgtcgcggcacacgaccagacggagtgcacgtcggccgccgtcagcgtcaccgccgccgccttccggcgcgccgtgcgggaggagtgccggcccaaggtgtcccggcgatacgtccacgccgaccccgctgacctcagcctcgtggtgaaggacgggtaccaatggcggaagtacgggcagaaggtgaccaaggacaacccgtgcccgcgcgcctactaccggtgctccttcgcgccgtcgtgcccggtgaagaagaaggtgcagcgcagcgcggacgacagcaccgtcctggtggccacgtacgagggcgagcacaaccacggccagccgccgcagcacgacggaggcagggccgcgaggtcgacggcgacggcgcaggcgcaggtggcgagcgaggccgccgtgcgaccggtggcggcaccactgccgctgcagcacccgcaccagcagcagaagcagaagcagaagcaagaggcggcgacgacggtgccgtcgtcggaggtggcgaggaagaacctcgcggagcacatggcggtgaccctgaccagggatcccgggttcaaggcggcgctagtcagcgcgctctccggccggatcctcgagctctccccgaccagggattaa

SEQ ID NO: 19999 - protein, 348 aa, Sorghum bicolor
  misc_feature: The sequence is a functional homolog of SEQ ID NO 1200 in the 10/374,780 US patent application
  misc_feature: The sequence is a functional homolog of SEQ ID NO 1395 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
  misc_feature: Ceres ANNOT ID no. 8743794
  misc_feature (190)..(250): Pfam ID: WRKY Pfam Description: WRKY DNA -binding domain
MDPWVGHQPSLSLDLNVGLLPTARPAVPAKSTKVLVQENFMAVKKDNREVEKLEAELRRVGEENRRLSEMLRAVVAKYTELKGQVDDMVVATANHTGSSTSEGGSAASPSRKRIRSAGDNSLDTAAQHHHRRKPSPPLAAAVAAHDQTECTSAAVSVTAAAFRRAVREECRPKVSRRYVHADPADLSLVVKDGYQWRKYGQKVTKDNPCPRAYYRCSFAPSCPVKKKVQRSADDSTVLVATYEGEHNHGQPPQHDGGRAARSTATAQAQVASEAAVRPVAAPLPLQHPHQQQKQKQKQEAATTVPSSEVARKNLAEHMAVTLTRDPGFKAALVSALSGRILELSPTRD

SEQ ID NO: 20000 - DNA, 1506 bp, Sorghum bicolor
  misc_feature: Ceres ANNOT ID no. 8743821
  misc_feature: Encodes the peptide sequence at SEQ ID NO 20001
atgagcgcggcttctctcccgaccggccaggagccggagccgcagccgcacgcagtgtgcgtgccgttcccgacgcagggccacatcacgccgatgctgaagctggccaagatcctccacgccaggggcttccgcgtcaccttcgtcaacaccgagtacaaccaccgccgcctcgtccgctcccgcggcgccgccgtcgcgggcctcacggcgtcgtcgtcgtcgttccgcttcgccaccatcccggacggcctgccggagtccgacgccgacgccacgcaggacccggcgaccatcagctacgccaccaagcacaactgcccgcctcacctccgaagcctgctcgccgggctggacggcgtgacgtgcgtcgtcgccgacaacctcatgagcttcgccgtcgacgccgccagggacatgggcgtgccgtgcgcgctcttctggaccgccagcgcctgcggctacatgggctaccgcaacttccgcctcctcatcgacatgggcatcatccccttccaagacgaagagcagctgacgaacgggttcatggacatgccggtggactgggcgccaggcatgagcaagcacacgcggctcaaggacttgccgaccttcctccgcaccacggaccccaacgacgtgctgctgaacttccagctacaggaggtggagcgctccgagtacgcgtccgccgtcgtcgtcaacaccttcgacgagctggagcagccggcgctcgacgccatgcgcgccgtcatcccggcggtatacaccatcggcccgctcgtctccgtcacggagcaggtcgtcgtcgtccgcagggatccccgcctcgacgcggtgagctgcagcctgtggcgggaggaccagtcctgcctcgcgtggctggacgccaggaagcaccggccgcggtcggtggtgtacgtgaacttcgggagcattacggtgatgaccgggcaggagatggcggagttcgcggcggggatggcgagcagcggccacgacttcctgtggatcgtccggccggacgccgtcaagggcgacacctcctcctcggcggcggcgctgccaccggggttcctggaggcgacccccaagggcaggggcctcctggcgagctggtgcgaccaggaggccgtgctgcggcacgaggcggtgggcctgttcctgacgcacagcgggtggaactcgacgctggagagcctcgccgccggggtgccgatgctgtgctggccgttcttcgcggagcagcagaccaactgccggtacaagtgcgtcgagtggggcgtggccatggaggtcggcggcgacgtgcggcgggaggccgtggaggcgaggatacgggaggcgatgggtggggacaaggggaaggagatggcgcgcagggcggcggagtggaaagaggccgccgcggggtcggcggcgaggtcgctcgcgaacctcgacaggctcatcaacgatgtgctgctctctccggcacgattgggcggctcactcaaaatggcttga

SEQ ID NO: 20001 - protein, 501 aa, Sorghum bicolor
  misc_feature: Useful for making plants with altered carbohydrate content
  misc_feature: Functional homolog of the protein sequence given in SEQ ID NO 14546
  misc_feature: Ceres ANNOT ID no. 8743821
  misc_feature (287)..(455): SWISSPROT Homolog: EC 2.4.1.115 Anthocyanidin 3-O-glucosyltransferase
  misc_feature (18)..(495): Pfam ID: UDPGT Pfam Description: UDP-glucoronosyl and UDP-glucosyl transferase
MSAASLPTGQEPEPQPHAVCVPFPTQGHITPMLKLAKILHARGFRVTFVNTEYNHRRLVRSRGAAVAGLTASSSSFRFATIPDGLPESDADATQDPATISYATKHNCPPHLRSLLAGLDGVTCVVADNLMSFAVDAARDMGVPCALFWTASACGYMGYRNFRLLIDMGIIPFQDEEQLTNGFMDMPVDWAPGMSKHTRLKDLPTFLRTTDPNDVLLNFQLQEVERSEYASAVVVNTFDELEQPALDAMRAVIPAVYTIGPLVSVTEQVVVVRRDPRLDAVSCSLWREDQSCLAWLDARKHRPRSVVYVNFGSITVMTGQEMAEFAAGMASSGHDFLWIVRPDAVKGDTSSSAAALPPGFLEATPKGRGLLASWCDQEAVLRHEAVGLFLTHSGWNSTLESLAAGVPMLCWPFFAEQQTNCRYKCVEWGVAMEVGGDVRREAVEARIREAMGGDKGKEMARRAAEWKEAAAGSAARSLANLDRLINDVLLSPARLGGSLKMA

SEQ ID NO: 20002 - DNA, 2523 bp, Sorghum bicolor
  misc_feature: Ceres ANNOT ID no. 8743831
  misc_feature: Encodes the peptide sequence at SEQ ID NO 20003
atggctactttggggaggaagaagtggcaagctgtaacaaccttcatcgtgctatgcatcttgtcatccatttgcatctgcaaagcgcaattcaagcctgcggacagctaccttgttgattgtgggtcctccaagagcacaatggttggccagaggacctttgcagcggatggtgcatctccggtgaaggtgtccacctcccaggatatactcgcgggcacctcagcaaatggggtggcctctttcgataactcggcgctgtaccagactgcccgtatcttcaccgggccgtcgtcctacactttccctatccagaagcagggccggcatttcgttcggttctacttcttccccttcacctaccagagctatgatctttcacttgccaaatttactgtgtccacccaagatgttctcctgcttagtgacttccagcaaccagacaagaccgcacccttgttcaaggagtactccctgaatatcacccgcgacacgctcgtgatttccttcaagccatccaatggaattgcatttgtcaacgcaattgaggtgatctctgtcccagatgatctcattgctgataatgcacaaatggtcaaccctgtccagcagtacactggtttgtcgacacagccactggagacagtgtatcgggttaacatgggtggtccgaaggtcactcctgacaatgataccctctcgaggacctgggtgactgatggaaagtacttgttgaacccagctgtgacaaaaaatgttttgtatggcaaggatgtcaactataagaagggtctagcaactcagctgacagcccctgatattgtctatggtacagctacagagttggcagcatcatcaaatacatccaatgctgttttcaacatgacatggcagtttgatgtggatgctggcttcagctatttggttaggtttcacttctgtgatattgtcagtaaggcacttaaccagctctacttcaatgcatatgttggaggcttctctgcgcagactaatcttgatctctcaacaatgtctgaaagtcagttggctacacctgtctatatagatgtggttctttcatcaaatgatgcatccagcaaacttggcatcagcattggcccatcgaccttggacaatgtattgactgacgggattctgaatgggcttgaggttatgaagataagtactggaggttctgctttcactgttgggtctggcagtggaaacaaaaattggggtgtgattcttggtgctgcccttggaggtgttggtctgtttataattgttgttgttcttgtgcttctttgccggaggaaaaagactctggaaaagcagcattcaaagacctggatgcctttctcaatcaatgggctcacctctctcagcacaggaagcagaacatcttatggtactactctcacatcagggctgaatggaagttacggataccgctttgccttcagtgtgctccaagaagcaacaaacaattttgatgagaactgggtcattggagttggaggctttggaaaggtctacaagggagtgatgagggatgagaccaaggttgcagtgaagcgtggaaacccaaagtctcagcaaggtctcaatgagttccgtacagagattgagctcctctcacgtctgcggcaccgccatttggtgtctctgattgggtactgtgacgaaaggaacgaaatgatcttggtctatgagtatatggagaaaggcactctcaagagccatctctatggctctgataatccctcactcaattggaagcagaggctggaggtttgcattggagcagcaagggggttgcactatcttcacactggatctgcaaaggccattatccatcgtgatgtcaagtctgcaaacatcttgcttgatgagaacctcctcgcgaaggttgctgactttgggctatcaaagactgggcctgagctcgaccaaactcatgtcagcactgcggtgaagggcagctttgggtatcttgaccccgaatatttccggaggcagcagctgactgagaaatcagatgtctactcctttggtgtcgttttgcttgaggttctttgtgcaaggccagtgattgaccctacacttcccagggagatggtgaacctggccgagtggggaatgaagtggcagaagagaggagagttgcatcagatcattgaccagagaatctcaggcacgatcaggccagattctctgaggaagtttggcgaaacagtggagaagtgcctggcagactatggtgtggagcggccatcaatgggagacgtcctgtggaacctggagtacgttctgcagcttcaggatgctgattccacagtctcggatgtgaacagcatgaaccgtattgtggaactcccatcacaggttcagaacgtcggcgcccttgagagcatcagtgtgacaatggcagaagctggagcgtcaaacgagcctgatcatgacctctctgatgtgtcgatgagccgggtcttctctcagctgatcaaagccgagggaaggtaa

SEQ ID NO: 20003 - protein, 840 aa, Sorghum bicolor
  misc_feature: Useful for making plants with modulated biotic stress sensitivity
  misc_feature: Functional homolog of the protein sequence given in SEQ ID NO 14099
  misc_feature: Ceres ANNOT ID no. 8743831
  misc_feature (518)..(786): SWISSPROT Homolog: EC 2.7.11.1 Non-specific serine/threonine protein kinase
  misc_feature (497)..(770): Pfam ID: Pkinase Pfam Description: Protein kinase domain
MATLGRKKWQAVTTFIVLCILSSICICKAQFKPADSYLVDCGSSKSTMVGQRTFAADGASPVKVSTSQDILAGTSANGVASFDNSALYQTARIFTGPSSYTFPIQKQGRHFVRFYFFPFTYQSYDLSLAKFTVSTQDVLLLSDFQQPDKTAPLFKEYSLNITRDTLVISFKPSNGIAFVNAIEVISVPDDLIADNAQMVNPVQQYTGLSTQPLETVYRVNMGGPKVTPDNDTLSRTWVTDGKYLLNPAVTKNVLYGKDVNYKKGLATQLTAPDIVYGTATELAASSNTSNAVFNMTWQFDVDAGFSYLVRFHFCDIVSKALNQLYFNAYVGGFSAQTNLDLSTMSESQLATPVYIDVVLSSNDASSKLGISIGPSTLDNVLTDGILNGLEVMKISTGGSAFTVGSGSGNKNWGVILGAALGGVGLFIIVVVLVLLCRRKKTLEKQHSKTWMPFSINGLTSLSTGSRTSYGTTLTSGLNGSYGYRFAFSVLQEATNNFDENWVIGVGGFGKVYKGVMRDETKVAVKRGNPKSQQGLNEFRTEIELLSRLRHRHLVSLIGYCDERNEMILVYEYMEKGTLKSHLYGSDNPSLNWKQRLEVCIGAARGLHYLHTGSAKAIIHRDVKSANILLDENLLAKVADFGLSKTGPELDQTHVSTAVKGSFGYLDPEYFRRQQLTEKSDVYSFGVVLLEVLCARPVIDPTLPREMVNLAEWGMKWQKRGELHQIIDQRISGTIRPDSLRKFGETVEKCLADYGVERPSMGDVLWNLEYVLQLQDADSTVSDVNSMNRIVELPSQVQNVGALESISVTMAEAGASNEPDHDLSDVSMSRVFSQLIKAEGR

SEQ ID NO: 20004 - DNA, 1017 bp, Sorghum bicolor
  misc_feature: Ceres ANNOT ID no. 8743837
  misc_feature: Encodes the peptide sequence at SEQ ID NO 20005
atgcctgcacacaatgctcggcaagtgccaaaggctgccaacaatggcacgccgtcattcctctccgacaagtcggcgaaagtcttcctcgccggccacaaaggtatgctgggcacggccatccaccgtcgcctggccgcgctgggcttcaccaacatcgtcggccgcacccgcgccgagctcgacctgacgtgcgagcccgccgtccacaagttcttcgacgcggagcagcctcgctacgtgatcctcgccgcgggcaaggtgggcggcctccacgccagctccgccgcgccggccgacttcatgaccgagaacctccgcatcaccgtgaacgtcctcaccgccgcacgccgctgcggcaccgtccgcaagctgctattcctcgccacctccgccgtctaccccgtcgacgccccccagccgataccggagtccgcgctcctcaccggcccaccggcgccgggaaacgagtggtatgccatccccaagatcgttggcatcaagatgtgccaggcgtaccgcgccgagctcgacgacggcatggacgccatcgtggcgacgcccaacaacctgtacggcccgcgcgacccgttcccgtcggagagctcccacgtcatcccggcgctgatccggcggttccacgacgccaaggccagcggcgcccccgaggtcgtcgtgtggggctccggccgccagctgcgggagttcacgcacgccgacgacgccgcggacgccgccgtgctgctgatggagaggtactccggggccgagcacgtcaacgtcgggagcgggcgcgaggtgacggtgcgcgagctcgcggagacggtgagggaggtggtcgggtacgaggggcgggtcgtctgggacacaagccggccggacagcgtgatgaggcggctgctggatagctctaagatggcggcgctggggtgggagcccaaggtcgagctgagggacgggctcaagaagctgtacgagtggtacctgagtggccgcgccgcaagcttccaaccatga

SEQ ID NO: 20005 - protein, 338 aa, Sorghum bicolor
  misc_feature: Useful for making plants with altered carbohydrate content
  misc_feature: Functional homolog of the protein sequence given in SEQ ID NO 14757
  misc_feature: Useful for making plants with altered cell wall content and/or composition
  misc_feature: Functional homolog of the protein sequence given in SEQ ID NO 14041
  misc_feature: Ceres ANNOT ID no. 8743837
  misc_feature (21)..(329): SWISSPROT Homolog: EC 1.1.1.271 GDP-L-fucose synthase
  misc_feature (28)..(262): Pfam ID: Epimerase Pfam Description: NAD dependent epimerase/dehydratase family
MPAHNARQVPKAANNGTPSFLSDKSAKVFLAGHKGMLGTAIHRRLAALGFTNIVGRTRAELDLTCEPAVHKFFDAEQPRYVILAAGKVGGLHASSAAPADFMTENLRITVNVLTAARRCGTVRKLLFLATSAVYPVDAPQPIPESALLTGPPAPGNEWYAIPKIVGIKMCQAYRAELDDGMDAIVATPNNLYGPRDPFPSESSHVIPALIRRFHDAKASGAPEVVVWGSGRQLREFTHADDAADAAVLLMERYSGAEHVNVGSGREVTVRELAETVREVVGYEGRVVWDTSRPDSVMRRLLDSSKMAALGWEPKVELRDGLKKLYEWYLSGRAASFQP

SEQ ID NO: 20006 - DNA, 1872 bp, Sorghum bicolor; identical to SEQ ID NO: 19994
  misc_feature: Ceres ANNOT ID no. 8743849
  misc_feature: Encodes the peptide sequence at SEQ ID NO 20007

SEQ ID NO: 20007 - protein, 623 aa, Sorghum bicolor; identical to SEQ ID NO: 19995
  misc_feature: Useful for making plants with modulated nitrogen use efficiency
  misc_feature: Functional homolog of the protein sequence given in SEQ ID NO 13049
  misc_feature: Ceres ANNOT ID no. 8743849
  misc_feature (131)..(253): Pfam ID: FA_hydroxylase Pfam Description: Fatty acid hydroxylase

SEQ ID NO: 20008 - DNA, 1674 bp, Sorghum bicolor
  misc_feature: Ceres ANNOT ID no. 8743892
  misc_feature: Encodes the peptide sequence at SEQ ID NO 20009
atgggttccgtcgcggaggactccgccgcgcccgcggcagcgtcggtagtgttccgctccaagctaccggacatcgagatcccgcgccacctctcgctgcaggcctactgcttcgagcgtctcccggaggtatcctcccgcccgtgcctcatcgacgggcagacgggcgccgtccacacctacgccgacgtggagcgcctctcgcggaccgccgcggcggcgctgcgcgggctcggggtggggaagggcgacgtggtgatgaacctgctccgcaactgccccgagttcgccttcgtcttcctcggcgccgcgcggctgggcgccgccaccaccacggccaacccgttctacaccccgcacgagatccaccgccaggcggccgcggcgggggccaaggtgatcgtcaccgaggcctgcgccgtggagaaggtgcgcgggttcgccgccgagcgcggcgtgcccgtggccaccgtcgacggcggcgccttcgacgggtgcctcgagctcggggccctgatggacgccgccgagccgctggctgacgacgaggaggtggaccccgacgacgtcgtcgcgctgccttactcctccggcaccaccgggatgcccaagggcgtcatgctcacgcaccgcagcctcgtcaccagcgtcgcgcagcaggtggacggcgagaacccgaacctgcacttcagcagcgacgacgtggtgctgtgcgtgctgccgctgttccacatctactcgctcaactcggtgctcctggcggggctgcgcgccgggtgcgccatcgtgatcatgcgcaagttcgagatcggcgcgctggtggagctggtgcgcgcgcacggcgtgaccgtggcgcccttcgtgccgcccatcgtggtggagatcgccaagagcccccgcgtgggcgccgccgacctcgcctccatccgcatggtcatgtccggcgcggcgcccatggggaaggacctccaggacgcgttcatggccaagatccccaacgccgtgctcggccaggggtatgggatgaccgaggcagggcccgtgctggccatgtgcctggccttcgccaaggagccgttcgaggtgaagtccggctcctgcggcaccgtcgtcaggaacgcggagctcaagatcgtcgacccagacaccagcgagtcgctgggacgaaaccagccaggcgagatatgcatccgcggcgaacaaatcatgaaaggttatctgaatgatccagaagcgacaaagaacaccattgataaggatggatggctgcacactggggacattggttatgtggacgatgacgatgagatattcattgttgacaggctcaaggagataatcaaatacaagggcttccaagtacctcctgcggaacttgaggcccttctcattacacatcctgaaattaaggatgctgcagttgtctcaatgaaagatgaacttgctggcgaagtccctgttgcattcattatacggagtgaaggctctgagattagtgagaacgagatcaaacagtttgttgcaaaggaggtcgtgttctacaagaggatcaacagagttttcttcacggattccattccgaagaatccctccggcaagattcttaggaaggacctgagagcgcggcttgctgcgggcattccgagcagtgacaacacacagtccaaaagttaa

SEQ ID NO: 20009 - protein, 557 aa, Sorghum bicolor
  misc_feature: Useful for making plants with altered carbohydrate content
  misc_feature: Functional homolog of the protein sequence given in SEQ ID NO 14004
  misc_feature: Useful for making plants with altered lignin content
  misc_feature: Functional homolog of the protein sequence given in SEQ ID NO 13358
  misc_feature: Useful for making plants with altered cell wall content and/or composition
  misc_feature: Functional homolog of the protein sequence given in SEQ ID NO 13696
  misc_feature: Ceres ANNOT ID no. 8743892
  misc_feature (18)..(549): SWISSPROT Homolog: EC 6.2.1.12 4-coumarate--CoA ligase
  misc_feature (60)..(474): Pfam ID: AMP-binding Pfam Description: AMP-binding enzyme
MGSVAEDSAAPAAASVVFRSKLPDIEIPRHLSLQAYCFERLPEVSSRPCLIDGQTGAVHTYADVERLSRTAAAALRGLGVGKGDVVMNLLRNCPEFAFVFLGAARLGAATTTANPFYTPHEIHRQAAAAGAKVIVTEACAVEKVRGFAAERGVPVATVDGGAFDGCLELGALMDAAEPLADDEEVDPDDVVALPYSSGTTGMPKGVMLTHRSLVTSVAQQVDGENPNLHFSSDDVVLCVLPLFHIYSLNSVLLAGLRAGCAIVIMRKFEIGALVELVRAHGVTVAPFVPPIVVEIAKSPRVGAADLASIRMVMSGAAPMGKDLQDAFMAKIPNAVLGQGYGMTEAGPVLAMCLAFAKEPFEVKSGSCGTVVRNAELKIVDPDTSESLGRNQPGEICIRGEQIMKGYLNDPEATKNTIDKDGWLHTGDIGYVDDDDEIFIVDRLKEIIKYKGFQVPPAELEALLITHPEIKDAAVVSMKDELAGEVPVAFIIRSEGSEISENEIKQFVAKEVVFYKRINRVFFTDSIPKNPSGKILRKDLRARLAAGIPSSDNTQSKS

SEQ ID NO: 20010 - DNA, 1416 bp, Sorghum bicolor
  misc_feature: Ceres ANNOT ID no. 8743894
  misc_feature: Encodes the peptide sequence at SEQ ID NO 20011
atggacatggacatgagctcagcttatccccaccactggctctccttctccctctccaacaactaccaccatggccttcttgaggccttctccaactcctcctccgctgctccactcggagacgagcagggtacagtggaggagtccccgaagatggtggaggacttcctcggcggcgtcggtggcgcgggcgccccaccggcggcggcgacggctgcagaggatcaccagcttgtctgcggcgagctgggcagcatcacggccgggttcttgcgccactacccggcgcctgggacgacggtggagaaccccggcgcggtgaccgtggcggcgatgtcgacggacgtggcggagtccgaccaggcgaggcgccccgccgagacgttcgggcagcgcacatcaatctaccgtggtgtcaccaggcaccggtggacagggagatacgaggcgcacctgtgggacaacagctgccgccgggaaggccaaagccgcaaaggtcgccaaggaggctatgataaggaggagaaggcggctagagcttacgacctcgccgcactcaagtactggggtgctacaaccacgaccaacttcccggtgtccaactacgagaaggagctggaggagatgaagtcgatgacgcggcaggagttcatcgcgtcgttgcgcaggaagagcagcggcttctcgcgaggtgcctccatctacagaggagtcacaaggcatcatcagcatggccggtggcaggcaaggatcggcagggtggccggaaacaaggacctgtacttgggcacgttcagtactcaggaggaagcagcggaggcatacgacattgctgcgatcaagttccgcgggctcaatgccgtgaccaacttcgacatgagccgctacgacgtggacagcatcctcaacagcgacctccccgttgggggcggagcggccggacgcgcctccaagttcccactggactcactgcagccagggagcgctgctgcgatgatcgccggagctgcgtcacaggccatgccgccgtccgagaaggactactggtctctgctcgcccttcactaccagcagcagcagcagcagcagcagtttccggcttctgcttacgaggcttacggctccggcgtgaacgtggacttcacgatgggcaccagcagccacagcagcagcaacaccggcagtggcgtcatgtggggcaccactacgggtgcaatgggacagcaagacagcagcagcagcaagcagggcaacggctatgccagcaacattccttatgctgctgctgctgctgctatggtttctggatcagctggctacgagggctccaccggaaacaatggaacctgggttaccagtagcactagcaccagcacggctccccagtactacaactatctgttcgggatggagtag

SEQ ID NO: 20011 - protein, 471 aa, Sorghum bicolor
  misc_feature: The sequence is a functional homolog of SEQ ID NO 1900 in the 10/412,699 US patent application
  misc_feature: The sequence is a functional homolog of SEQ ID NO 358 in the 10/666,642 US patent application
  misc_feature: The sequence is a functional homolog of SEQ ID NO 676 in the 11/435,388 US patent application
  misc_feature: The sequence is a functional homolog of SEQ ID NO 1070 in the 10/225,066 US patent application
  misc_feature: The sequence is a functional homolog of SEQ ID NO 140 in the 11/375,241 US patent application
  misc_feature: The sequence is a functional homolog of SEQ ID NO 1904 in the 10/412,699 US patent application
  misc_feature: The sequence is a functional homolog of SEQ ID NO 2164 in the 10/374,780 US patent application
  misc_feature: The sequence is a functional homolog of SEQ ID NO 458 in the 11/435,388 US patent application
  misc_feature: Useful for making plants with altered lignin content
  misc_feature: Useful for making plants with modulated drought sensitivity
  misc_feature: Functional homolog of the protein sequence given in SEQ ID NO 14199
  misc_feature: The sequence is a functional homolog of SEQ ID NO 320 in US patent 7157621
  misc_feature: Useful for biocontainment applications
  misc_feature: Functional homolog of the protein sequence given in SEQ ID NO 13650
  misc_feature: Ceres ANNOT ID no. 8743894
  misc_feature (233)..(285): Pfam ID: AP2 Pfam Description: AP2 domain
  misc_feature (134)..(191): Pfam ID: AP2 Pfam Description: AP2 domain
MDMDMSSAYPHHWLSFSLSNNYHHGLLEAFSNSSSAAPLGDEQGTVEESPKMVEDFLGGVGGAGAPPAAATAAEDHQLVCGELGSITAGFLRHYPAPGTTVENPGAVTVAAMSTDVAESDQARRPAETFGQRTSIYRGVTRHRWTGRYEAHLWDNSCRREGQSRKGRQGGYDKEEKAARAYDLAALKYWGATTTTNFPVSNYEKELEEMKSMTRQEFIASLRRKSSGFSRGASIYRGVTRHHQHGRWQARIGRVAGNKDLYLGTFSTQEEAAEAYDIAAIKFRGLNAVTNFDMSRYDVDSILNSDLPVGGGAAGRASKFPLDSLQPGSAAAMIAGAASQAMPPSEKDYWSLLALHYQQQQQQQQFPASAYEAYGSGVNVDFTMGTSSHSSSNTGSGVMWGTTTGAMGQQDSSSSKQGNGYASNIPYAAAAAAMVSGSAGYEGSTGNNGTWVTSSTSTSTAPQYYNYLFGME

SEQ ID NO: 20012 - DNA, 1335 bp, Sorghum bicolor
  misc_feature: Ceres ANNOT ID no. 8743909
  misc_feature: Encodes the peptide sequence at SEQ ID NO 20013
atgatgagcgggaggctgaacgtggccacgtccgcctcgccgggcgacgacttcccgttcgcgtccatgcagcagcagcagcagccgccgcctcctcctccgcctccgccctacgtcgggttcgagcacggcgtggcgggcggcggcggtggccagcgcggcgccggagggatggggatgcagcagcagcagcacctctacgacgggctcgacttcgccgcggcgctgcagttccagcaggaggcgccccaccaccaccaccaccagctgctgacgctgccgtccagcctcggcccgatggcgccgccgccgctgccgatgccgatgccgatgccgctgcagatgccgatgccgatgcccgggatgcccggcggcgaccacgtgtaccaggcgctcgggatggtgaagcgcgagggcggcggcggcggcggcgcggacgccgggaggatcgggctcaacctcggccgccgcacctacttctcccccggggacatgctggccgtggaccggctcctgatgcggtcccgcctcggcggcgtgttcgggctcggcttcggcggcgcccaccaccagccccctcgctgccaggccgagggctgcaaggccgacctctccggcgccaagcactaccaccgccgccacaaggtctgcgagtaccacgccaaggcctccgtcgtcgccgccggcggcaagcagcagcgcttctgccagcaatgcagcaggtttcacgtgctgtcagagttcgacgaggttaagaggagctgcaggaagcggctggccgagcacaaccgccgccgccggaagccggccaccaccgcgtcatccaaggacgccgcgtcgccgccggccaacaagaagcccaacggcggctccatcacaagctcttactccaccgacaacaagaacctgagcacggccaagtcgaccatgtcatcgaacacgagcagcgtgatcagctgcctggaccaggccggcaacaagcagcagcagctggcgaggccgacgctgacgctcggcgcgtcgcaggacaacaaggaccagcaccagcaccagcagcagctgagcaccatgctccaggtccaagcggccggcggcggccaccaccaggagcagcacttcctaacctctctgcaggttcacaacaatggcggctgtgggggtggcaacaacaacaacatcctgtcgtgctcctcggtgtgctccagcggcgcgctgccgtcgtcggccaacggcgaggtctcggaccagaacaccaccaccaccactaccaacaacggcaacggtggcagcagcaacaacaacctgcataacctgttcgaggtggacttcatgtag

SEQ ID NO: 20013 - protein, 444 aa, Sorghum bicolor
  misc_feature: Useful for making plants with altered terpenoid content
  misc_feature: Useful for making plants with modulated flowering time
  misc_feature: Functional homolog of the protein sequence given in SEQ ID NO 13706
  misc_feature: Ceres ANNOT ID no. 8743909
  misc_feature (194)..(272): Pfam ID: SBP Pfam Description: SBP domain
MMSGRLNVATSASPGDDFPFASMQQQQQPPPPPPPPPYVGFEHGVAGGGGGQRGAGGMGMQQQQHLYDGLDFAAALQFQQEAPHHHHHQLLTLPSSLGPMAPPPLPMPMPMPLQMPMPMPGMPGGDHVYQALGMVKREGGGGGGADAGRIGLNLGRRTYFSPGDMLAVDRLLMRSRLGGVFGLGFGGAHHQPPRCQAEGCKADLSGAKHYHRRHKVCEYHAKASVVAAGGKQQRFCQQCSRFHVLSEFDEVKRSCRKRLAEHNRRRRKPATTASSKDAASPPANKKPNGGSITSSYSTDNKNLSTAKSTMSSNTSSVISCLDQAGNKQQQLARPTLTLGASQDNKDQHQHQQQLSTMLQVQAAGGGHHQEQHFLTSLQVHNNGGCGGGNNNNILSCSSVCSSGALPSSANGEVSDQNTTTTTTNNGNGGSSNNNLHNLFEVDFM

SEQ ID NO: 20014 - DNA, 1203 bp, Sorghum bicolor
  misc_feature: Ceres ANNOT ID no. 8743902
  misc_feature: Encodes the peptide sequence at SEQ ID NO 20015
atggatgcgctccgcctacggccgtccctcctctccgccgcgcgtcccggcgccgcccgcccgcgagatcattttctaccaccatgttgttccatccaacgaaatggtgaagggcgaatttgcttttctagccaaaggacccaaggtcctaccttgtatcaccatcagaaattcttcgactggaaatcctcctattgtaggatatcacatcagtcattaaatacttctgttaatgcttcggggcaacagctgcagtctgaacctgaagcacatgattctacaaccatctggagggcaatatcatcttctctagatgcattttacagattttcccggccacatactgtcataggaacagcattaagcatagtctcagtttcccttctagctgtccagagcttgtctgatatatcacctttgttcctcacgggtttgctgcaggcagtggtagctgctcttttcatgaatatctatattgttggactgaaccagttattcgacattgagatagacaaggttaacaagccaactcttccattggcatccggggaatacacccctgcaactggggttgcaatagtttcggtctttgctgctatgagctttggccttggatgggctgttggatcacaacctctgttttgggctcttttcataagctttgtccttggaactgcatattcaatcaatctgccgtaccttagatggaagagatttgctgttgttgcagcactctgcatattagcagttcgtgcagtgattgttcagctggcttttttcctccacattcagacttttgttttcagaagaccggcggtattttctaggccactgatatttgcaactggatttatgacgttcttctcagttgtaatagcactatttaaggatatacctgatatcgaaggggaccgcatttttgggattcgatcttttagtgtccggttaggtcaaaagaaggtcttctggatctgtgttggcctgcttgagatggcttacagcgttgcattactgatgggagctacttcttcctctttgtggagcaaaacagtaactattgctggccattccatacttgctgggatcttatggagctgcgcgagatcggtggacctgacgagcaaagccgcaataacatccttctacatgttcatctggaagctgttctacgcggagtacctgctcatccctctggtgcggtga

SEQ ID NO: 20015 - protein, 400 aa, Sorghum bicolor
  misc_feature: Useful for making plants with altered tocopherol content
  misc_feature: Functional homolog of the protein sequence given in SEQ ID NO 14756
  misc_feature: The sequence is a functional homolog of SEQ ID NO 2 in US patent 7154029
  misc_feature: Ceres ANNOT ID no. 8743902
  misc_feature (158)..(336): SWISSPROT Homolog: EC 2.5.1.62 Chlorophyll synthase
  misc_feature (121)..(399): Pfam ID: UbiA Pfam Description: UbiA prenyltransferase family
MDALRLRPSLLSAARPGAARPRDHFLPPCCSIQRNGEGRICFSSQRTQGPTLYHHQKFFDWKSSYCRISHQSLNTSVNASGQQLQSEPEAHDSTTIWRAISSSLDAFYRFSRPHTVIGTALSIVSVSLLAVQSLSDISPLFLTGLLQAVVAALFMNIYIVGLNQLFDIEIDKVNKPTLPLASGEYTPATGVAIVSVFAAMSFGLGWAVGSQPLFWALFISFVLGTAYSINLPYLRWKRFAVVAALCILAVRAVIVQLAFFLHIQTFVFRRPAVFSRPLIFATGFMTFFSVVIALFKDIPDIEGDRIFGIRSFSVRLGQKKVFWICVGLLEMAYSVALLMGATSSSLWSKTVTIAGHSILAGILWSCARSVDLTSKAAITSFYMFIWKLFYAEYLLIPLVR

SEQ ID NO: 20016 - DNA, 888 bp, Sorghum bicolor
  misc_feature: Ceres ANNOT ID no. 8743898
  misc_feature: Encodes the peptide sequence at SEQ ID NO 20017
atggcgacgatccagcacaagccggctccgacggcgccgtcgacgacgacgggcggcggcctgcgcgccatggacctgtacgagaagctggagaaagtcggggagggcacgtacgggaaggtgtacaaggcccgggagaaggcgacgggccgcatcgtggcgctcaagaagacgcggctccccgaggacgacgagggcgtgcccccgaccgcgctgcgggaggtgtcgctgctgcggatgctgtcgcaggacccgcacgtggtgcgcctgctcgacctcaagcagggcgtcaacaaggaagggcagaccatcttgtacctcgtcttcgagtacatggacaccgacctcaagaagttcatccggggctaccgcgccaaccacgagaagatccccgcacaaaccgtcaagatcctgatgtaccaactgtgcaagggcgtggctttcgtccacggccgcggggtgctgcaccgtgatctcaaaccccacaacctgctcatggaccgcaagaccatggcgctcaagatcgctgacctcggactcagccgtgccatcaccgtccctatgaagaagtacacacacgagattctgacgctgtggtacagggcgcctgaggttcttcttggcgccacacactactccacgccggttgacatttggttgctgggcaccccaaatgagcagatgtggccaggagtaggcaagctgcccaactggcacgtgtatcctcagtggaagcccactaagctgtgcactcttgtccctggtcttgactccgatggctatgatttgcttgagaaaatgctggcatatgagccggcgaagcggatctctgcgaagaaagccctggagcacccgtacttcaatggtgtgaacaaggaggtgtactga

SEQ ID NO: 20017 - protein, 295 aa, Sorghum bicolor
  misc_feature: Useful for making plants with modulated nitrogen use efficiency
  misc_feature: Functional homolog of the protein sequence given in SEQ ID NO 14265
  misc_feature: Useful for making plants with modulated growth rate
  misc_feature: Functional homolog of the protein sequence given in SEQ ID NO 14264
  misc_feature: Ceres ANNOT ID no. 8743898
  misc_feature (24)..(222): SWISSPROT Homolog: EC 2.7.11.22 Cyclin-dependent kinase
  misc_feature (27)..(287): Pfam ID: Pkinase Pfam Description: Protein kinase domain
MATIQHKPAPTAPSTTTGGGLRAMDLYEKLEKVGEGTYGKVYKAREKATGRIVALKKTRLPEDDEGVPPTALREVSLLRMLSQDPHVVRLLDLKQGVNKEGQTILYLVFEYMDTDLKKFIRGYRANHEKIPAQTVKILMYQLCKGVAFVHGRGVLHRDLKPHNLLMDRKTMALKIADLGLSRAITVPMKKYTHEILTLWYRAPEVLLGATHYSTPVDIWLLGTPNEQMWPGVGKLPNWHVYPQWKPTKLCTLVPGLDSDGYDLLEKMLAYEPAKRISAKKALEHPYFNGVNKEVY

SEQ ID NO: 20018 - DNA, 1296 bp, Sorghum bicolor
  misc_feature: Ceres ANNOT ID no. 8743976
  misc_feature: Encodes the peptide sequence at SEQ ID NO 20019
atgatgcaccaccaccctcagttcctgcttccgcgcctccactcgccgtcgtcgtcctcctcgtctgaggcggtggacatggacccccgcgtgtggggccgactgccgcagccgctggtggaccgcgtgctggcgtgcctaccgacgccgtccttcctccgcctccgggccgcctgccgccgcttctgcaacctcatctactcgtcgccgttcctccactcccacctcctcctctccccgcacctccccttcttcgccttcgccgtcccttccgcggggtacctcctcctgctcgaccccaccaggccggaggcgccctcctggtcccgcctcccgctgccgctgcccgcggcgcccggcgctggccaccaggcgttctccccggcggccgcgtccgcgggcctgctcgcgttcctgtcggacgcgtccggccacaagacgctgctcctcgccaaccccatcacgcgcctcctcgcgccgctgccgctctgccccaccgcgcgcctctcccccaccgtcggcctcgccgccggacccacctccttcatcgccgtcatcgccggcgacgaccttgtgtcccccttcgcggtcaagaacatctccgccgacacgttagtcgccgatgccgcctccgtcccaccctccggtttctgggccccgagttccatcctgccccgcctctcctccctcgaccctcgcgccggcatggctttcgcctccggaaggttctactgcatgagctcgtcgccgttcgcggtgcttgtgttcgacgtggcgaccaacgtctggagcaaggtgcagccgccgatgaggaggttcctgcggtcgccggcgctcgtggagttcggcggcgggagggagcgcgaggcgagggtggcgctggtctccgccgtcgagaagagccgcctcagcgtgccacggagcgtgcgcgtgtggacgctgcgcggcgggagcaacggcggcagcggggcgtggaccgagatggcgcggatgccgcccgacgtgcacgcacagtttgcggcggccgagggcgggcgcgggttcgagtgcgcggcgcacggcgacttcgtggtgctggcgccacgcgggcccgcgatccccgtgctcgtgttcgactcgcgccgcgacgagtggcggtgggcgccgccgtgcccgtacccgccgtacgccggggggatcgccgcgggaggtgccgggttcagggtgttcgcttacgagccacgcctggcgacgccggccatcggcctcctggacgccacggcgccggcggcctttttgcatgggatgcagggctag

SEQ ID NO: 20019 - protein, 431 aa, Sorghum bicolor
  misc_feature: Useful for biocontainment applications
  misc_feature: Functional homolog of the protein sequence given in SEQ ID NO 14758
  misc_feature: Ceres ANNOT ID no. 8743976
  misc_feature (30)..(77): Pfam ID: F-box Pfam Description: F-box domain
MMHHHPQFLLPRLHSPSSSSSSEAVDMDPRVWGRLPQPLVDRVLACLPTPSFLRLRAACRRFCNLIYSSPFLHSHLLLSPHLPFFAFAVPSAGYLLLLDPTRPEAPSWSRLPLPLPAAPGAGHQAFSPAAASAGLLAFLSDASGHKTLLLANPITRLLAPLPLCPTARLSPTVGLAAGPTSFIAVIAGDDLVSPFAVKNISADTLVADAASVPPSGFWAPSSILPRLSSLDPRAGMAFASGRFYCMSSSPFAVLVFDVATNVWSKVQPPMRRFLRSPALVEFGGGREREARVALVSAVEKSRLSVPRSVRVWTLRGGSNGGSGAWTEMARMPPDVHAQFAAAEGGRGFECAAHGDFVVLAPRGPAIPVLVFDSRRDEWRWAPPCPYPPYAGGIAAGGAGFRVFAYEPRLATPAIGLLDATAPAAFLHGMQG

SEQ ID NO: 20020 - DNA, 1059 bp, Sorghum bicolor
  misc_feature: Ceres ANNOT ID no. 8743973
  misc_feature: Encodes the peptide sequence at SEQ ID NO 20021
atgaacagccacgcggccggaacaagcaacggcggatccggggatgcggccgccgggggcgcggccaggaggaacaccaggatgcctaagtattccaagttcacacagcaggagctgccagcttgcaagccgattcttactccaaaatgggttgtctctgttttcttcatcgtcggagtcatctttgttcccattggtgttgtttcactgatagctgcaagagatgttgttgagattattgatcggtatgatgaggcatgtgtgccaggcaacatgactgatgacaagcttgcctacatccagaatgaaaccatatccaaagagtgcataaggaatcttacggttacaaaggatatgaagcagcctatttttgtgtattatgaactcgataacttctaccagaaccataggaggtatgtaaagagccgaaatgatgcacagctaagagatgctagtaaagctaaccagacatccgcttgtgaacctgagaagaccacggctaatgggcaaccaattgttccttgtggcctcattgcttggagcttgtttaatgatacatataattttactcgtggtactgagaacttgacagtggacaagaaagacatctcctggaagagtgatagggagcataaatttggtaaagatgtctatccgagcaacttccagaatggtgcacttaaaggtggagcaacacttaacccaaagatcccgttgagtgagcaagaggacctcatcgtttggatgcggactgcagcacttcctacattcagaaagttatatgggagaatacactttgacctcaaggagaatgacacaataacagtgagattgaataacaactacaatacatatagcttcggcggcaagaaaaaactggtcctctcaactgcaacctggcttggggggaagaacgactttcttggctttgcgtaccttatagttggcgggctctgcattttcctggcatttgcattcaccttgctgtacttcgtaaaaccaaggaaactgggagaccacaactacttatcctggaacagacaccctgcaggacgctaa

SEQ ID NO: 20021 - protein, 352 aa, Sorghum bicolor
  misc_feature: Useful for making plants with modulated nitrogen use efficiency
  misc_feature: Functional homolog of the protein sequence given in SEQ ID NO 13263
  misc_feature: Ceres ANNOT ID no. 8743973
  misc_feature (69)..(341): Pfam ID: CDC50 Pfam Description: LEM3 (ligand-effect modulator 3) family / CDC50 family
MNSHAAGTSNGGSGDAAAGGAARRNTRMPKYSKFTQQELPACKPILTPKWVVSVFFIVGVIFVPIGVVSLIAARDVVEIIDRYDEACVPGNMTDDKLAYIQNETISKECIRNLTVTKDMKQPIFVYYELDNFYQNHRRYVKSRNDAQLRDASKANQTSACEPEKTTANGQPIVPCGLIAWSLFNDTYNFTRGTENLTVDKKDISWKSDREHKFGKDVYPSNFQNGALKGGATLNPKIPLSEQEDLIVWMRTAALPTFRKLYGRIHFDLKENDTITVRLNNNYNTYSFGGKKKLVLSTATWLGGKNDFLGFAYLIVGGLCIFLAFAFTLLYFVKPRKLGDHNYLSWNRHPAGR

SEQ ID NO: 20022 - DNA, 507 bp, Sorghum bicolor
  misc_feature: Ceres ANNOT ID no. 8744007
  misc_feature: Encodes the peptide sequence at SEQ ID NO 20023
atggggcgtgggaaggtggagatgaagaggatcgagaacaaggtgagccggcaggtgaccttctccaagcgccgcaaggggctgctgaagaaagccgaggagctcgccgtgctctgcgacgtggacgtcggcgtcatcggcttctccgaacgcggcaagctgttcgactactcctcgccggccagcttggatgatctgattcaccggtacgaggcggccaccaacacgcaactctaccatcaggagctgcactacactgatcatcaggagcagcagcagcagatggccgcaaagatcagcaagctgcagcatgagtatcaacagcttgaggccagcttgaagacgtacacgggagaagacctgtcgtctctgacttcggtggccgaactcggcgagctcgagcagcagctcgagtcggctgtcggtaaagtacgtgcaagaaaggtagtatctctgttagtgatcctgattcctggtaaatactgtttctgcaagttgaagttttaa

SEQ ID NO: 20023 - protein, 168 aa, Sorghum bicolor
  misc_feature: The sequence is a functional homolog of SEQ ID NO 729 in the 10/666,642 US patent application
  misc_feature: The sequence is a functional homolog of SEQ ID NO 1701 in the 10/412,699 US patent application
  misc_feature: Useful for making plants with altered lignin content
  misc_feature: Functional homolog of the protein sequence given in SEQ ID NO 12944
  misc_feature: The sequence is a functional homolog of SEQ ID NO 1949 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: Ceres ANNOT ID no. 8744007
  misc_feature (9)..(59): Pfam ID: SRF-TF Pfam Description: SRF-type transcription factor (DNA-binding and dimerisation domain)
MGRGKVEMKRIENKVSRQVTFSKRRKGLLKKAEELAVLCDVDVGVIGFSERGKLFDYSSPASLDDLIHRYEAATNTQLYHQELHYTDHQEQQQQMAAKISKLQHEYQQLEASLKTYTGEDLSSLTSVAELGELEQQLESAVGKVRARKVVSLLVILIPGKYCFCKLKF

SEQ ID NO: 20024 - DNA, 954 bp, Sorghum bicolor
  misc_feature: Ceres ANNOT ID no. 8744020
  misc_feature: Encodes the peptide sequence at SEQ ID NO 20025
atggagcatggccgcacgcaaggtgcagctgctgaagatcgacggctactgcgccaccgtaccgctgccttggagtcctctgagtacatcaaatccaaatggattgtcgatggccacgagtgggaggtccgtttctatcctacctatacctacgacgactactgcggaaattgctcccaaataattaatggggtagctctaaagctcagtcttctcagtgaaccccacagaggaacaaggccttgtttagttctcaaaaattttgcgatttgtacatccaatgatccaaccagctatcttgatccttctgctgaggagagtgcgacgtcgaaactgcctgacgtagtcatcccagctaataccgaggagccacttcctccctctgatgatctgcaccgtcacctcggtgagctctggcggggccagcagggggcagacgtcacatttgtgctcgagtctggcgagcgttttgtcgcgcacaaagccattcttgccgcgaggtctcctgtcttcatggccgagttcttcggtggcatgaacgagaggagctctcagactgtcaggatcgaggacatggacgatgatgtcttcaaggccatgcttcacttcatctacaccgacagggctccggagcttgatgaggagcctgatgtggcggtgaccatggctcagcacttactcgtagctgccgacaggtatgggcttgataggctgaagctgatctgtggaagcaagctcgctggtggcatcagcattgatactgttgcgacgacgttggctgtagctgagcagcacagctgctctctgctgaaggccaagtgcgtggatttcattgccagatcgcctgaaactcttgatgctgtcctggcgaccgagggctataatcatctggtggagagccatcccttggtgttgactgaacttctaagggctgcgcatggaagaaggatctga

SEQ ID NO: 20025 - protein, 317 aa, Sorghum bicolor
  misc_feature: Useful for making plants with modulated biomass
  misc_feature: Functional homolog of the protein sequence given in SEQ ID NO 12898
  misc_feature: Ceres ANNOT ID no. 8744020
  misc_feature (135)..(250): Pfam ID: BTB Pfam Description: BTB/POZ domain
MEHGRTQGAAAEDRRLLRHRTAALESSEYIKSKWIVDGHEWEVRFYPTYTYDDYCGNCSQIINGVALKLSLLSEPHRGTRPCLVLKNFAICTSNDPTSYLDPSAEESATSKLPDVVIPANTEEPLPPSDDLHRHLGELWRGQQGADVTFVLESGERFVAHKAILAARSPVFMAEFFGGMNERSSQTVRIEDMDDDVFKAMLHFIYTDRAPELDEEPDVAVTMAQHLLVAADRYGLDRLKLICGSKLAGGISIDTVATTLAVAEQHSCSLLKAKCVDFIARSPETLDAVLATEGYNHLVESHPLVLTELLRAAHGRRI

SEQ ID NO: 20026 - DNA, 207 bp, Sorghum bicolor
  misc_feature: Ceres ANNOT ID no. 8744047
  misc_feature: Encodes the peptide sequence at SEQ ID NO 20027
atgagagggtttgagagaaaaggggtccggcagtacaaccgatcagaggtgccgcggatgcggtggacggaggagctgcaccggcagttcgtcgaggccgtcgagtgcctcggtggccaggacggtgagtcgccttccaataccttccttctccttcgactgcatgcatgcatgagacatgctccagctagcctctgcatgttttga

SEQ ID NO: 20027 - protein, 68 aa, Sorghum bicolor
  misc_feature: The sequence is a functional homolog of SEQ ID NO 1339 in the 10/374,780 US patent application
  misc_feature: Ceres ANNOT ID no. 8744047
MRGFERKGVRQYNRSEVPRMRWTEELHRQFVEAVECLGGQDGESPSNTFLLLRLHACMRHAPASLCMF

SEQ ID NO: 20028 - DNA, 1341 bp, Sorghum bicolor
  misc_feature: Ceres ANNOT ID no. 8744059
  misc_feature: Encodes the peptide sequence at SEQ ID NO 20029
atgagggagatcctccacatccagggcgggcagtgcgggaaccagatcggggccaagttctgggaggtgatctgcgacgagcacggcatcgaccacaccggcaagtacgccggcgactccgacctccagctcgagcgcatcaacgtctactacaacgaggccagcggcggacgctacgtcccgcgcgccgtcctcatggacctcgagccggggaccatggactccgtgcgctcgggccccttcggccagatcttccgccccgacaacttcgtcttcggccaatccggcgccggaaacaactgggccaagggacactacaccgagggcgccgagctcatcgactccgtgctcgatgtcgtgcgcaaggaggccgagaactgcgactgcctacaagggttccaggtctgccactcgctgggaggaggtactggttcaggaatgggcaccctgctcatctccaagatcagggaggagtacccggaccgcatgatgttgacattctctgtcttcccgtcgcccaaggtgtctgatactgtcgtggagccctacaacgccacgctctctgttcaccagctggttgagaacgctgatgagtgcatggtgctcgacaacgaggctctctatgacatctgcttccgcacgctcaagcttgctacaccaacctttggtgatctcaaccacctcatctctgcaaccatgagtggtgttacgtgctgccttcgcttccctggtcagctcaactctgacctccggaagcttgctgtgaacctgatccccttcccgcgtctccacttcttcatggttggatttgctccactgacctcgcggggctcccagcagtaccgtgccctcactgtgccagagctgacccagcagatgtgggactccaagaacatgatgtgtgctgctgaccctcgccacggccgctacctcacagcgtctgctatgttccgtgggaagatgagcaccaaggaagtggatgaacagatgctgaacgttcagaacaagaactcttcctactttgtggagtggatccccaacaatgtgaagtcgagcgtgtgcgacatcccacccattgggctgaagatgtcctcaacattcatcggcaactccacctccatccaggagatgttccgccgcgtcagtgagcagttcacagctatgttcaggaggaaggccttcttgcattggtacactggtgagggcatggatgagatggagttcaccgaggccgagagcaacatgaacgacctggtggctgagtaccagcagtaccaggatgccacggccgaggacgatgaggagtatgaggaggaagaagaggaagagcacgctgactaa

SEQ ID NO: 20029 - protein, 446 aa, Sorghum bicolor
  misc_feature: Useful for making plants with modulated flowering time
  misc_feature: Functional homolog of the protein sequence given in SEQ ID NO 14090
  misc_feature: Ceres ANNOT ID no. 8744059
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in root tissues in response to methyl jasmonate treatment
  misc_feature: Down-regulated in shoot tissues in response to salicylic acid treatment
  misc_feature (45)..(244): Pfam ID: Tubulin Pfam Description: Tubulin/FtsZ family, GTPase domain
  misc_feature (246)..(383): Pfam ID: Tubulin_C Pfam Description: Tubulin/FtsZ family, C-terminal domain
MREILHIQGGQCGNQIGAKFWEVICDEHGIDHTGKYAGDSDLQLERINVYYNEASGGRYVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMLNVQNKNSSYFVEWIPNNVKSSVCDIPPIGLKMSSTFIGNSTSIQEMFRRVSEQFTAMFRRKAFLHWYTGEGMDEMEFTEAESNMNDLVAEYQQYQDATAEDDEEYEEEEEEEHAD

SEQ ID NO: 20030 - DNA, 756 bp, Sorghum bicolor
  misc_feature: Ceres ANNOT ID no. 8744064
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 20031
atgcaggtcggaggaggagcggccgacagccccggcgcggcggcgggcgcggaggcgccccgcccgagccgctacgagtcgcagaagcggcgggactggcacacgttcgggcagtacctgcgcaaccaccggccgccgctggagctggcgcggtgcagcggcgcgcacgtgctcgagttcctgcgctacctggaccagttcggcaagaccaaggtccacgcgccggggtgccccttcttcggccacccgtcgccgccggccccgtgcccgtgcccgctgcgccaggcctggggcagcctcgacgcgctcgtcggccgcctgcgcgccgccttcgaggagcacgggggacggcctgaggccaaccccttcggcgcgcgcgccgtgcgcctatacctccgcgaggccgcgacgaccccgccgcagcaggctcctcccgtctcctcgccggccctgtcggacgtggtgcccgagagggccgacgtgcgggcgcacgtgccggacgccgggcaccagcagcaccatcacctgcaccagcaccagcaccagcatcacttcttcatgccacacccgcagttcctgcacgggttcagcctgctgccgggcaaccccgaagcggtggctgccaatggcaacggcggcggcagcagcagcgctagcgtcgctgccggcaacggtgacgagatagcgctggcgatggcggcggcggcggaggcgcacgcggcggggtgcatgctgccgctgtcggtgttcaactag

SEQ ID NO: 20031 - protein, 251 aa, Sorghum bicolor
  misc_feature: Useful for making plants with modulated low light sensitivity
  misc_feature: Functional homolog of the protein sequence given in SEQ ID NO 14143
  misc_feature: Useful for making plants with modulated nitrogen use efficiency
  misc_feature: Functional homolog of the protein sequence given in SEQ ID NO 13437
  misc_feature: Useful for making plants with modulated flowering time
  misc_feature: Functional homolog of the protein sequence given in SEQ ID NO 13982
  misc_feature: Useful for making plants with modulated biomass
  misc_feature: Functional homolog of the protein sequence given in SEQ ID NO 13338
  misc_feature: Useful for biocontainment applications
  misc_feature: Functional homolog of the protein sequence given in SEQ ID NO 13983
  misc_feature: Ceres ANNOT ID no. 8744064
MQVGGGAADSPGAAAGAEAPRPSRYESQKRRDWHTFGQYLRNHRPPLELARCSGAHVLEFLRYLDQFGKTKVHAPGCPFFGHPSPPAPCPCPLRQAWGSLDALVGRLRAAFEEHGGRPEANPFGARAVRLYLREAATTPPQQAPPVSSPALSDVVPERADVRAHVPDAGHQQHHHLHQHQHQHHFFMPHPQFLHGFSLLPGNPEAVAANGNGGGSSSASVAAGNGDEIALAMAAAAEAHAAGCMLPLSVFN

SEQ ID NO: 20032 - DNA, 1071 bp, Sorghum bicolor
  misc_feature: Ceres ANNOT ID no. 8744050
  misc_feature: Encodes the peptide sequence at SEQ ID NO 20033
atggacgtgaagggtagtggtggccggccgccggcggtgcagctgcagtccacgacgaagcgccgggctgcgagctcaccatggggacttcagaaagcgacgcttttactggcataccagagcttcggagttgtgtatggcgatctctgcatttcacctgtctatgtgtacaagaacaccttctctgggaagctgcgtctgcatgaggaggacgaggagatccttggggtgctgtcactcgtcttctggagcctgacgctcataccactgctcaaatacataatccttgttcttggagcagatgacgatggagaaggtggcacatttgcattgtactcgctaatgtgcaggcgctcaaggatggggctcctgaacaatataaacaatgggtgtttatcggtatacaaccagaaggaacctcgtgaggagctaaggagtagtttggcgataaaatctttcatcgagaagcattactcgcttcgtgtggtgctgctgctcttcgttctgatgggtactagtatggttattggggatggcgtcttcaccccaacaatgtcagttctatcggcagtttctggactcagaattaagtttccagaattacatgaaaattacactgtgctttttgcctgtttcattttagttgtcctttttgcgctgcaacactacggaacccaccgtgttgggttcctatttgctccaattttgcttgcctggcttggctgcattggcggtatcggcatatacaacatattcaagtggaaccgtactgtcatccgtgctctgtccccatactacatatacaacttcttcaggaaggccggcaaggatggctggagctcactgggagggattgttctatgcattacaggtgctgaagcaatgtttgctgaccttgggcatttctcaaaactttcactaaggcttggattcacaatagttgtctatccatgcttagtcctggcttacatgggtgaggctgcttatctgtctaaacatagggaggacctacaaagcagcttttacaaagctctcccaggtgaggtggcaatgttttgccggactgactga

SEQ ID NO: 20033 - protein, 356 aa, Sorghum bicolor
  misc_feature: Useful for making plants with modulated biomass
  misc_feature: Functional homolog of the protein sequence given in SEQ ID NO 13565
  misc_feature: Ceres ANNOT ID no. 8744050
  misc_feature (36)..(356): Pfam ID: K_trans Pfam Description: K+ potassium transporter
MDVKGSGGRPPAVQLQSTTKRRAASSPWGLQKATLLLAYQSFGVVYGDLCISPVYVYKNTFSGKLRLHEEDEEILGVLSLVFWSLTLIPLLKYIILVLGADDDGEGGTFALYSLMCRRSRMGLLNNINNGCLSVYNQKEPREELRSSLAIKSFIEKHYSLRVVLLLFVLMGTSMVIGDGVFTPTMSVLSAVSGLRIKFPELHENYTVLFACFILVVLFALQHYGTHRVGFLFAPILLAWLGCIGGIGIYNIFKWNRTVIRALSPYYIYNFFRKAGKDGWSSLGGIVLCITGAEAMFADLGHFSKLSLRLGFTIVVYPCLVLAYMGEAAYLSKHREDLQSSFYKALPGEVAMFCRTD

SEQ ID NO: 20034 - DNA, 924 bp, Sorghum bicolor
  misc_feature: Ceres ANNOT ID no. 8744117
  misc_feature: Encodes the peptide sequence at SEQ ID NO 20035
atggccatcaactcgctgagcatggtggaggccaggctgccgccggggttcaggttccacccgcgggacgacgagctcgtgctcgactacctcgccaagaagctcgccggcggcgccggagtcggcggaggcccgctggtggtgagcatctacggctgccccgccatggtcgacgtcgatctcaacaagtgcgagccctgggaccttcccgaaatcgcgtgcattggtggaaaagagtggtatttctacagccttagagatagaaagtatgccaccggccagcgtacaaacagagcaactgattcaggatattggaaggccacggggaaagaccgtccaataagccggaaagggttacttgttggtatgcgcaaaactcttgtgttttatcaaggtagagccccaaaggggaagaagaccgagtgggttatgcatgaatttcgcatggaagggcaaggtgatcccatgaaattacctttcaaggaggactgggtcttgtgtagagttttctacaagagtagggcaacagttgcaaagccacccacagagagtagcagcagcttcaatattgatgctgccacaacttcattgcctcccctcattgacaacaactacaatatttcctttgatcagcctggctcatcagtgcaaaacctagagggttatgagcaagtgccctgcttctccagtaacccctctcagctatcgtcatcgataaacgctccgctgtcgtctgccgccaccatggctgatccggagcaacacatggggaagtcaataatcaaggatgttctcatgagccagttcagcaggttcgaagcaggcaacgtcaagagggaggcgcctcaaagcaatttttctcaggatgggtttgagtacttagctgagagtggattcacacagatgtggaattctttcaattaa

SEQ ID NO: 20035 - protein, 307 aa, Sorghum bicolor
  misc_feature: Useful for making plants with altered lignin content
  misc_feature: Functional homolog of the protein sequence given in SEQ ID NO 12985
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: Useful for making plants with altered terpenoid content
  misc_feature: Functional homolog of the protein sequence given in SEQ ID NO 13140
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with modulated light quality sensitivity
  misc_feature: Functional homolog of the protein sequence given in SEQ ID NO 13618
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 1198 in the 10/412,699 US patent application
  misc_feature: The sequence is a functional homolog of SEQ ID NO 867 in the 10/374,780 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: Ceres ANNOT ID no. 8744117
  misc_feature (13)..(150): Pfam ID: NAM Pfam Description: No apical meristem (NAM) protein
MAINSLSMVEARLPPGFRFHPRDDELVLDYLAKKLAGGAGVGGGPLVVSIYGCPAMVDVDLNKCEPWDLPEIACIGGKEWYFYSLRDRKYATGQRTNRATDSGYWKATGKDRPISRKGLLVGMRKTLVFYQGRAPKGKKTEWVMHEFRMEGQGDPMKLPFKEDWVLCRVFYKSRATVAKPPTESSSSFNIDAATTSLPPLIDNNYNISFDQPGSSVQNLEGYEQVPCFSSNPSQLSSSINAPLSSAATMADPEQHMGKSIIKDVLMSQFSRFEAGNVKREAPQSNFSQDGFEYLAESGFTQMWNSFN

SEQ ID NO: 20036 - DNA, 996 bp, Sorghum bicolor
  misc_feature: Ceres ANNOT ID no. 8744201
  misc_feature: Encodes the peptide sequence at SEQ ID NO 20037
atggtgagaagaatggtgctggtggcggcgctggtggtggccaccgtcgccgtcctcgccggcggcgcgcgggcgcagctcaaggaagggttctacggctccacctgcccgcaggcggagaagatcgtcaaggagttcgtcaaggcgcacatcccgcacgcgcctgacgtcgccgccaccctgatccgcacccacttccacgactgcttcgtcaggggctgcgacgcgtcggtgctgctcaacgcgacgggcggcaaggaggcggagaaggacgcggcgcccaaccagacgctgcggggcttcggcttcatcgaccgcatcaaggcgctgctcgagaaggagtgccccggcgtcgtgtcctgcgccgacatcctcgcgctcgccgcccgcgactccgtcggcgtcatcggcgggccgttctggagcgtgccgacggggaggcgcgacggcaccgtgtccatcaagcaggaggcgctggaccagatccccgcgcccaccatgaacttcaccacactcctccagtccttccgcaacaagagcctcgacctcgccgacctcgtctggctctcaggggctcacacgatcggcatctcccactgcaactccttcagcgagcggctgtacaacttcacggggcgcgccgttcccggggacgcggacccgtcgctggacccgctgtacgcggcgaagctgcggcggaagtgcaagacgctgacggacaacacgacgatcgtggagatggacccggggagcttccgcaccttcgacctcagctactaccgcggcgtgctcaagcggcggggcctgttccagtccgacgccgcgctcatcaccgacgccgcctccaaggccgacatcctcagcgtggtgaacgcgccgcccgaggtgttcttccaggtcttcgcgcgctccatggtgaagatgggcgccatcgacgtcaagaccggctccgagggcgagatcaggaagcactgcgccttcgtcaacaagcactag

SEQ ID NO: 20037 - protein, 331 aa, Sorghum bicolor
  misc_feature: Useful for making plants with altered carbohydrate content
  misc_feature: Functional homolog of the protein sequence given in SEQ ID NO 14507
  misc_feature: Useful for making plants with altered cell wall content and/or composition
  misc_feature: Functional homolog of the protein sequence given in SEQ ID NO 14262
  misc_feature: Useful for making plants with modulated phosphate use efficiency
  misc_feature: Functional homolog of the protein sequence given in SEQ ID NO 13134
  misc_feature: Useful for making plants with modulated nitrogen use efficiency
  misc_feature: Functional homolog of the protein sequence given in SEQ ID NO 13758
  misc_feature: Useful for making plants with modulated oxidative stress sensitivity
  misc_feature: Functional homolog of the protein sequence given in SEQ ID NO 13607
  misc_feature: Ceres ANNOT ID no. 8744201
  misc_feature (26)..(329): SWISSPROT Homolog: EC 1.11.1.7 Peroxidase
  misc_feature (43)..(292): Pfam ID: peroxidase Pfam Description: Peroxidase
MVRRMVLVAALVVATVAVLAGGARAQLKEGFYGSTCPQAEKIVKEFVKAHIPHAPDVAATLIRTHFHDCFVRGCDASVLLNATGGKEAEKDAAPNQTLRGFGFIDRIKALLEKECPGVVSCADILALAARDSVGVIGGPFWSVPTGRRDGTVSIKQEALDQIPAPTMNFTTLLQSFRNKSLDLADLVWLSGAHTIGISHCNSFSERLYNFTGRAVPGDADPSLDPLYAAKLRRKCKTLTDNTTIVEMDPGSFRTFDLSYYRGVLKRRGLFQSDAALITDAASKADILSVVNAPPEVFFQVFARSMVKMGAIDVKTGSEGEIRKHCAFVNKH

SEQ ID NO: 20038 - DNA, 1299 bp, Sorghum bicolor
  misc_feature: Ceres ANNOT ID no. 8744211
  misc_feature: Encodes the peptide sequence at SEQ ID NO 20039
atggccattctgtggtggacggcgctcaagaggtccctgagctgcaagtcccagggctcctgcgacgtgatcaagcgcgacgaccccgactcgcgcggcggcagcgccagggaattcaaccacaagaagccgtcgttcctgctgcagccgtcgtcgttgtcgatgccgaggtccgggtgctcgcgctccatctccaacctgcgggacgtgatccacagcgccaggttccaggcgccaccggcaccggccgctcgcgccaagtgcgacagcccgatgtcggtggagagcggcgacgtcctcagcgcggtgacgacgcacgacgtgctgctcgccaccgggtcccggcgcgacgtccttgtcggcgccggcgccgtcgcctccccgggcctcgccgcctgggacatcggcgcggtgccgccgttcgcgcacagcccgctcctgacgcggtgcgccaccggcgcccgtctctcccagaggaagtcaccgctccgcctcggaacaggcgtctacggcgacgccgggtcgccccttcccgcctgggcctcctgcgtcgaggtcgccgtccggtgcaaccgctgcgacggcctcttccccaacgacagcgccctggaatcgcatcacctcgtctaccacgccgtctccgaggtggtcgacggcgagacggcgagcaaggtggtggagctcatatacagtgccgggtggccgaatcccgaggcggcgctggaccgcgtcgagcgagtcgtcaaggtccacagcttggagaggcgggtggaccggttcaaggagtacatggaggaggtgaagggcagggcggcgaagctgcccaacaacaacaagcacccccgctgcgtcgccgacggcaacgagctgctccagttccatggcaccaccgtgtcctgctccctcggcgccggcggctcgcacagcgtctgcacgtccagcctctgcaacgtctgccgcatcatccgccacggcttctccaggaacggcggcgtcggcgtgttcaccacctccacgagcaagcacgcgctggattgcctgcaggagaccggcgccgccggcggtggcactggcgaggatgggccggccgacggcggcgtgaagcacgcgttgttcgtgtgcagggtgatcgcggggaggatccaccgcccgctggagaagctgaggcaggacgccgccgtgcagccggggttcgactcggttgccggccaggtcggcggcgattcgagcatcgaggagctgtacctgctcaacccgagcgctcttctcccgtgcttcgtggtcatatgtaaagcttag

SEQ ID NO: 20039 - protein, 432 aa, Sorghum bicolor
  misc_feature: The sequence is a functional homolog of SEQ ID NO 1546 in the 10/666,642 US patent application
  misc_feature: Ceres ANNOT ID no. 8744211
MAILWWTALKRSLSCKSQGSCDVIKRDDPDSRGGSAREFNHKKPSFLLQPSSLSMPRSGCSRSISNLRDVIHSARFQAPPAPAARAKCDSPMSVESGDVLSAVTTHDVLLATGSRRDVLVGAGAVASPGLAAWDIGAVPPFAHSPLLTRCATGARLSQRKSPLRLGTGVYGDAGSPLPAWASCVEVAVRCNRCDGLFPNDSALESHHLVYHAVSEVVDGETASKVVELIYSAGWPNPEAALDRVERVVKVHSLERRVDRFKEYMEEVKGRAAKLPNNNKHPRCVADGNELLQFHGTTVSCSLGAGGSHSVCTSSLCNVCRIIRHGFSRNGGVGVFTTSTSKHALDCLQETGAAGGGTGEDGPADGGVKHALFVCRVIAGRIHRPLEKLRQDAAVQPGFDSVAGQVGGDSSIEELYLLNPSALLPCFVVICKA

SEQ ID NO: 20040 - DNA, 912 bp, Sorghum bicolor
  misc_feature: Ceres ANNOT ID no. 8744225
  misc_feature: Encodes the peptide sequence at SEQ ID NO 20041
atgacgcgcagcatccatcaccacacggcgaagcgcagccgcgaacgcggacacgctccctcccgccatcccgcgcggaggagcccaaggaggccgaaacgcgcaggaaggcgcgcgcgcgcgctgcggttcgcccgtccagcccagggccagccaagccaagccaacgccaacgtccccgccagagccaccccacgcgaaccaaccgggggtcggggagggataccaatcgctcgatcacgcacacgtgacccccatccaccagcggcctccgcgtcccgcaggggcaggcaggcaccttccctgaagaagccccagcccggcaggcgccagccgtccccgtcgccacgcctatttattctcccccttgccatcccccgctcccatcccctcgtcgtcctcctcttccacaatccacattccacaccgagaaaagaacaagcagccgccaccggagctcacaatcagaatcatccgccgccgtaccaagagtccatccaccttctacaatctacacacatggcgtcgcaccagcagcagcaggcgggagcggcagcagcggcggcgtccgtggacttcgaggactacctgccggtgatggcggagcgtctaggcgaggacgggctgatgcgggagctggcgagcgggttccgcctgctcatggacccggcgcgggggctcatcacgttcgacagcctccgccgcaacgcgccgctgctggggctgggcggcatgtccgacgccgacctccgcgggatgctcgccgagggcgacttcgacggcgacggcgcgctcagcgagatggagttctgcgtcctcatggtccgcctcagccccgagctcatggacgagcctcgcaggtggctcgacgacgccgtcgaccaggcgtcccgcttcctcttcaccagctga

SEQ ID NO: 20041 - protein, 303 aa, Sorghum bicolor
  misc_feature: Useful for making plants with altered glycerol content
  misc_feature: Functional homolog of the protein sequence given in SEQ ID NO 13517
  misc_feature: Ceres ANNOT ID no. 8744225
  misc_feature (249)..(277): Pfam ID: efhand Pfam Description: EF hand
MTRSIHHHTAKRSRERGHAPSRHPARRSPRRPKRAGRRARALRFARPAQGQPSQANANVPARATPREPTGGRGGIPIARSRTRDPHPPAASASRRGRQAPSLKKPQPGRRQPSPSPRLFILPLAIPRSHPLVVLLFHNPHSTPRKEQAAATGAHNQNHPPPYQESIHLLQSTHMASHQQQQAGAAAAAASVDFEDYLPVMAERLGEDGLMRELASGFRLLMDPARGLITFDSLRRNAPLLGLGGMSDADLRGMLAEGDFDGDGALSEMEFCVLMVRLSPELMDEPRRWLDDAVDQASRFLFTS

SEQ ID NO: 20042 - DNA, 1392 bp, Sorghum bicolor
  misc_feature: Ceres ANNOT ID no. 8744312
  misc_feature: Encodes the peptide sequence at SEQ ID NO 20043
atggagtcagtcgccgtggtgaccgttcccttcccggcgcagggccacctgaaccagctcctgcacctgtcgctgcagctcgcgtcgcggggcctgcccgtgcactacgcggcgcccgcggcgcaggtccgccaggcccgcgcgcgcgtgcacggctgggacgaggacgcgctccgctccgtcgagttccacgagctcggcatctccgagtacgtctccccgccgcccgaccccaccgcgccctcgcccttccccacgcacctcatgcccctgttcgaggcctacaccgccggcgcgcgcgccccgctcgcggcgctcctcgccaggctctccgcctcgcaccgccgcgtggtcgtggtgcacgaccgcgtcaacgtgtacgccggcgaggaggccgcgcggctgcccaacggcgaggcgttcgggctccactgcctggcggcgtcgacgctcgccgtgacgacgggcgccgggctccgtctcctgcgtgagcgcggcctggcgttcctcgacttcgcgcactccacgtcgagggagttcgcggagtacgtcgccaaacgcgcgatgccgaccaaggagatctcgcctggcgcgggcatcctcgtgaactcatgtcgcacgctcgagggcgagttcgtggacgtcgttgcaggcgaccttgccgccgacggcaagaagtacttcgccatcgggcccttaaacccactgctcctccacctccgcgcggactcccagaagccgcgtcacgagtgcctggactggctggacaagcagccaccggattcggttctctacgtgtcgttcggcacgacatcgtcgctgcagacggagcagatcgcagagcttgcagcagcgctgcgcgacagcgaccagcggttcgtctgggtggtgcgcgacgcagaccgcggcaacgaatcggcggacgacgacgagagccagaacaacagacacgcggagctgctgtccaagttcaccaaccagacccgagggaggggcagggtgatcaccgggtgggcgccgcagctggagatactggcgcacggcgccacggcggccttcatgagccactgcggctggaactcgactatggagagcctgagcaacgggaagcctatccttgcgtggcccatgcactccgaccagccgtgggatgcggagctggtgtgcaagtatctcaacgccggcatccttgtgcgcccctgggagaagcacggtgaggtgattccggcggaggccatcagacaagtaatcgaggttgccatgctttctgaccaaggagtggcagtgcggcagcgagccaaggtgctcggagaggccgtccgtgcctgcctgactgacggcggctcatcgcgcaaagaccttgatgatttcattgctcatatcacaaagtaa

SEQ ID NO: 20043 - protein, 463 aa, Sorghum bicolor
  misc_feature: The sequence is a functional homolog of SEQ ID NO 8 in US patent 7148405
  misc_feature: Ceres ANNOT ID no. 8744312
  misc_feature (1)..(463): SWISSPROT Homolog: EC 2.4.1.215 Cis-zeatin O-beta-D-glucosyltransferase
  misc_feature (5)..(463): Pfam ID: UDPGT Pfam Description: UDP-glucoronosyl and UDP-glucosyl transferase
MESVAVVTVPFPAQGHLNQLLHLSLQLASRGLPVHYAAPAAQVRQARARVHGWDEDALRSVEFHELGISEYVSPPPDPTAPSPFPTHLMPLFEAYTAGARAPLAALLARLSASHRRVVVVHDRVNVYAGEEAARLPNGEAFGLHCLAASTLAVTTGAGLRLLRERGLAFLDFAHSTSREFAEYVAKRAMPTKEISPGAGILVNSCRTLEGEFVDVVAGDLAADGKKYFAIGPLNPLLLHLRADSQKPRHECLDWLDKQPPDSVLYVSFGTTSSLQTEQIAELAAALRDSDQRFVWVVRDADRGNESADDDESQNNRHAELLSKFTNQTRGRGRVITGWAPQLEILAHGATAAFMSHCGWNSTMESLSNGKPILAWPMHSDQPWDAELVCKYLNAGILVRPWEKHGEVIPAEAIRQVIEVAMLSDQGVAVRQRAKVLGEAVRACLTDGGSSRKDLDDFIAHITK

SEQ ID NO: 20044 - DNA, 1578 bp, Sorghum bicolor
  misc_feature: Ceres ANNOT ID no. 8744316
  misc_feature: Encodes the peptide sequence at SEQ ID NO 20045
atgatgaagtcgctgctgccgcagagccagctgcggagctcgtcggcggcggccgcgcggtcgtcgtcgggcggcggcgcagcggggggagacggggctatggccgacggcgacggcgcgggcccgcgggcgccggcctcctccaccttctggttcctgctccacgcgctctgctgcctcatctcgctcttcctcggcttccgcttctcgcggctcctcttcttcctgctcttctccaccaccgcgctctaccactccaccacctcgtcctcctcggccgcggtcctgcgcgccaccacgactaccaccacaacgacgacaaccacgacgacgaccaccaacaccttcacgctctccttcgccgccgccaacactcccccttccggccccgctaaccgcaccgcgctggaggcggcgggcgacaacaaggggagccacgtcgtggtggggaggcacgggattcggatccggccgtggccgcacccggaccccgtcgaggtgatgcgcgcgcaccggatcatggagcgcgtgcaggaggagcagcggcgctggtacggcgtcaaggagcccaggcaggtgcttgtcgtcaccccgacctactcccgtgcgttccaggcgctccacctcaccggcctcctccactccctccgcaacgtgccgtacccgctcacctggatcgtcgtcgaggcaggcggcaccaccaacgccacggcgtcgatgctggcgcgctctggcctcactttcgtccacatccccttccctgaccgcatgcctcatgaatgggccgaccgccacgccactgagaaccggatgcgcctccacgccctacgcgtgatccgtgagaggaagatggatggtgtggttgtgtttgcggacgacagcaatgttcatagcatggagctgttcgatgaggtgcagaaggtccagtggatgggtgctgtatccgttggaatccttgcgcatactggaacggcagatcaactacggctaagcgaggaggacaagcagaatatgcctcttccagtccagggccctgcttgcaactcctcagggcatctggctggatggcacacgttcaactcactgcccttctctgggaagaccgccacagtggttggtgaggcagcccctgttctgcccaggggtttggagtgggctggttttgtgctgaactcgagaatgctgtggaaggaggctgatggcaagcctgactgggtgaaggatcttgatgctgtgggcgagaatggagaggagattgagaacccacttgctctattgaatgatccatcctctgttgagccactagggaactgtgggaagaaggtccttctgtggtggctccgtgttgaagcacgggctgatagcaagtttcctcaggggtgggtgattgagccgcctttggaagtcgtcgtccctgcaaagcgcactccatggcctgaaaccaccaccgagcttccatccgagttgttggatgacaagcaagagcaggaggatagacggctgtctagagccaacaaatcatctcggccccgaggcaccacgaaacggaaggctgaccctcaagggcaagaaaactga

SEQ ID NO: 20045 - protein, 525 aa, Sorghum bicolor
  misc_feature: Useful for making plants with altered carbohydrate content
  misc_feature: Functional homolog of the protein sequence given in SEQ ID NO 14759
  misc_feature: Ceres ANNOT ID no. 8744316
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature (189)..(319): SWISSPROT Homolog: EC 2.4.1.135 Galactosylgalactosylxylosylprotein 3-beta-glucuronosyltransferase
  misc_feature (212)..(451): Pfam ID: Glyco_transf_43 Pfam Description: Glycosyltransferase family 43
MMKSLLPQSQLRSSSAAAARSSSGGGAAGGDGAMADGDGAGPRAPASSTFWFLLHALCCLISLFLGFRFSRLLFFLLFSTTALYHSTTSSSSAAVLRATTTTTTTTTTTTTTTNTFTLSFAAANTPPSGPANRTALEAAGDNKGSHVVVGRHGIRIRPWPHPDPVEVMRAHRIMERVQEEQRRWYGVKEPRQVLVVTPTYSRAFQALHLTGLLHSLRNVPYPLTWIVVEAGGTTNATASMLARSGLTFVHIPFPDRMPHEWADRHATENRMRLHALRVIRERKMDGVVVFADDSNVHSMELFDEVQKVQWMGAVSVGILAHTGTADQLRLSEEDKQNMPLPVQGPACNSSGHLAGWHTFNSLPFSGKTATVVGEAAPVLPRGLEWAGFVLNSRMLWKEADGKPDWVKDLDAVGENGEEIENPLALLNDPSSVEPLGNCGKKVLLWWLRVEARADSKFPQGWVIEPPLEVVVPAKRTPWPETTTELPSELLDDKQEQEDRRLSRANKSSRPRGTTKRKADPQGQEN

SEQ ID NO: 20046 - DNA, 1392 bp, Sorghum bicolor; identical to SEQ ID NO: 20042
  misc_feature: Ceres ANNOT ID no. 8744308
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 20047

SEQ ID NO: 20047 - protein, 463 aa, Sorghum bicolor; identical to SEQ ID NO: 20043
  misc_feature: The sequence is a functional homolog of SEQ ID NO 8 in US patent 7148405
  misc_feature: Ceres ANNOT ID no. 8744308
  misc_feature (1)..(463): SWISSPROT Homolog: EC 2.4.1.215 Cis-zeatin O-beta-D-glucosyltransferase
  misc_feature (5)..(463): Pfam ID: UDPGT Pfam Description: UDP-glucoronosyl and UDP-glucosyl transferase

SEQ ID NO: 20048 - DNA, 393 bp, Sorghum bicolor
  misc_feature: Ceres ANNOT ID no. 8744337
  misc_feature: Encodes the peptide sequence at SEQ ID NO 20049
atggcgaaggctgccgccgccgctctgctcgtcgccgccctgctcggctgccttgtctcggcgtcgctcgccgaccagggcaccgccacctactacaccgtctacactccgtcggcgtgctacgggtaccaggacgagggcacgatgatcgcggcggcgagcgacgggctgtgggacaacggcgcggcgtgcgggcggatgtaccaggtgtcctgcgccggcggcaccaacgccaccccgaacccctgcaaaggcggcagcgtcaccgtcaagatcgtcgaccgctgcccgtcgccgggatgccaggccacgctcgacctctcccaggaggccttcaacaccatcggcaacctcgacgccggcaagatcctcatcaactacaaccaggtgtaa

SEQ ID NO: 20049 - protein, 130 aa, Sorghum bicolor
  misc_feature: Useful for making plants with altered cell wall content and/or composition
  misc_feature: Functional homolog of the protein sequence given in SEQ ID NO 14322
  misc_feature: Ceres ANNOT ID no. 8744337
  misc_feature (50)..(127): Pfam ID: DPBB_1 Pfam Description: Rare lipoprotein A (RlpA)-like double-psi beta-barrel
MAKAAAAALLVAALLGCLVSASLADQGTATYYTVYTPSACYGYQDEGTMIAAASDGLWDNGAACGRMYQVSCAGGTNATPNPCKGGSVTVKIVDRCPSPGCQATLDLSQEAFNTIGNLDAGKILINYNQV

SEQ ID NO: 20050 - DNA, 1212 bp, Sorghum bicolor
  misc_feature: Ceres ANNOT ID no. 8744325
  misc_feature: Encodes the peptide sequence at SEQ ID NO 20051
atgcaatgcaaccgcctttcgccgcggggcccacctgcctcacgggacccttccgtctgtgcctggatgcagatctttgttaagaccctcaccggcaagaccatcaccctcgaggttgagtcctcggacaccattgacaacgtcaaggctaagatccaggacaaggaaggcattcctccggaccagcagaggctcatctttgctggcaagcagcttgaggacggccgcacccttgctgactacaacatccagaaggagtccaccctccatctggtgctccggctcaggggaggcatgcagatcttcgtcaagaccctcactggcaagaccatcacgcttgaggtcgagtcttctgacacgatcgacaatgtgaaggccaagatccaggacaaggagggcatccccccggaccagcagcgtctcatcttcgcaggcaagcagctcgaggatggccgtacccttgctgactacaacatccagaaggagtcgacactccaccttgtgctcaggctcaggggtggtatgcagatcttcgtcaagaccctcactggcaagaccatcacgcttgaggtcgagtcctcagacaccattgataatgtcaaggccaagattcaggacaaggagggcatccctccggaccagcagcgtcttatctttgctgggaagcagctcgaggatggtcgcacccttgctgactacaacatccagaaggaatccacccttcaccttgtgctcaggctcaggggtggtatgcagatctttgtgaagaccctcactggcaagactatcactttggaggttgaatcctcggataccattgacaatgtgaaggccaagattcaggacaaggagggcatccccccggaccagcagcgcctcattttcgctggcaagcagcttgaggatggtcgtacccttgctgattacaacatccagaaggagtcaacccttcacctggtgctccgcctgcgtggtggtatgcagatcttcgtcaagaccctcaccggcaagaccatcaccctggaggtggagtcttctgataccattgacaatgtgaaggcgaagatccaggataaggagggcatccccccagaccagcagcgtctgatctttgctggcaagcagctggaggatggccgcactttggcagactacaacatccagaaggagtccaccctccacctggtgctccgcctccgtggtggccagtaa

SEQ ID NO: 20051 - protein, 403 aa, Sorghum bicolor
  misc_feature: Useful for making plants with modulated nitrogen use efficiency
  misc_feature: Functional homolog of the protein sequence given in SEQ ID NO 13585
  misc_feature: Useful for making plants with modulated cold sensitivity
  misc_feature: Useful for making plants with modulated flowering time
  misc_feature: Functional homolog of the protein sequence given in SEQ ID NO 14303
  misc_feature: Ceres ANNOT ID no. 8744325
  misc_feature (28)..(96): Pfam ID: ubiquitin Pfam Description: Ubiquitin family
  misc_feature (104)..(172): Pfam ID: ubiquitin Pfam Description: Ubiquitin family
  misc_feature (180)..(248): Pfam ID: ubiquitin Pfam Description: Ubiquitin family
  misc_feature (256)..(324): Pfam ID: ubiquitin Pfam Description: Ubiquitin family
  misc_feature (332)..(400): Pfam ID: ubiquitin Pfam Description: Ubiquitin family
MQCNRLSPRGPPASRDPSVCAWMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGQ

SEQ ID NO: 20052 - DNA, 1482 bp, Sorghum bicolor
  misc_feature: Ceres ANNOT ID no. 8744336
  misc_feature: Encodes the peptide sequence at SEQ ID NO 20053
atggcgagtagtgctgctgcgccatggtcgttaacgttgttcttcctcccgctgtgtttcctcctcgtcgtctccgtggcgctcggcgcccatgatgtcaacaagcccgggggccactacaacctcagcagggagaccttccctcccggcttcgtcttcgggacggcgtcgtcggcgtaccaggtggagggcaacacgcgaaagttcggacgaggcccctccatctgggacactttcctcaagtatccaggcactactcctgataacgcgacagcggatgtgtcggtcgacgagtacgatcgctacatggatgatgtggacaatatggtccgggttggattcgacgcgtaccgcttctcgatctcatggtcgcgcattttccccagtggaattgggagggtcaacaaggacggcgtggactattaccacaggctcatcgactacatgttggctaaccatattactccctatgttgttctctaccactacgaccttcctcaggtgctgcaagaccagtacaatggctggttaagccccagaattgtgcctgatttcacagcattcgcagatttttgctttaagacatacggcgatcgggtgaagttttggttcaccatcaacgagccccagatggtggctagccatggctacggagacgccttcttcccccctggcagatgcactggttgctacttcggcggcaattccgccaccgagccgtacatcgccggccatcaccttcttctttcgcatgctgctgctgtcaagctataccgcgagaagtacaaggttcatcagggtggaaagattggcatcctgcttgacttcgtctggtatgagccgctcaccaagtcgatcgaggacgagttcgcggcgcaccgggctaggatgttcacccttggctggttcctgcacccaatcacctacggccattacccggagacgatggagaagatagtgatgggaaggctgcccaatttcaccttcgagcagtctgcaatggtgaaaggttcagcagattacatcgccatcaaccactacacgacgtattacgccagcaacttcgtcaacgagacacatacgagctatctcaacgactggcatggatactcggactggctctacgttgttccatgggggctctataaggctctcatttggacaaaggagaagttcaacaaccctgtcatgctcatcggcgaaaacggaattgaccagtcgggaaatgaaactttgccgcacgccctgtatgacaagttcaggatagactacttccagaagtaccttcaggagctccaatatgccatacgcgatggtgcaaatgtcttcgggtactttgtgtggtctctgctagacaactttgagtggcggctcggctacacctccagatttggaattgtacatgtggaccgaagcacgttcgttcggtaccccaaggactcagctcgatggttccggaaggtgatcaagaacgaggactaa

SEQ ID NO: 20053 - protein, 493 aa, Sorghum bicolor
  misc_feature: Useful for making plants with altered cell wall content and/or composition
  misc_feature: Functional homolog of the protein sequence given in SEQ ID NO 14123
  misc_feature: Useful for making plants with altered carbohydrate content
  misc_feature: Functional homolog of the protein sequence given in SEQ ID NO 14124
  misc_feature: Ceres ANNOT ID no. 8744336
  misc_feature (44)..(371): SWISSPROT Homolog: EC 3.2.1.21 Beta-glucosidase
  misc_feature (43)..(493): Pfam ID: Glyco_hydro_1 Pfam Description: Glycosyl hydrolase family 1
MASSAAAPWSLTLFFLPLCFLLVVSVALGAHDVNKPGGHYNLSRETFPPGFVFGTASSAYQVEGNTRKFGRGPSIWDTFLKYPGTTPDNATADVSVDEYDRYMDDVDNMVRVGFDAYRFSISWSRIFPSGIGRVNKDGVDYYHRLIDYMLANHITPYVVLYHYDLPQVLQDQYNGWLSPRIVPDFTAFADFCFKTYGDRVKFWFTINEPQMVASHGYGDAFFPPGRCTGCYFGGNSATEPYIAGHHLLLSHAAAVKLYREKYKVHQGGKIGILLDFVWYEPLTKSIEDEFAAHRARMFTLGWFLHPITYGHYPETMEKIVMGRLPNFTFEQSAMVKGSADYIAINHYTTYYASNFVNETHTSYLNDWHGYSDWLYVVPWGLYKALIWTKEKFNNPVMLIGENGIDQSGNETLPHALYDKFRIDYFQKYLQELQYAIRDGANVFGYFVWSLLDNFEWRLGYTSRFGIVHVDRSTFVRYPKDSARWFRKVIKNED

SEQ ID NO: 20054 - DNA, 255 bp, Sorghum bicolor
  misc_feature: Ceres ANNOT ID no. 8744345
  misc_feature: Encodes the peptide sequence at SEQ ID NO 20055
atgcgccgggcgaagccgccgcagccgcagccctcgccgtcgccggagatccggtaccgcggcgtgcggaggcggccgtcggggcgctacgccgccgagatccgggacccggccaagaagaccccgatctggctcggcaccttcgactccgccgaggtcgccgcgcgcgcctacgacgccgccgcacgatccctacgcgggcccaccgcatgcaccaactttcccagcgccgcgtcaccgggctcgcggaactga

SEQ ID NO: 20055 - protein, 84 aa, Sorghum bicolor
  misc_feature: Useful for making plants with altered carbohydrate content
  misc_feature: Functional homolog of the protein sequence given in SEQ ID NO 14760
  misc_feature: Useful for making plants with altered lignin content
  misc_feature: Functional homolog of the protein sequence given in SEQ ID NO 14761
  misc_feature: Useful for biocontainment applications
  misc_feature: Useful for making plants with altered cell wall content and/or composition
  misc_feature: Functional homolog of the protein sequence given in SEQ ID NO 12919
  misc_feature: The sequence is a functional homolog of SEQ ID NO 1419 in the 11/479,226 US patent application
  misc_feature: The sequence is a functional homolog of SEQ ID NO 668 in the 10/412,699 US patent application
  misc_feature: Useful for making plants with modulated cold sensitivity
  misc_feature: Functional homolog of the protein sequence given in SEQ ID NO 13439
  misc_feature: The sequence is a functional homolog of SEQ ID NO 2220 in the 10/374,780 US patent application
  misc_feature: The sequence is a functional homolog of SEQ ID NO 500 in the 10/225,066 US patent application
  misc_feature: The sequence is a functional homolog of SEQ ID NO 314 in the 10/666,642 US patent application
  misc_feature: Useful for making plants with altered alkaloid content
  misc_feature: Functional homolog of the protein sequence given in SEQ ID NO 13008
  misc_feature: The sequence is a functional homolog of SEQ ID NO 1435 in the 11/479,226 US patent application
  misc_feature: The sequence is a functional homolog of SEQ ID NO 2504 in the 10/374,780 US patent application
  misc_feature: The sequence is a functional homolog of SEQ ID NO 618 in the 10/225,066 US patent application
  misc_feature: The sequence is a functional homolog of SEQ ID NO 674 in the 10/412,699 US patent application
  misc_feature: The sequence is a functional homolog of SEQ ID NO 1356 in the 10/666,642 US patent application
  misc_feature: The sequence is a functional homolog of SEQ ID NO 1726 in the 10/412,699 US patent application
  misc_feature: The sequence is a functional homolog of SEQ ID NO 191 in the 11/479,226 US patent application
  misc_feature: The sequence is a functional homolog of SEQ ID NO 2230 in the 10/374,780 US patent application
  misc_feature: The sequence is a functional homolog of SEQ ID NO 50 in the 10/412,699 US patent application
  misc_feature: The sequence is a functional homolog of SEQ ID NO 788 in the 10/225,066 US patent application
  misc_feature: The sequence is a functional homolog of SEQ ID NO 10 in the 10/666,642 US patent application
  misc_feature: The sequence is a functional homolog of SEQ ID NO 54 in the 10/412,699 US patent application
  misc_feature: Ceres ANNOT ID no. 8744345
  misc_feature (17)..(68): Pfam ID: AP2 Pfam Description: AP2 domain
MRRAKPPQPQPSPSPEIRYRGVRRRPSGRYAAEIRDPAKKTPIWLGTFDSAEVAARAYDAAARSLRGPTACTNFPSAASPGSRN

SEQ ID NO: 20056 - DNA, 1713 bp, Sorghum bicolor
  misc_feature: Ceres ANNOT ID no. 8744370
  misc_feature: Encodes the peptide sequence at SEQ ID NO 20057
atggcaggcctcttggacaactcaagcggcgtgtggaccgtgctcgggcaggcctcgaacgtggcgcagctggtcggcgtcgacgcgctcgggctggtgtccatggtcgtgcaggccgcgctggcggcgcgccgccaccgcgacgcctgccgtcgcctggcgcagcacgtggaggtcgtcggcggcctgctgcgggagctggagctcgccgagctgatgcggcgggaggctacgcggcggccgctcgagcagctccagggctcactgcggcggtgctacgcgctcgtcacggcgtgccaggactgcgggtacctccgcagcctgttcctcggcgcccggatggccgacgagctccacgctgcggagaaggagatcgacatgttcatccgcttagtcccactcatcgccctcgtcgacagtacgcatgatcgcgatgccaagcagactgccgagggagtaccaggtctaatcacgaatggttcaaaccatcatgtcaggtttccaagaagtgttttggacctcaccaaaatacacattcaaggagctactcaagtttgcagttttgcagaacaaccattagcaggagcactggactttagagaacaaaaaagtctggacattgaagaactgttggagctttgcatccgtactcaagagagttgctcaggattcagaaggtttgaattcttccagattattgatgctacagacaatttctcagaaagtagaaaaatcgggtggggtggttttggtacagtttacaagggtcagttgcctgatggatccatgattgccatcaaaaggatggatgaaaatgctacagtgtttgatttcagcagtgaatttctgcttgcgaggcttcagcataccaatctaattagacttttggggtggtgtatccatgggaaagaaaggattctagtgtatgagttcatgcacaagggtagcctgcaccatttcatctttgacaaaagaatggggtcgttgctagactggtctaagagaatcaatataatcaaagggttagctgaaggacttgtttaccttcacaaacagtccaagttatggattgtccatagggatttgaaacccaagaacatcctattagatcatgacatgaacccaaagattgctgattttggatcagctagaactctgagttcagatttcgctgaagagtgtacaagcagggttgtggggactagtggctacaaagctcctgagtacacgtctcgaggtgtatattcactaaagacagatgtgtttagctttggggtgatggttttagtgaccatcagtgggcgaaagaataccatactggagaaccaaggagattctgttggcacccttgtacgagatgcatggcaactatggaatgatggaaggctacaggagcttgtggatccaatgttgggtgatgaatttgaacttgctgaggtgatgcagtatgctcaagtagcactactctgcgctcaggaggaatcaacagatcgcccaaccatgtcggatgttgtgtcactcttgaactttcaaagcataagtttattaccagatcctaagcagccatcagagttgtgcaagggaggtgctactggtgacaagttatcgacatatgttagccagtcaagcaggaccatagacataacaatcacaagctcagctcctatatcaactagagtccgcatcactgtagacccagagacctcaaagtag

SEQ ID NO: 20057 - protein, 570 aa, Sorghum bicolor
  misc_feature: Useful for making plants with altered cell wall content and/or composition
  misc_feature: Functional homolog of the protein sequence given in SEQ ID NO 14140
  misc_feature: Ceres ANNOT ID no. 8744370
  misc_feature (232)..(508): SWISSPROT Homolog: EC 2.7.11.1 Non-specific serine/threonine protein kinase
  misc_feature (239)..(508): Pfam ID: Pkinase Pfam Description: Protein kinase domain
MAGLLDNSSGVWTVLGQASNVAQLVGVDALGLVSMVVQAALAARRHRDACRRLAQHVEVVGGLLRELELAELMRREATRRPLEQLQGSLRRCYALVTACQDCGYLRSLFLGARMADELHAAEKEIDMFIRLVPLIALVDSTHDRDAKQTAEGVPGLITNGSNHHVRFPRSVLDLTKIHIQGATQVCSFAEQPLAGALDFREQKSLDIEELLELCIRTQESCSGFRRFEFFQIIDATDNFSESRKIGWGGFGTVYKGQLPDGSMIAIKRMDENATVFDFSSEFLLARLQHTNLIRLLGWCIHGKERILVYEFMHKGSLHHFIFDKRMGSLLDWSKRINIIKGLAEGLVYLHKQSKLWIVHRDLKPKNILLDHDMNPKIADFGSARTLSSDFAEECTSRVVGTSGYKAPEYTSRGVYSLKTDVFSFGVMVLVTISGRKNTILENQGDSVGTLVRDAWQLWNDGRLQELVDPMLGDEFELAEVMQYAQVALLCAQEESTDRPTMSDVVSLLNFQSISLLPDPKQPSELCKGGATGDKLSTYVSQSSRTIDITITSSAPISTRVRITVDPETSK

SEQ ID NO: 20058 - DNA, 963 bp, Sorghum bicolor
  misc_feature: Ceres ANNOT ID no. 8744405
  misc_feature: Encodes the peptide sequence at SEQ ID NO 20059
atggcgagtggtcggttgagcttcgtcgtcgtcgtggccgccctcgtcgcgtccgcgggtctcatgccgccgtctgccgtcgccgagctgaagacagactactatgccagcacctgccctaacctggaggtcatcgtccggagctccgtgaagcagtccatggcgcagtcacccatctccgcgcccgccgcgctcaggctcttcttccacgattgcgccgtcaggggctgcgacgcgtcgatcatgatcgtgaactccaacggcgacgacgagtggcggaacagcgacaaccagtcgctcaagccggaggggtttcagaccatcctgaacgccaaggccgccgtggacagcgacccgcaatgccagtacaaggtttcctgcgccgacatcatggccatcgcagccagagaatccgtctaccagagcggcgggccgtactacgaggtggagttgggacggtacgacggccgggtgtccaccagggacggcgtcgtgctgccgcatgccaacttcaacctcgaccagctcaacgccttcttctccggcctcggcttctcccaggctgaaatggtcgcgctgtcaggcgcccacaccctcggcgccgcggactgccccttcttccagtacaggatcggcagcgacgcgaccatggaccccggcttcgcgtcgcagctgaaagacacctgcagctccgaccccaacgccttcgccttcctcgacccgtcgccggtgggcttcgacaacgccttctaccggaacctgcagggcggcaaggggctcctgggctccgatcaggtgctctactccgacacgaggtcccgcggcacggtcaactactacgcgtccaaccagggcgccttcttcgccgacttcgtggcggcgatgacaaagctcgggaggataggggtcaagacgcccgccaccggcggcgagatacgccgggactgccggttcccgaactag

SEQ ID NO: 20059 - protein, 320 aa, Sorghum bicolor
  misc_feature: Useful for making plants with altered carbohydrate content
  misc_feature: Functional homolog of the protein sequence given in SEQ ID NO 14762
  misc_feature: Useful for making plants with altered cell wall content and/or composition
  misc_feature: Functional homolog of the protein sequence given in SEQ ID NO 14763
  misc_feature: Ceres ANNOT ID no. 8744405
  misc_feature (21)..(316): SWISSPROT Homolog: EC 1.11.1.7 Peroxidase
  misc_feature (46)..(283): Pfam ID: peroxidase Pfam Description: Peroxidase
MASGRLSFVVVVAALVASAGLMPPSAVAELKTDYYASTCPNLEVIVRSSVKQSMAQSPISAPAALRLFFHDCAVRGCDASIMIVNSNGDDEWRNSDNQSLKPEGFQTILNAKAAVDSDPQCQYKVSCADIMAIAARESVYQSGGPYYEVELGRYDGRVSTRDGVVLPHANFNLDQLNAFFSGLGFSQAEMVALSGAHTLGAADCPFFQYRIGSDATMDPGFASQLKDTCSSDPNAFAFLDPSPVGFDNAFYRNLQGGKGLLGSDQVLYSDTRSRGTVNYYASNQGAFFADFVAAMTKLGRIGVKTPATGGEIRRDCRFPN

SEQ ID NO: 20060 - DNA, 957 bp, Sorghum bicolor
  misc_feature: Ceres ANNOT ID no. 8744406
  misc_feature: Encodes the peptide sequence at SEQ ID NO 20061
atggcgaggcttaggctggtcttgtttgtcgccgtcgtcgtgtccgcggcgctcctgccgccgcccgccgccgtcgcgcagctgaggacggactactacgccagcacctgccccaacctcgagtccatcgtccggggctccgtcaggcagtccatggcgcagtcccagatcgccgcgcccgccgcgctcaggctcttcttccacgactgcgccgtcatgggctgcgacgcgtcgatcatgatcgtgaactcgaccggcgacgacgagtggcggaactccgccaaccagtcgctcaagccggatgggttccaggccattctgagcgccaaggccgccgtggacagcaaccagcagtgccagtacaaggtgtcgtgcgcggacatcatcgccctcgccgccagagaagccgtctacctgagtggcgggccgtactaccaggtggagctcggccggtttgacggcagggtgtcgaccagagacagcgtccggctgccgagcgtcaacttcaacctcgaccagctcaacgccttcttctccggcctcggcttctcccaggctgaaatgatcgccctcctaggtgcgcacaccctcggcgcggcggactgccccttcttccagtacaggatcggtagcgacccgagcatggaccagggcctggcgtcgcagctgcgcggcacctgcggctccaaccccaacagcggcttcgcgttcttcgaccccacgccggtgagcttcgacaacgccttctaccggaacctgcagggcggcagggggctgctgggctccgaccaggtgctgtacagcgaccagagatcccgcagtgccgtcgacaactacgtgtccaaccagggcgccttcttcaccgacttcgtcgcggcgatcaccaagctcggcaggatcggagccaagacggcggccaccggcgagatacgccgcgactgccggttcccgaactag

SEQ ID NO: 20061 - protein, 318 aa, Sorghum bicolor
  misc_feature: Useful for making plants with altered carbohydrate content
  misc_feature: Functional homolog of the protein sequence given in SEQ ID NO 14762
  misc_feature: Useful for making plants with altered cell wall content and/or composition
  misc_feature: Functional homolog of the protein sequence given in SEQ ID NO 14763
  misc_feature: Ceres ANNOT ID no. 8744406
  misc_feature (30)..(314): SWISSPROT Homolog: EC 1.11.1.7 Peroxidase
  misc_feature (44)..(282): Pfam ID: peroxidase Pfam Description: Peroxidase
MARLRLVLFVAVVVSAALLPPPAAVAQLRTDYYASTCPNLESIVRGSVRQSMAQSQIAAPAALRLFFHDCAVMGCDASIMIVNSTGDDEWRNSANQSLKPDGFQAILSAKAAVDSNQQCQYKVSCADIIALAAREAVYLSGGPYYQVELGRFDGRVSTRDSVRLPSVNFNLDQLNAFFSGLGFSQAEMIALLGAHTLGAADCPFFQYRIGSDPSMDQGLASQLRGTCGSNPNSGFAFFDPTPVSFDNAFYRNLQGGRGLLGSDQVLYSDQRSRSAVDNYVSNQGAFFTDFVAAITKLGRIGAKTAATGEIRRDCRFPN

SEQ ID NO: 20062 - DNA, 975 bp, Sorghum bicolor
  misc_feature: Ceres ANNOT ID no. 8744408
  misc_feature: Encodes the peptide sequence at SEQ ID NO 20063
atggagaagaagacggtggtgctgtatccgggcgtcggcgtcggccacctcgcgccgatgctcgagctggccaaggcgttcctccgccacggcggagaccaggtcgacgtcgccatcgcggtcttcgagccgcccgtctacgccaacggcttcgcctccacggtcgcgcgcgccaaggcctccaacgcctctgtcgccttgcacgtgctttccccgccaccgccgccgccggcggcctccaacgacgccgagcctgatgtccccttggcccggatgctccgcttcctccgcgccacgaatgcgccgctccgcgacttccttcgcgcgctgtcgtcgtcgtcgtcgtcgtcgcgctgcgtccaggcaatcgtcctcgacatgttctgcgccgacgcgctcgacgtcgccgccgagcttggcctgcccgcctacttcttcttcccctcgggcaccgccggcctcgcctgcttcctcggcctccccgccatgcgcgccagagtgggcaccagcttcgcggcgctcgggaactccgccgtcctgtcgttcccgggcgctcctccgttcacggttgcggacctggcgcaggggctggcggacgacggcgaggcgtgcaagggcatcatcggcgtggctgcccggatgccggaagcccgcggcatcctcatcaactccttcgagtcgctggagccgcgtgcgatgtgggcgctcagggacgggctgtgcgtgccggaccgccccacgccgccggtctactgcgtcgggccaagaatgggacaagaagtccgccgtgctcctcttgagatcaaagtctgccccgtcacctaccaccgccaccaccagagccgaggaaccgacatcgacatccattgcggccgagaggctccgcctggcgcccgggtcccccccgcatggcgacctcacggggagcaccgatgccgccgccgcggcacgggtggaaagcgaacgggcgagtag

SEQ ID NO: 20063 - protein, 324 aa, Sorghum bicolor
  misc_feature: Useful for making plants with altered carbohydrate content
  misc_feature: Functional homolog of the protein sequence given in SEQ ID NO 14447
  misc_feature: Ceres ANNOT ID no. 8744408
  misc_feature (6)..(291): SWISSPROT Homolog: EC 2.4.1.218 Hydroquinone glucosyltransferase
MEKKTVVLYPGVGVGHLAPMLELAKAFLRHGGDQVDVAIAVFEPPVYANGFASTVARAKASNASVALHVLSPPPPPPAASNDAEPDVPLARMLRFLRATNAPLRDFLRALSSSSSSSRCVQAIVLDMFCADALDVAAELGLPAYFFFPSGTAGLACFLGLPAMRARVGTSFAALGNSAVLSFPGAPPFTVADLAQGLADDGEACKGIIGVAARMPEARGILINSFESLEPRAMWALRDGLCVPDRPTPPVYCVGPRMGQEVRRAPLEIKVCPVTYHRHHQSRGTDIDIHCGREAPPGARVPPAWRPHGEHRCRRRGTGGKRTGE

SEQ ID NO: 20064 - DNA, 1011 bp, Sorghum bicolor
  misc_feature: Ceres ANNOT ID no. 8744410
  misc_feature: Encodes the peptide sequence at SEQ ID NO 20065
atgaggtcgaggaggtcgtcgccttcgtggcggcggagcgtggtcgccgcggtcgtcatagcgttggctgcgtcgtggtccgcggcggcggcggcgcaagcgcagctgagccagagctactacgcttcgacgtgccccaacgtggagacgctggtgcgcggcgccgtcacccagaagctgcaggagaccttcaacgcggcgccgggcacgctccgcctcttcttccacgactgctttgtcaggggctgcgacgcgtccgtgctgctgtcgggccccgacgacgagcacagcgcgggcgccgacacgacgctgtcaccggacgcgctggacctcgtcacccgcgccaaggccgccgtcgacgccgaccccaagtgcgcctacaaggtctcctgcgccgacatcctcgccctcgccgcccgcgacgtcgtctcccagacgggcgggccgtactaccaggtggagctggggcggctggacggcaaggtgggcactcgcgccgtggtgaagcacagcctccccggcgccggcttcgacctcgaccagctcaacaagctcttcgccgccaacggcctcacgcagaccgacatgatcgccctctcaggtgggcacacgatcggcgtgacgcactgcgacaagttcgtgcggcggctgtacacgttcaagggcggccgcaacagcgccggcccgccgatgaacctcaacttcctgcggcagatgcggcagacgtgcccgctcaactacaccccgtcggcgttcgcgatgctggacgccgtcacgccgcgcaagttcgacaacggctactaccagacgctgcagcagatgaagggcctgctggcctccgaccaggtgctcttcgccgaccgccggtcccgcgccaccgtcaactacttcgccgccaaccagacggctttcttcgacgccttcgtcgccgccatggctaagctcggacgcgtcggcgtcaagaccgccgctgacggcgagatccgccgcgtctgcaccaaggtcaactag

SEQ ID NO: 20065 - protein, 336 aa, Sorghum bicolor
  misc_feature: Useful for making plants with altered carbohydrate content
  misc_feature: Functional homolog of the protein sequence given in SEQ ID NO 13878
  misc_feature: Useful for making plants with altered cell wall content and/or composition
  misc_feature: Functional homolog of the protein sequence given in SEQ ID NO 13879
  misc_feature: Ceres ANNOT ID no. 8744410
  misc_feature (44)..(336): SWISSPROT Homolog: EC 1.11.1.7 Peroxidase
  misc_feature (52)..(300): Pfam ID: peroxidase Pfam Description: Peroxidase
MRSRRSSPSWRRSVVAAVVIALAASWSAAAAAQAQLSQSYYASTCPNVETLVRGAVTQKLQETFNAAPGTLRLFFHDCFVRGCDASVLLSGPDDEHSAGADTTLSPDALDLVTRAKAAVDADPKCAYKVSCADILALAARDVVSQTGGPYYQVELGRLDGKVGTRAVVKHSLPGAGFDLDQLNKLFAANGLTQTDMIALSGGHTIGVTHCDKFVRRLYTFKGGRNSAGPPMNLNFLRQMRQTCPLNYTPSAFAMLDAVTPRKFDNGYYQTLQQMKGLLASDQVLFADRRSRATVNYFAANQTAFFDAFVAAMAKLGRVGVKTAADGEIRRVCTKVN

SEQ ID NO: 20066 - DNA, 906 bp, Sorghum bicolor
  misc_feature: Ceres ANNOT ID no. 8744425
  misc_feature: Encodes the peptide sequence at SEQ ID NO 20067
atggcgtctcgtcgtgtgtccctgctgctgggcgtactgctgtcctactccgccgccgtcgccgtcgccgtggcggcggccaacttcaaccaggagttcgacatcacgtggggcgacggtcgtggcaagatccaggacaacgggcagctgctgacgctgacgctggaccggacctccgggtccgggttccagtccaggcacgagtacctcttcggcaagatcgacatgcagctgaagctggtccccggcaactcggccggcaccgtcaccgcctactacctgtcgtcgcagggcaacacccacgatgagatcgacttcgagttcctcggcaacgtctccggcgagccctacacgctgcacaccaacgtgttcacccagggccagggacagagggagcagcagttccgcctctggtttgatcccaccaaggacttccatacctactccatcctctggaaccccaagcacgtcatcttcatggtggacgagatgccgatcagggacttccggaacctggagagcaagggggtggcgttccccaagaaccagccgatgcggctctactccagcctgtggaacgccgacgactgggcgacacagggcggccgcgtcaagacggactggtcccacgcgcccttctccgcctcgtaccggggattcagggccgacgcctgcgtcgcagtcgccggcggcaagacgcgctgcggcggcggcggcggcggcggcgccgtcggcaccgagggcgccggcgctggagcgccggccggggactggtacaaccaggagctggacctcacgctgcagcagcggatgcggtgggtgcagcgcaagtacatgatctacaactactgcaccgaccccaagcgctacccgcagggcctccccgccgagtgctccatgcagtag

SEQ ID NO: 20067 - protein, 301 aa, Sorghum bicolor
  misc_feature: Useful for making plants with altered carbohydrate content
  misc_feature: Functional homolog of the protein sequence given in SEQ ID NO 14764
  misc_feature: Useful for making plants with altered cell wall content and/or composition
  misc_feature: Functional homolog of the protein sequence given in SEQ ID NO 14639
  misc_feature: Useful for making plants with altered lignin content
  misc_feature: Functional homolog of the protein sequence given in SEQ ID NO 13341
  misc_feature: Ceres ANNOT ID no. 8744425
  misc_feature (28)..(298): SWISSPROT Homolog: EC 2.4.1.207 Xyloglucan:xyloglucosyl transferase
  misc_feature (29)..(210): Pfam ID: Glyco_hydro_16 Pfam Description: Glycosyl hydrolases family 16
  misc_feature (235)..(298): Pfam ID: XET_C Pfam Description: Xyloglucan endo-transglycosylase (XET) C-terminus
MASRRVSLLLGVLLSYSAAVAVAVAAANFNQEFDITWGDGRGKIQDNGQLLTLTLDRTSGSGFQSRHEYLFGKIDMQLKLVPGNSAGTVTAYYLSSQGNTHDEIDFEFLGNVSGEPYTLHTNVFTQGQGQREQQFRLWFDPTKDFHTYSILWNPKHVIFMVDEMPIRDFRNLESKGVAFPKNQPMRLYSSLWNADDWATQGGRVKTDWSHAPFSASYRGFRADACVAVAGGKTRCGGGGGGGAVGTEGAGAGAPAGDWYNQELDLTLQQRMRWVQRKYMIYNYCTDPKRYPQGLPAECSMQ

SEQ ID NO: 20068 - DNA, 879 bp, Sorghum bicolor
  misc_feature: Ceres ANNOT ID no. 8744420
  misc_feature: Encodes the peptide sequence at SEQ ID NO 20069
atgaggtcgaccgcgcttgttgcgttcgtggcggtggcgtgcctagcggccgtcgcacacggcggcaacttctacaaggacacggagatgacctgggggcaaggccgtggcaaggtggtggacggcgggcgcgggctggacctaaccctggacaggacctccggctccggcttccagtccaagtccgagtacctcttcggcaagatcgacatgcagatcaagctggtgccaggcaactcggccggcaccgtcaccaccttctacctctcctcgcaaggccccacccacgacgagatcgacttcgagttcctcggcaacgtctccggcgagccctacacgctgcacaccaacgtgttcaccggcggccagggccagcgcgagcagcagttccgcctctggttcgaccccaccaaggacttccacacctactccgtggtgtggaacccgcagcacgtgatcttcgccgtggacggcaccccgatccgcgacttcaagaaccatgaggcccgcggggtggggttcccgcggacgcagccgatgcggctgtacgcgagtctctggaacgccgacgactgggccacgcagggcggccgcgtcaaggcggactggacgcaggcgccgttcgtcgcgtcgttccgtgggttcagcgctgacgcgtgtgtgtgggcgaatgggaagcagcagtgccctgtgggaaccatggcggcggcggcgacggggggacggcgcggaggccctggcagctggtggaaccagcagcttagtgacatgagctaccgccgcatgcgctgggtgcagaggaagttcatgatctacaactactgcaccgacgccaagcggttcccgcagggggtgcccgccgagtgcaagctccggtga

SEQ ID NO: 20069 - protein, 292 aa, Sorghum bicolor
  misc_feature: Useful for making plants with altered carbohydrate content
  misc_feature: Functional homolog of the protein sequence given in SEQ ID NO 14637
  misc_feature: Useful for making plants with altered cell wall content and/or composition
  misc_feature: Functional homolog of the protein sequence given in SEQ ID NO 14638
  misc_feature: Ceres ANNOT ID no. 8744420
  misc_feature (23)..(289): SWISSPROT Homolog: EC 2.4.1.207 Xyloglucan:xyloglucosyl transferase
  misc_feature (24)..(205): Pfam ID: Glyco_hydro_16 Pfam Description: Glycosyl hydrolases family 16
  misc_feature (229)..(289): Pfam ID: XET_C Pfam Description: Xyloglucan endo-transglycosylase (XET) C-terminus
MRSTALVAFVAVACLAAVAHGGNFYKDTEMTWGQGRGKVVDGGRGLDLTLDRTSGSGFQSKSEYLFGKIDMQIKLVPGNSAGTVTTFYLSSQGPTHDEIDFEFLGNVSGEPYTLHTNVFTGGQGQREQQFRLWFDPTKDFHTYSVVWNPQHVIFAVDGTPIRDFKNHEARGVGFPRTQPMRLYASLWNADDWATQGGRVKADWTQAPFVASFRGFSADACVWANGKQQCPVGTMAAAATGGRRGGPGSWWNQQLSDMSYRRMRWVQRKFMIYNYCTDAKRFPQGVPAECKLR

SEQ ID NO: 20070 - DNA, 846 bp, Sorghum bicolor
  misc_feature: Ceres ANNOT ID no. 8744422
  misc_feature: Encodes the peptide sequence at SEQ ID NO 20071
atgaagacgttggttctggcggcggcgatgctgctactgctggtgcacgggggagtcgccggcggcggcaacttctaccaggacgtggacatcacgtggggcgacggccgtggcaagatcctgaacaacgggcagctcctgacgctgtccatggacaggtcctccgggtcggggttccagtccaagtcccagtacctctacggccgcttcgacatgcagctgaagctggtgccaggcaactccgccggcaccgtcaccaccttctacctctcctcgcagggcagcgcccacgacgagatcgacttcgagttcctcggcaacgcgagcggagagccctacacggtgcacaccaacgtgtacagccaggggaaaggcgggcgggagcagcagttccggatgtggttcgaccccaccgcggacttccacgcctactcggtgctctggaacccttcccacatcgtcttctacgtcgacggcgtccccatccgcgagttccgccgccgaaacgacggcgcggtgccgttcccgacgtcgcagccgatgcgggtgtacgccagcgtgtgggacgccgaggagtgggccacgcagggcgggcgtgtcaagacggactggtccaaggcgcccttcgtcgcgtcgtaccaggggtacgccgccgccggctgcaccgcgcccgacgccgccgcgtgcgccaggtccaacggcgcctggatgtcgcaggagctcgacagcgccgcgcaggggcagctccgccgggcgcaggccagctacatgatctacaactactgcaccgataagtaccgcttcccgcagggaccgccgcccgagtgctcgtcgccggccaagtag

SEQ ID NO: 20071 - protein, 281 aa, Sorghum bicolor
  misc_feature: Useful for making plants with altered cell wall content and/or composition
  misc_feature: Functional homolog of the protein sequence given in SEQ ID NO 14638
  misc_feature: Useful for making plants with altered carbohydrate content
  misc_feature: Functional homolog of the protein sequence given in SEQ ID NO 14764
  misc_feature: Ceres ANNOT ID no. 8744422
  misc_feature (24)..(276): SWISSPROT Homolog: EC 2.4.1.207 Xyloglucan:xyloglucosyl transferase
  misc_feature (25)..(206): Pfam ID: Glyco_hydro_16 Pfam Description: Glycosyl hydrolases family 16
  misc_feature (229)..(276): Pfam ID: XET_C Pfam Description: Xyloglucan endo-transglycosylase (XET) C-terminus
MKTLVLAAAMLLLLVHGGVAGGGNFYQDVDITWGDGRGKILNNGQLLTLSMDRSSGSGFQSKSQYLYGRFDMQLKLVPGNSAGTVTTFYLSSQGSAHDEIDFEFLGNASGEPYTVHTNVYSQGKGGREQQFRMWFDPTADFHAYSVLWNPSHIVFYVDGVPIREFRRRNDGAVPFPTSQPMRVYASVWDAEEWATQGGRVKTDWSKAPFVASYQGYAAAGCTAPDAAACARSNGAWMSQELDSAAQGQLRRAQASYMIYNYCTDKYRFPQGPPPECSSPAK

SEQ ID NO: 20072 - DNA, 1056 bp, Sorghum bicolor
  misc_feature: Ceres ANNOT ID no. 8744461
  misc_feature: Encodes the peptide sequence at SEQ ID NO 20073
atgtctcaccacgacggaagcaagccgtaccagccgcgccgggggcccgagcggcacccgcagccggcggacgggatggccgccccgcctcccgccgccgttggcccgtcggtggagcacctcgtggcggccgccgccgaggcggaggcgttgaaccgcttcgccgtggaaccacaggtgcacgagcaggaggttggggaggaagaagaggaggacgaggaggaagacgagatggaggaggaggaggacgagcaggaaggccagcacggtggcatcggtggggagcacgttcccatggacgcggatgctgctgccgcggcggctgcggccgccggcgcgcagatggacccgcactcggcgatggtgcctgggaccgtgccacccatggcgaccaaccagctcaccctgtcgttccagggcgaggtctatgtgttcgactccgtctcccctgataaggtccaagccgtgcttttgctgcttggagggagggagctgagcagcctgggcggagcgtcatcctctgcaccttatagtaagaggttgaattttccacatcgggtggcgtcactaatgagatttagggaaaaacggaaggagcggaactttgataagaagatccggtacactgttcggaaggaagttgcgcttaggatgcagcggaatagaggtcagtttacatcttcaaaaccaaagcctgatgaaatagcagcatcagaaatggcagctgtagatggctccccgaattgggcgttagttgaaggccgacctccatctgctgccgaatgtcatcattgtggtactaatgcaacagctacgccaatgatgcgtcgtggacctgatggaccaagaacactatgcaatgcctgcggcctcatgtgggcaaataagggtctcctgagggacctatcaaaatctcctgtaccacttcaagttatgcaatcagctccacttctagatggtggtaatggaaatgtcatgtctgcgcctggctctgagctagagaatgctgcagctgccatgaccaatggccacgagtcatcaagtagtggtgtttaa

SEQ ID NO: 20073 - protein, 351 aa, Sorghum bicolor; identical to SEQ ID NO: 2222
  misc_feature: Useful for making plants with altered terpenoid content
  misc_feature: Functional homolog of the protein sequence given in SEQ ID NO 12908
  misc_feature: Ceres ANNOT ID no. 8744461
  misc_feature (186)..(230): Pfam ID: CCT Pfam Description: CCT motif
  misc_feature (262)..(299): Pfam ID: GATA Pfam Description: GATA zinc finger

SEQ ID NO: 20074 - DNA, 405 bp, Sorghum bicolor
  misc_feature: Ceres ANNOT ID no. 8744510
  misc_feature: Encodes the peptide sequence at SEQ ID NO 20075
atgatggtgatgggctacttccggtcgacgaacaagtccgcgacgtcggcagcgggcggcaagaacaagaagaaggcgaagaacagctgtgcgccggcggcgcgcgaggaggcggccggactgcgggaggcgctgctggaccagccggcggcggcggaggaggacggcggcgttcctaagggctacttcgcggtgtacgccggggaggagtcccgccggttcgtcgtgcccacggggtacctccgggagccggcgttccgggacctcatggagcgcgccgccgacgagttcggcttcgcgcaggccggcggcctgcgcgtgccctgcgccgaggaggacttcgaggacctcctgcgccgtctccagcgcaagaacggcggcgccgtcgggaagggcaagaaataa

SEQ ID NO: 20075 - protein, 134 aa, Sorghum bicolor
  misc_feature: Useful for making plants with modulated cold sensitivity
  misc_feature: Functional homolog of the protein sequence given in SEQ ID NO 14765
  misc_feature: Useful for making plants with modulated salt sensitivity
  misc_feature: Functional homolog of the protein sequence given in SEQ ID NO 13813
  misc_feature: Ceres ANNOT ID no. 8744510
  misc_feature (26)..(122): Pfam ID: Auxin_inducible Pfam Description: Auxin responsive protein
MMVMGYFRSTNKSATSAAGGKNKKKAKNSCAPAAREEAAGLREALLDQPAAAEEDGGVPKGYFAVYAGEESRRFVVPTGYLREPAFRDLMERAADEFGFAQAGGLRVPCAEEDFEDLLRRLQRKNGGAVGKGKK

SEQ ID NO: 20076 - DNA, 1026 bp, Sorghum bicolor
  misc_feature: Ceres ANNOT ID no. 8744515
  misc_feature: Encodes the peptide sequence at SEQ ID NO 20077
atgaggacttttcaacaaaaccctgaggataggagagtaaatacttccaagccttggacttcaaaaaagaagttttgtgagctgcctgactctgttgaagtgcatataattgatgatgacagtaatgacagcagcaaggattactcagtggaagatgcatcaaagcagcttgccatttacaatcctgatatcacacatgacaagcaaactgacatggatcactatgcttcaccgcaccagagttctaagaagccaagacgtggatatggcacagttttaccttctattggtacttatactgtacagtgtgccaaatgctacaaatggaggatcgttccaaccaaagaaaaatatcaagagctacgagggagtatttctcaggagctttttgtatgcgcaagggctcgtgagtggaaccgcgaattatcatgtgttgaactagaagatatttcacaagatggaagtaggatgtgggcgattgataggccaaacattgtccaaccccctcctggctgggacagggaggtcagactcaggggagcttccaccaagtttgcagatgtgtattacacttctccatctgggaaaaagttgaggtcattggttgaaattgggaggtacttggaacagaacccacactacatcagagaaggggttaacttatcccagttttcatttgccactcccaaacctctgcaagaagactatgttcagaagcatacatttggagatggtcatgagttactagggcttcatgagatatctcaaggacctccttctcgcagagaactgctcggtgaacttggcatttcagctttgggtcgtgttgacactgaccagcccgagatgtcagatagtgtcagtcttcaccagctcaaggtgtctgaaccaccagctcagcactgcaagagaactgtgaagcaagtatcatcgaggaagtgtcgaaggactcctccagcagcgaggtatccattcgaagaacaatctggtggccacacgaacgacatcgagcatgtgcagctgtga

SEQ ID NO: 20077 - protein, 341 aa, Sorghum bicolor
  misc_feature: Useful for making plants with altered terpenoid content
  misc_feature: Functional homolog of the protein sequence given in SEQ ID NO 13054
  misc_feature: Useful for making plants with altered alkaloid content
  misc_feature: Functional homolog of the protein sequence given in SEQ ID NO 13172
  misc_feature: Ceres ANNOT ID no. 8744515
  misc_feature (98)..(151): Pfam ID: zf-CW Pfam Description: CW-type Zinc Finger
  misc_feature (158)..(234): Pfam ID: MBD Pfam Description: Methyl-CpG binding domain
MRTFQQNPEDRRVNTSKPWTSKKKFCELPDSVEVHIIDDDSNDSSKDYSVEDASKQLAIYNPDITHDKQTDMDHYASPHQSSKKPRRGYGTVLPSIGTYTVQCAKCYKWRIVPTKEKYQELRGSISQELFVCARAREWNRELSCVELEDISQDGSRMWAIDRPNIVQPPPGWDREVRLRGASTKFADVYYTSPSGKKLRSLVEIGRYLEQNPHYIREGVNLSQFSFATPKPLQEDYVQKHTFGDGHELLGLHEISQGPPSRRELLGELGISALGRVDTDQPEMSDSVSLHQLKVSEPPAQHCKRTVKQVSSRKCRRTPPAARYPFEEQSGGHTNDIEHVQL

SEQ ID NO: 20078 - DNA, 378 bp, Sorghum bicolor
  misc_feature: Ceres ANNOT ID no. 8744527
  misc_feature: Encodes the peptide sequence at SEQ ID NO 20079
atgtggaggctgaaagagagtgaaggtgacaggcaggtgtgggagttcgacaccgacactggcacaccggaagagcgcgccgaggtcgagaggctgcatcaggacttcacccgccaccgcttccagaagaaagagtcccaggacctcctcctgcgcatgcggtatgcaaaattaaaccaacgactacatccttcaactccatcgatgaagcttgaaaacagtgaagaagtgactgaagaaatactattaacttcattaaggcgagctttaagtcaacattctactttacaagcacatgatggtcattggcctggagagtacagtggacttttgatcattatgccaatgtttgtaagtacttcaggtttcatccgttaa

SEQ ID NO: 20079 - protein, 125 aa, Sorghum bicolor
  misc_feature: The sequence is a functional homolog of SEQ ID NO 15 in US patent 7186884
  misc_feature: Ceres ANNOT ID no. 8744527
  misc_feature (1)..(120): SWISSPROT Homolog: EC 5.4.99.8 Cycloartenol synthase
MWRLKESEGDRQVWEFDTDTGTPEERAEVERLHQDFTRHRFQKKESQDLLLRMRYAKLNQRLHPSTPSMKLENSEEVTEEILLTSLRRALSQHSTLQAHDGHWPGEYSGLLIIMPMFVSTSGFIR

SEQ ID NO: 20080 - DNA, 3216 bp, Sorghum bicolor
  misc_feature: Ceres ANNOT ID no. 8744533
  misc_feature: Encodes the peptide sequence at SEQ ID NO 20081
atgtcggcgtacggccgcctcaagctcttcacgtacgacgagctcaggaaggccaccggcgacttcaacccggggcagatcgtcggcgagggcggcttcggcgtcgtctacagaggggtcatcgacggcgccgtgcgcaaggggtacccgcccacggaggtcgccgtcaaggtgctcaacccagaggggctccagggcgacagggagtggctgacggaggtgagctacctcgggcagtacagccacccgaacctggtggagctcatcggctactgctgcgaggacgaccaccggctgctggtgtacgagttcatggccaagggcagcctggagcaccacctgttccgccgcgcctgcagcctgtcgtggacgacgcggctggccatcgcgctgcacgtcgccaggggcctcgccttcctccacgggcccgaccgccccatcatctaccgggacttcaagacctccaacatcttgctcgacgcggaattcaacgccaagctgtcggacttcgggctcgccaaggagggaccaatgggcggcgagacgcacgtgtccaccagggtcatgggcacctacggctacgcggcgccggagtacatagccaccgggcacctgacggtgatgagcgacgtgtacggcttcggcgtggtgctgctggagatgctggtggggcggcgcgcgctggagccgagcagggcgggggcccgcgaaggcagcctggtggactgggcccggccaatactgatccggcccaagaagctggagcggatcctggaccggcggatgggcgaggtgggctcggagatgggcctggagcgcgtggcccgcctcgcctacgactgcctcagccagaaccccaaggtccggccgtccatggccagggtcgtcaccacgctcgaggccgtcctcgccgccgccgacgacgccccgccgcggttgatgaagaactttgacttaaacatgccggcagcgttcggctgcactcactttggctgtgccagttccacaaaagagatcatgtggaggctgaaggtgtgggagttcgacgccgacgctggcacgccggaggagcgcgccgaggtcgagaggctgcgtcaggacttcacccgccaccgcttccagaagaaagagtcccaggacctcctcctgcgcatgcagtatgcaaaacaaaaccaccttgtagaaaatattcctgccgtgaagcttgaaaagggtgcagaggttacagaggagattctattaacttcattgaagcgagctatgaatcagtattctgctctacaagcacatgatgggcattggcctggtgattacagtggaattctgttcattatgccaatatttatatttgctctgcatgttactgggtccattaatgtcgtgttatcgttagagcatcgacgagagatactacgctacatttacaaccatcagaatgaagatggaggttggggcacacaagtgttggggccaagtagcatgtttggatcatgcttgaactatgctacattgaggcttcttggcgaggcgccaaatggcgagaatgatgcgttggccaaagggcgtgcttggattttaacccacggaagtgcaactgcgataccacaatggggaaagatatggctctctataattggtgcttatgaatggtcaggaaataatccaataattcctgaattgtggatggttccatattttcttccaatccatccaggacgattttggtgtttttgccgtttggtgtatatgcccatggcttacctttatgggaagaaatttgttgggcccatcactgaaactatactggaattaagagaggagctctatagcataccatatgacactattgactggaacaaggctcgtcattcttgtgccaaggacgaccttcgctatcctcgctcagagttgcaaaatattattttcagttgtctcaacaagtttgtggagccaatgttaaattgctggccagttaacaagctgcgagagaaagctttggacaacctcatggagcacatccactatcaagagaaaactaccaaatacatttgtatttgtcctattgataagaaaaatccaaattcagatgcattcaagaagcatcttccaaggatttatgattacttgtggcttgcagaagatggcatgaaggcacaggtttatgatggctgtcagagctgggagacagcattcatagttcaagccttttgctcaacagatcttgccaatgaatttagtcaaactctagaaagagcatacgattttatcaaaaaatcacaggttcttgaaaatcatataaattacgaaagctattatcgtcataaatcaaagggttcatggacactttcaacagcagacaacggatggtctgtatcagattgtacagcagaagctctcaaggcattactgttgttgtcaaagatttcacccaaacttgttgcccaaccaataaaacaggaaaggttatatgatgccattgacagcatcctttcttttatgaacaaagacggaaccttttcaacatatgaatgtaaaagaacagtctcttggatagagattctcaatccttctgagagctttataaacatcgtcgtggattatccatctgttgaatgcacatcatcagttctcgaagctttgacattgttcaaagagctatatccaccataccgtgccaaagagatcaaaaaatgtattaaggattgtgctatgtttattgagaacaaacaacgaaaggatggttcatggtatggaacttggagcatatgtttcacttatggaaccatgtttgcaataaaaggattggttgctgctggaagcacatatgatactagttcttgcatcaggaaagcatgcaaatttctgttgtcaaagcaacaaattacaggtggatggggggaaagctatctatctagcgaaacagaggattatgttgatggaggtactcctcatgcagtaaacactgcttgggcaatgttagctttgatttatgccggccaggttgagcgcgatccagtaccattatgtcatgctgcaagagaattgatcaacatgcagctagagacaggcgagttcccccaacaggaacacgttgggtgctttaactcctccctctactacaactatgccaactatcgcaacttattccccatttgggcccttggagaatttcgccgacggcttctcgcaaacaagagcttatctcagtgcatatga

SEQ ID NO: 20081 - protein, 1071 aa, Sorghum bicolor
  misc_feature: The sequence is a functional homolog of SEQ ID NO 15 in US patent 7186884
  misc_feature: The sequence is a functional homolog of SEQ ID NO 6 in US patent 7122717
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8744533
  misc_feature (346)..(1062): SWISSPROT Homolog: EC 5.4.99.8 Cycloartenol synthase
  misc_feature (7)..(292): SWISSPROT Homolog: EC 2.7.11.1 Non-specific serine/threonine protein kinase
  misc_feature (22)..(299): Pfam ID: Pkinase Pfam Description: Protein kinase domain
  misc_feature (465)..(508): Pfam ID: Prenyltrans Pfam Description: Prenyltransferase and squalene oxidase repeat
  misc_feature (946)..(999): Pfam ID: Prenyltrans Pfam Description: Prenyltransferase and squalene oxidase repeat
  misc_feature (897)..(939): Pfam ID: Prenyltrans Pfam Description: Prenyltransferase and squalene oxidase repeat
MSAYGRLKLFTYDELRKATGDFNPGQIVGEGGFGVVYRGVIDGAVRKGYPPTEVAVKVLNPEGLQGDREWLTEVSYLGQYSHPNLVELIGYCCEDDHRLLVYEFMAKGSLEHHLFRRACSLSWTTRLAIALHVARGLAFLHGPDRPIIYRDFKTSNILLDAEFNAKLSDFGLAKEGPMGGETHVSTRVMGTYGYAAPEYIATGHLTVMSDVYGFGVVLLEMLVGRRALEPSRAGAREGSLVDWARPILIRPKKLERILDRRMGEVGSEMGLERVARLAYDCLSQNPKVRPSMARVVTTLEAVLAAADDAPPRLMKNFDLNMPAAFGCTHFGCASSTKEIMWRLKVWEFDADAGTPEERAEVERLRQDFTRHRFQKKESQDLLLRMQYAKQNHLVENIPAVKLEKGAEVTEEILLTSLKRAMNQYSALQAHDGHWPGDYSGILFIMPIFIFALHVTGSINVVLSLEHRREILRYIYNHQNEDGGWGTQVLGPSSMFGSCLNYATLRLLGEAPNGENDALAKGRAWILTHGSATAIPQWGKIWLSIIGAYEWSGNNPIIPELWMVPYFLPIHPGRFWCFCRLVYMPMAYLYGKKFVGPITETILELREELYSIPYDTIDWNKARHSCAKDDLRYPRSELQNIIFSCLNKFVEPMLNCWPVNKLREKALDNLMEHIHYQEKTTKYICICPIDKKNPNSDAFKKHLPRIYDYLWLAEDGMKAQVYDGCQSWETAFIVQAFCSTDLANEFSQTLERAYDFIKKSQVLENHINYESYYRHKSKGSWTLSTADNGWSVSDCTAEALKALLLLSKISPKLVAQPIKQERLYDAIDSILSFMNKDGTFSTYECKRTVSWIEILNPSESFINIVVDYPSVECTSSVLEALTLFKELYPPYRAKEIKKCIKDCAMFIENKQRKDGSWYGTWSICFTYGTMFAIKGLVAAGSTYDTSSCIRKACKFLLSKQQITGGWGESYLSSETEDYVDGGTPHAVNTAWAMLALIYAGQVERDPVPLCHAARELINMQLETGEFPQQEHVGCFNSSLYYNYANYRNLFPIWALGEFRRRLLANKSLSQCI

SEQ ID NO: 20082 - DNA, 1491 bp, Sorghum bicolor
  misc_feature: Ceres ANNOT ID no. 8744574
  misc_feature: Encodes the peptide sequence at SEQ ID NO 20083
atgaagacgccggcgccgccgctgaggaccgggagcaagaagggcagggccgctgccttctgcaacctcccgatgctcctcctcatcggcgccatccagttcctcgtcatctactcccccgccatcgatcgctacatggtcatggtcaccaaaggcaagcccgggttcccgtcgctgctgctggacggcaggcgaggcttcaagctggtggaggaggagtccatcccggagtcccgggtgcggtgcgacttcgcggacccgaggtcggacgtgtgcgagctggaaggcgccatccgcatccgcgggagcacgtcggaggtcttcgtcgtcgccggcgccggcgccgacggtctgctggcggcgaacgtgacgggtctggcgcccgggatgaacgcgacgagctggacgatccagccgtacacgcggaaaggcgaggtccgcgtgatgcgtggcatcacgacgctgacggtgcgcgtggtgtcccccggcgacgcgccgccctgcacggtgcggcacgacgtccccgccgtggtgtactccaacggcggctactgcggcaactactaccacgacttcaacgacaacatcatcccgctgttcgtgacgacgcgccacctgggcggcgaggtgcagctgctggtggcgcagaagcaggcgtggtggttccacaagtaccgggagatcgtggacgggctcaccaactacgacgccgtggacctcgacggcgccggcgaggtgcggtgcttccgtaaggccacgctggggctgcgtagcctcaaggacctcagcatcgacccgcgacgcgcgccgcggaacctgtccatggtggacttcaaacgcttcctcatgtggcggtacgcgctgccgcgggagcacgccatccggacggacgaggaggaggccgccggggccgggggtgggcaccggaggccccggctgctgctggtgacccggcggtcgcggcggcggttcgtgaacgtcccggagatcgtggcgctggcggaggaggtcgggttcgacgtgacgacgtcggacctgatgtcggcgtcggctaagaacaacaacaaggccggcgccggcgtcggggacgaagggcactcgcgcatggcggacgcgtcgaagctggtgaactcgttcgacgtgatggtggcggtgcacgggtccgggctgaccaacctggtgttcctgccgatgaacgcggtggtggtgcaggtggtgccgctggggcggatggagagcctcgccatggacgagtacggggtgccgccgcgggacatgaacatgcggtacatccagtacaacatcacggcggaggagagcacgctgtcggaggtgtacccgagggcgcaccccgtgctgctggaccccatgcccatccacgagcagagctggtcgctcgtcaatgacgtctacctcgggaagcaggacgtcaggctcgacgtccggcggttcaggcccgtcctcctcaaggccatccagctgctccggtga

SEQ ID NO: 20083 - protein, 496 aa, Sorghum bicolor
  misc_feature: Useful for making plants with altered carbohydrate content
  misc_feature: Functional homolog of the protein sequence given in SEQ ID NO 14766
  misc_feature: Ceres ANNOT ID no. 8744574
MKTPAPPLRTGSKKGRAAAFCNLPMLLLIGAIQFLVIYSPAIDRYMVMVTKGKPGFPSLLLDGRRGFKLVEEESIPESRVRCDFADPRSDVCELEGAIRIRGSTSEVFVVAGAGADGLLAANVTGLAPGMNATSWTIQPYTRKGEVRVMRGITTLTVRVVSPGDAPPCTVRHDVPAVVYSNGGYCGNYYHDFNDNIIPLFVTTRHLGGEVQLLVAQKQAWWFHKYREIVDGLTNYDAVDLDGAGEVRCFRKATLGLRSLKDLSIDPRRAPRNLSMVDFKRFLMWRYALPREHAIRTDEEEAAGAGGGHRRPRLLLVTRRSRRRFVNVPEIVALAEEVGFDVTTSDLMSASAKNNNKAGAGVGDEGHSRMADASKLVNSFDVMVAVHGSGLTNLVFLPMNAVVVQVVPLGRMESLAMDEYGVPPRDMNMRYIQYNITAEESTLSEVYPRAHPVLLDPMPIHEQSWSLVNDVYLGKQDVRLDVRRFRPVLLKAIQLLR

SEQ ID NO: 20084 - DNA, 1725 bp, Sorghum bicolor
  misc_feature: Ceres ANNOT ID no. 8744590
  misc_feature: Encodes the peptide sequence at SEQ ID NO 20085
atgggcggagggggcgcgatcgtccacggcttccgccgctggttccaccgccggaacggctccacctccggctccaaccagtcgtccgtcgccggcgagggggacgacggctcgtccgatctcgaggtcatcgaggacccggatctcgtcgcactccgcgccatccgcgtgcccaagcgcaagatgccgctgcccgtcgagagccacaggaagaactcggtggaaatggagttcttcacagagtacggagaggcaagccagtaccagatccaagaagtcattggtaaagggagctacggagtagttgctgcagctgtagatacccgcaccggtgagcgggttgctatcaagaagatcaatgatgtgtttgagcacgtctcggatgccacacgcatactgcgggagatcaagctccttcggttgcttcgccacccagacatagttgagattaagcacattatgctccctccttctcggagggagttccaagacatctatgttgtttttgagctcatggagtcggatctccatcaagtgatcaaggcaaatgatgacctcacccctgaacatcaccagtttttcttgtaccaacttcttcgtgctctaaagtacatacatgctgctaatgtatttcatcgcgacctaaagcccaagaatatactggctaactcggactgcaaactgaaaatatgtgacttcggacttgcccgtgcatcatttaatgatgccccttcagctatattttggacagattatgtggcaacaaggtggtaccgggcacctgaactttgtggttcctttttctccaaatacactcctgcaattgatatttggagcattgggtgcatatttgctgaacttctcactggaaggccattatttcctgggaagaatgttgtgcaccaattagatcttataacggatcttcttggaactccatcatctgagaccttatctcggattcgaaatgagaaggccaggagatacttgagctgcatgcggaaaaaatatcctgtgccctttactcataaatttcgaaatgctgatcctttggctcttcgtcttctagagcgtttacttgcatttgatcctaaagatcggcctactgcagaagaggctctagcagatccatactttgcatcccttgctaatgtggaacgtgagccatcaagacatccaatttctaaacttgagtttgaatttgaaagaaggaagctggccaaagatgatgttagagaattgatctatcgagagattttggagtatcatccacagatgctggaggagtacatgaaaggtggagaacagattagcttcctctatccaagtggagttgatcggttcaaacggcagtttgcacatcttgaggagcattatagcaaaggagaaagaggttctccactgcaaagaaagcatgcttccttaccaagggaaagagtggttgtatcgaaggatggcaatactgaacaacatattaatgatcaggagaggagtgcagattctgttgcccgcactactgtgagccctccaaggtcagaagatgccgacatgaatgatgtgaaatccacaagtttaagctctcggagctacctgaagagcgcaagcataagtgcttccaagtgtgtcgttgtcaaaaataaacacccagaggatgatgaaatcccagaggaaatggaaggcgtcgtcgatggattgtctgaacaggtctccaggatgcactcctag

SEQ ID NO: 20085 - protein, 574 aa, Sorghum bicolor
  misc_feature: Useful for making plants with altered cell wall content and/or composition
  misc_feature: Functional homolog of the protein sequence given in SEQ ID NO 14430
  misc_feature: Ceres ANNOT ID no. 8744590
  misc_feature (1)..(574): SWISSPROT Homolog: EC 2.7.11.24 Mitogen-activated protein kinase
  misc_feature (88)..(379): Pfam ID: Pkinase Pfam Description: Protein kinase domain
MGGGGAIVHGFRRWFHRRNGSTSGSNQSSVAGEGDDGSSDLEVIEDPDLVALRAIRVPKRKMPLPVESHRKNSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIKANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDLITDLLGTPSSETLSRIRNEKARRYLSCMRKKYPVPFTHKFRNADPLALRLLERLLAFDPKDRPTAEEALADPYFASLANVEREPSRHPISKLEFEFERRKLAKDDVRELIYREILEYHPQMLEEYMKGGEQISFLYPSGVDRFKRQFAHLEEHYSKGERGSPLQRKHASLPRERVVVSKDGNTEQHINDQERSADSVARTTVSPPRSEDADMNDVKSTSLSSRSYLKSASISASKCVVVKNKHPEDDEIPEEMEGVVDGLSEQVSRMHS

SEQ ID NO: 20086 - DNA, 1389 bp, Sorghum bicolor
  misc_feature: Ceres ANNOT ID no. 8744577
  misc_feature: Encodes the peptide sequence at SEQ ID NO 20087
atgaccatgaagcagccgaggggccggcaggagccgcgccggatgggcaacgccgccatggtcgtcaccatgctcgtctccctctgcgtcctcacctacatcaaggcgcgatactgctccaaccccttccccaagccggcggaggagctggaggtagtggaggtggacgaggactacgacagcacgcggtacaagctctcaggccccatcggcgaggaggacttcgacccgtcccgcccgacctgctacaacaccagcaagcgctccgagcggtgcgccgccgtgggcgacatccgcgtggacggcaaccactcgcggatctacatcagccctctgtcccgcgagtggaagaccaagccgtacgcgcgcctgcacgacccggtggccatggacgacgtccgcgagttcacgctcgtccccttcggtcccggctcccccaacggcaccgtcgtcccgccgctctgcacgcggaaccactccgtcccgggtttcctcttctccagcggcgggttcgcgggcaacctctaccacgactacgccgacgtgctggtgccgctcttcgcgtccacgcaccacttcggcggggaggtccagttcctgctcgccgacatcaaggactggtgggccgacaagttcaagcccctcttccgccagctctcccgctacgacgtcatcgacgtgaacaacgaccgcgaggtgcactgcttcccgcggatcgtcatcggctccaccttccaccgcgccatgggcatcgacgcgtcgcggtcccccggtggcgagacggtggccgacttcaagcgcgtgctccgccgcgcgttcaagctggaacgcgccgtggcgtcgcggtcgggggcgccccggcgcaaggaccggcccaggctcctcatcatctcccgcaagagctcgcgccggttcgtgaacgagcgcgccatggcgcgcgccgccgcggcggccaagttcgacgtgcggatcgccgagccggacaaccacacggacatgccaaacttcgcgcggctggtgaactcggcggacgtcatgatgggcgtgcacggcgccgggctcaccaacatggtgttcctgcccagccgcgccgtgctggtgcaggtggtgccgttcggcgggctggagtggctcaccagggtcaccttcaaggaccccgccagggacatggacgtcacctacatggagtacaacgtgtcgctggaggagagctcgctcagggacctctacccggaggaccatttctacctgaagcacccctacgacgtgcacaagaagggctgggacgccatcaagacggtgtacctggacaagcagaacgtcaggctcaacctcaccagattcacaaggacgctggagcaggcacgagatctcttgccgtcgccatga

SEQ ID NO: 20087 - protein, 462 aa, Sorghum bicolor
  misc_feature: Useful for making plants with altered carbohydrate content
  misc_feature: Functional homolog of the protein sequence given in SEQ ID NO 14477
  misc_feature: Ceres ANNOT ID no. 8744577
MTMKQPRGRQEPRRMGNAAMVVTMLVSLCVLTYIKARYCSNPFPKPAEELEVVEVDEDYDSTRYKLSGPIGEEDFDPSRPTCYNTSKRSERCAAVGDIRVDGNHSRIYISPLSREWKTKPYARLHDPVAMDDVREFTLVPFGPGSPNGTVVPPLCTRNHSVPGFLFSSGGFAGNLYHDYADVLVPLFASTHHFGGEVQFLLADIKDWWADKFKPLFRQLSRYDVIDVNNDREVHCFPRIVIGSTFHRAMGIDASRSPGGETVADFKRVLRRAFKLERAVASRSGAPRRKDRPRLLIISRKSSRRFVNERAMARAAAAAKFDVRIAEPDNHTDMPNFARLVNSADVMMGVHGAGLTNMVFLPSRAVLVQVVPFGGLEWLTRVTFKDPARDMDVTYMEYNVSLEESSLRDLYPEDHFYLKHPYDVHKKGWDAIKTVYLDKQNVRLNLTRFTRTLEQARDLLPSP

SEQ ID NO: 20088 - DNA, 1464 bp, Sorghum bicolor
  misc_feature: Ceres ANNOT ID no. 8744641
  misc_feature: Encodes the peptide sequence at SEQ ID NO 20089
atggatggaaggtgggagcgggaggagatggatgacacatgggctttgcgcgaggataaaaaggtttggatggctgcacggaaagaaaaccctgagcttattgcttgtcaagcacccaatggtcgaatcacgcgagctcaagccgctgcaaatcgtcgaagctttggtgttctcccttctgttccactgcctgcaaaaactgatcgaaaacagactacacaagggaagatgaaaaggggatcttcatatgacaacactagtgcaagtactgcaatttctggcccccagcctaagaggcgcacagttctcagggatgtgaccaatttgcgtaatgctaactctaacaaaacttttgctgctgcaccgaaggttcagacaaggccctccctaaggactggaagaaccgtgaccagaggcaagcagtgcacaaaaaggattcctaaaataccccaaccagctggtaatggtggttcattcgccaatgattcgagcattgccgaagaaacacaagagaaacttttggcacagaaagaagaacctattcttttgcttgagaacaggggctcactgtcattgcagaatgttgaaaggaacagggacagtgcttgtcatgaggcattctttaaggaaagaaatgtcagggatatatgtgaaccttctgtgtcaaagaatggggactcttctgtgttagacattgtagatatcgacaaagataatggcaatcctcaaatgtgtgcttcctacgttgtagagatatactcaaaccttatggtttcagagcttatgagaagacccagtccgaattacatggagggtttgcaacgggacatcactaagggcatgagaggaatactcattgattggcttgtggaggtttctgaagaatacaagcttgttccagacacgctgtacctaactgtatatgttattgaccgaaagtatgaagagatatgtgctcctcgagttgaagaattctgtttcataaccgacaatacatacacaaaggcagaggtgctgaaaatggagtgccaagtgctgaacgacctgggatttcatctttctgttccaactacaaaaacatttctcaggagattccttagagcggcacaagcatctcgtaaaattccttctatgactttgggatttctggccaattatcttgcggagttgactttgaccgattatgagttcttgaaatttcttccatcattggtggcagcatcggctgtgtttcttgctagatggacacttgaccaatccgacgaaccatggaaccaaactctagagcactacacctcttacaaatgctctgacattcaattatgtgtctgtgctctacgagaactccagcataacaccagtaactgtcctcttaacgccatccgtgagaagtacaaacatcaaaagtttgattgcgtagcaaacctaacctcaccggagctccctcggtcgctcttcagctga

SEQ ID NO: 20089 - protein, 487 aa, Sorghum bicolor
  misc_feature: Useful for making plants with modulated nitrogen use efficiency
  misc_feature: Functional homolog of the protein sequence given in SEQ ID NO 13108
  misc_feature: Ceres ANNOT ID no. 8744641
  misc_feature (356)..(483): Pfam ID: Cyclin_C Pfam Description: Cyclin, C-terminal domain
  misc_feature (251)..(354): Pfam ID: Cyclin_N Pfam Description: Cyclin, N-terminal domain
MDGRWEREEMDDTWALREDKKVWMAARKENPELIACQAPNGRITRAQAAANRRSFGVLPSVPLPAKTDRKQTTQGKMKRGSSYDNTSASTAISGPQPKRRTVLRDVTNLRNANSNKTFAAAPKVQTRPSLRTGRTVTRGKQCTKRIPKIPQPAGNGGSFANDSSIAEETQEKLLAQKEEPILLLENRGSLSLQNVERNRDSACHEAFFKERNVRDICEPSVSKNGDSSVLDIVDIDKDNGNPQMCASYVVEIYSNLMVSELMRRPSPNYMEGLQRDITKGMRGILIDWLVEVSEEYKLVPDTLYLTVYVIDRKYEEICAPRVEEFCFITDNTYTKAEVLKMECQVLNDLGFHLSVPTTKTFLRRFLRAAQASRKIPSMTLGFLANYLAELTLTDYEFLKFLPSLVAASAVFLARWTLDQSDEPWNQTLEHYTSYKCSDIQLCVCALRELQHNTSNCPLNAIREKYKHQKFDCVANLTSPELPRSLFS

SEQ ID NO: 20090 - DNA, 1140 bp, Sorghum bicolor
  misc_feature: Ceres ANNOT ID no. 8744657
  misc_feature: Encodes the peptide sequence at SEQ ID NO 20091
atggcacggcacggtggtggattgcaacgcacgcgcccagagcgagccggccgcgtcagatcacggggcagggggctgggcgcggccggcagtcgcaggcagcgacggccggggcgggcgggcagtgcacggcaccacacggcacggtgccccacgcctttcacggatccggtagctgtctccgtccacgccgcgcaccgcacctcgtcctctccaccccgaattgcacacgcacacaccttgtccttccatcccttgccgcaccaccgcccaccccctcctctcatctgcctctccatttcgtcgtcgtcttcttcttcctcctccttcgatctccacccatccaccgccggcgcggccgggatccgcagctcgagaccgacggtggagcgcggcggcgagcatcagcagccgacgacggcggaggaggaggatccgcgccgccgccgtcccgagacgccgccgccacccacgatggggcgcggcaagatcgagatcaagcggatcgagaacgccaccaaccggcaggtgacctactccaagcgccgcacggggatcatgaagaaggcgcgcgagctcaccgtgctctgcgacgcccaggtcgccatcatcatgttctcctccaccggcaagtaccacgagttctgcagccccgggaccgacatcaagaccatctttgaccgataccagcaggccatcgggaccagcctatggaacgagcagtatgagaatatgcagcgcacgctgagccatctcaaggacatcaatcgcaacctgcgcacagagattaggcaaaggatgggcgaggatctggacactctggagttcgacgagctgcgcggtcttgagcaaaatgttgatgcggctctcaaggagtaccatgtgatcgccacacagactgaaacttacaagaaaaaggtgaagcactcgtacgaggcgtacaagaacctgcagcaggagctgggcatgcgcgaggacccggcgttcgggttcgtggacaacactggcgccggcggttgggacggcgccgcggcggcgctgggcggcggcgccccggacatgtacgccttccgcgtggtgcccagtcagcccaacctgcacggcatggcctatggctcccacgacctccgtcttggctag

SEQ ID NO: 20091 - protein, 379 aa, Sorghum bicolor
  misc_feature: The sequence is a functional homolog of SEQ ID NO 2 in US patent 7049489
  misc_feature: Useful for making plants with altered lignin content
  misc_feature: Functional homolog of the protein sequence given in SEQ ID NO 13115
  misc_feature: Useful for making plants with modulated biomass
  misc_feature: Functional homolog of the protein sequence given in SEQ ID NO 13659
  misc_feature: The sequence is a functional homolog of SEQ ID NO 1701 in the 10/412,699 US patent application
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: Useful for making plants with modulated flowering time
  misc_feature: Functional homolog of the protein sequence given in SEQ ID NO 13660
  misc_feature: The sequence is a functional homolog of SEQ ID NO 1955 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: Ceres ANNOT ID no. 8744657
  misc_feature (167)..(217): Pfam ID: SRF-TF Pfam Description: SRF-type transcription factor (DNA-binding and dimerisation domain)
  misc_feature (229)..(323): Pfam ID: K-box Pfam Description: K-box region
MARHGGGLQRTRPERAGRVRSRGRGLGAAGSRRQRRPGRAGSARHHTARCPTPFTDPVAVSVHAAHRTSSSPPRIAHAHTLSFHPLPHHRPPPPLICLSISSSSSSSSSFDLHPSTAGAAGIRSSRPTVERGGEHQQPTTAEEEDPRRRRPETPPPPTMGRGKIEIKRIENATNRQVTYSKRRTGIMKKARELTVLCDAQVAIIMFSSTGKYHEFCSPGTDIKTIFDRYQQAIGTSLWNEQYENMQRTLSHLKDINRNLRTEIRQRMGEDLDTLEFDELRGLEQNVDAALKEYHVIATQTETYKKKVKHSYEAYKNLQQELGMREDPAFGFVDNTGAGGWDGAAAALGGGAPDMYAFRVVPSQPNLHGMAYGSHDLRLG

SEQ ID NO: 20092 - DNA, 1188 bp, Sorghum bicolor
  misc_feature: Ceres ANNOT ID no. 8744705
  misc_feature: Encodes the peptide sequence at SEQ ID NO 20093
atggggtgcttcacgttcaggagcggcggcgggtccaaatcccagcacccgcggtccggcgcccggacgccggcggccaagtcggccccggcgtcgtcgtcgtcctcctctccctcctcttccggcggcgtgcacagcaagaccaaggcgtcggcggcgtccacgcccacgcggaccatccaggagctgtcggaggagcggggcgcgcagcggctccgggtgttcgacctcgacgagctcggcagcgccaccaacggcttcagccgcgcgctcaagctcggcgagggcggcttcggctccgtctaccgcgccttcttccgctccgcctccggcgcccgcgtcgtgctcgccgtcaagcgcctcaaccagcgcagcctccaggggcacaagcaatggcttgctgaagtccaattccttggtgttcttgagcacccgaatctcgtaaagctgatcggctattgcgcagtggattcagaagcaagcaagcacaggctgctggtctacgagttcatgcccaacaagagtttggatgaccacctgttcaaccgagcacatcctcccctttcatggagacagaggctgcagatcatgatcggtgctgcacggggtctggattacctccatgaaggagtgcctgaagttcaggtgatctacagggatttcaaagcgtccaacatccttctagacgccgaattcaagccaaaactgtcggattttggcctggcaagggagggtccaaccgaagggaaaacacacgtctccaccgcggtggtgggaacgcacgggtacgcggcgccagactacatcgagacagggcacttgacggcaaagagcgacgtgtggagcttcggcgtggtgctgtacgagatcctgacggggcggcggtcgctggagcgcagccgccccgcggaggagcagaagctgctggggtgggtgcggcagcacccgccggacagtgctgggttccgggccatcatggacccgcggctgggcggccggtacccgctggctgccgcgcgcgaggtggccagactcgctgaccgctgccttggcaagaaccccaaggagcggccgtcgatgagggacgtcgtcgaggagctcgaacgggtgctgcagatggagccgccaccgccgctggccgctgacaaaaagaaaggaggcgacggcagactgccgacgaagaggtga

SEQ ID NO: 20093 - protein, 395 aa, Sorghum bicolor
  misc_feature: Useful for making plants with modulated heat sensitivity
  misc_feature: Functional homolog of the protein sequence given in SEQ ID NO 14079
  misc_feature: Ceres ANNOT ID no. 8744705
  misc_feature (46)..(370): SWISSPROT Homolog: EC 2.7.11.1 Non-specific serine/threonine protein kinase
  misc_feature (87)..(367): Pfam ID: Pkinase Pfam Description: Protein kinase domain
MGCFTFRSGGGSKSQHPRSGARTPAAKSAPASSSSSSPSSSGGVHSKTKASAASTPTRTIQELSEERGAQRLRVFDLDELGSATNGFSRALKLGEGGFGSVYRAFFRSASGARVVLAVKRLNQRSLQGHKQWLAEVQFLGVLEHPNLVKLIGYCAVDSEASKHRLLVYEFMPNKSLDDHLFNRAHPPLSWRQRLQIMIGAARGLDYLHEGVPEVQVIYRDFKASNILLDAEFKPKLSDFGLAREGPTEGKTHVSTAVVGTHGYAAPDYIETGHLTAKSDVWSFGVVLYEILTGRRSLERSRPAEEQKLLGWVRQHPPDSAGFRAIMDPRLGGRYPLAAAREVARLADRCLGKNPKERPSMRDVVEELERVLQMEPPPPLAADKKKGGDGRLPTKR

SEQ ID NO: 20094 - DNA, 1569 bp, Sorghum bicolor
  misc_feature: Ceres ANNOT ID no. 8744708
  misc_feature: Encodes the peptide sequence at SEQ ID NO 20095
atggcgcggcggtgttgctgcggctgcaccgtgcggtgctgctgctggctcctggtgctgacgctgctggcgctcgcggtcacggccgccatcgtgttcgcccgctacaaggacggcggcaacgtcttccccatccccggcgtgccggaccccaagtacgccgaggccctcgccgtggcgctccgcttcttccaggtccagaaatccgggaagctggtgaacaacacgatcccgtggcgaggggactcggcgctgcgcgacggcgaggacgccaagctggacctgtccaagggcatgtacgacgccggcgaccacatgaagttcggcttcacgctggcgttcaccggcaccatgctgtcgtggtccgtcctcgagtacggcgacgccatgcgcgccgcccaccagcgcgacgccgccatggacgcgctgggctggatcatggagttcctcgtcaacgcgcacccctccgacgacgtgctctacatccaggtgggcgacccgaaatcggaccacaagtgctgggagcggccggagacgatgtcggagaagaggccgctgacgaagatcaccgcgaaatcccccggcagcgacgtggccgcggagacggcggcggccatggccgccgcgtcgatggtgtacaagcccgccaacgcgacctacgcgtcgtcgctcctggaccacgccgagcggctgttcgcgttcgccgacaagcaccggggctcgtacacgcgcacgttcccggagctcagcgcctactacaactccaccacgtaccaggacgagctcctgtgggccgccagctggctgtaccacgccaccggcaaccacagctacctgagctacgccaccggcaagaacgccgaccagttcgccgacctcggcaaccccaggtacttcagctgggacgacaaacgcgccggcaccgaggttctcttgtcaagggtgaggttcttcgccgcagatggatctgatgccggacaagacgaggtgcttggatcgtacaaggacaccgccgaagccgtcatgtgcattctcctgccggagtcggacacggccgccttcagaacagaaggggggttgctgtacgtggcggagtgggactcgctgcagcacccggtggcgtcggcgttcctcgccaacgtctacagcaactacatggcgacgtcggggaagtcggagctgacctgcagcggcaagagcttcacggcgctggacctgcgcaagttcgccaagtcgcaggcggactacgtcctcggcgacaaccccatgaagctgagctacctcgtcggcttcggcgacacctacccgcagcgggtgcaccaccgcggcgcgtccatccccgccgacgtcgacaccggctgcgacggccagaagtggctcaagtcgccagaccccaacccgaacgtcgccaccggcgcgctggtcggcgggccgttcaagaacgactcgttcgtcgacgacagggagaacgtgcagcagaacgagccgacgacgtacaacagcgcgctcgtcgtcggcctgctctccagcctcctctccaccgcccccgtggccaagtccctctcgtga

SEQ ID NO: 20095 - protein, 522 aa, Sorghum bicolor
  misc_feature: Useful for making plants with altered cell wall content and/or composition
  misc_feature: Functional homolog of the protein sequence given in SEQ ID NO 13839
  misc_feature: Ceres ANNOT ID no. 8744708
  misc_feature (16)..(522): SWISSPROT Homolog: EC 3.2.1.4 Cellulase
  misc_feature (52)..(509): Pfam ID: Glyco_hydro_9 Pfam Description: Glycosyl hydrolase family 9
MARRCCCGCTVRCCCWLLVLTLLALAVTAAIVFARYKDGGNVFPIPGVPDPKYAEALAVALRFFQVQKSGKLVNNTIPWRGDSALRDGEDAKLDLSKGMYDAGDHMKFGFTLAFTGTMLSWSVLEYGDAMRAAHQRDAAMDALGWIMEFLVNAHPSDDVLYIQVGDPKSDHKCWERPETMSEKRPLTKITAKSPGSDVAAETAAAMAAASMVYKPANATYASSLLDHAERLFAFADKHRGSYTRTFPELSAYYNSTTYQDELLWAASWLYHATGNHSYLSYATGKNADQFADLGNPRYFSWDDKRAGTEVLLSRVRFFAADGSDAGQDEVLGSYKDTAEAVMCILLPESDTAAFRTEGGLLYVAEWDSLQHPVASAFLANVYSNYMATSGKSELTCSGKSFTALDLRKFAKSQADYVLGDNPMKLSYLVGFGDTYPQRVHHRGASIPADVDTGCDGQKWLKSPDPNPNVATGALVGGPFKNDSFVDDRENVQQNEPTTYNSALVVGLLSSLLSTAPVAKSLS

SEQ ID NO: 20096 - DNA, 741 bp, Sorghum bicolor
  misc_feature: Ceres ANNOT ID no. 8744732
  misc_feature: Encodes the peptide sequence at SEQ ID NO 20097
atggatccgtcgggcggcgcgttcctgccgcagctgcaagctgggagctcctccttcccgcggtcctccagcaacacgtcgctcgccaggaccggtagcgccggccgcgggaggggcggcaccaggggcaggaagatgatgcgcagggtctgccgcggcgtcatcaccttcatcttcgccatcgctgggctgttcctgggagcggtgaccggcggtctgatcgggctggcgacggagagcgggctgttccgcggcaccgggatcggcgccatcaccggcgcgctcgtctccatcgaggtcgtcgactcctccatccggctctggcagtcgcggcgctccgggatctggagcatcctctacgtgctgaacgtgatctacagcctcctgaccggcaggctggtgcgcgagaaggtcgacccggcggtgcagagggtggtccggagccagatgaacgcggtggactcgtcgccgttcagggagtcgccggacctgttcgaggtggaggccaccaacggcatgccgcgggcgtccatcgacaagctccccgagtcgtggatcaccgaggagtacaggcgcgacgccgtcggcgacctctccggatgctccgtctgcctccaggatttccaggtcggggagaaggtgcggagcctgccggactgctggcacgtgttccacgtgccgtgcatcgacggctggctcatcaagcacggctcctgcccgctctgcaggaggaagctctag

SEQ ID NO: 20097 - protein, 246 aa, Sorghum bicolor
  misc_feature: Useful for making plants with modulated nitrogen use efficiency
  misc_feature: Functional homolog of the protein sequence given in SEQ ID NO 12909
  misc_feature: The sequence is a functional homolog of SEQ ID NO 216 in the 10/225,068 US patent application
  misc_feature: The sequence is a functional homolog of SEQ ID NO 2322 in the 10/374,780 US patent application
  misc_feature: The sequence is a functional homolog of SEQ ID NO 242 in the 10/412,699 US patent application
  misc_feature: The sequence is a functional homolog of SEQ ID NO 515 in the 11/479,226 US patent application
  misc_feature: Ceres ANNOT ID no. 8744732
  misc_feature (201)..(242): Pfam ID: zf-C3HC4 Pfam Description: Zinc finger, C3HC4 type (RING finger)
MDPSGGAFLPQLQAGSSSFPRSSSNTSLARTGSAGRGRGGTRGRKMMRRVCRGVITFIFAIAGLFLGAVTGGLIGLATESGLFRGTGIGAITGALVSIEVVDSSIRLWQSRRSGIWSILYVLNVIYSLLTGRLVREKVDPAVQRVVRSQMNAVDSSPFRESPDLFEVEATNGMPRASIDKLPESWITEEYRRDAVGDLSGCSVCLQDFQVGEKVRSLPDCWHVFHVPCIDGWLIKHGSCPLCRRKL

SEQ ID NO: 20098 - DNA, 741 bp, Sorghum bicolor; identical to SEQ ID NO: 20096
  misc_feature: Ceres ANNOT ID no. 8744736
  misc_feature: Encodes the peptide sequence at SEQ ID NO 20099

SEQ ID NO: 20099 - protein, 246 aa, Sorghum bicolor; identical to SEQ ID NO: 20097
  misc_feature: Useful for making plants with modulated nitrogen use efficiency
  misc_feature: Functional homolog of the protein sequence given in SEQ ID NO 12909
  misc_feature: The sequence is a functional homolog of SEQ ID NO 216 in the 10/225,068 US patent application
  misc_feature: The sequence is a functional homolog of SEQ ID NO 2322 in the 10/374,780 US patent application
  misc_feature: The sequence is a functional homolog of SEQ ID NO 242 in the 10/412,699 US patent application
  misc_feature: The sequence is a functional homolog of SEQ ID NO 515 in the 11/479,226 US patent application
  misc_feature: Ceres ANNOT ID no. 8744736
  misc_feature (201)..(242): Pfam ID: zf-C3HC4 Pfam Description: Zinc finger, C3HC4 type (RING finger)

SEQ ID NO: 20100 - DNA, 2070 bp, Sorghum bicolor
  misc_feature: Ceres ANNOT ID no. 8744806
  misc_feature: Encodes the peptide sequence at SEQ ID NO 20101
atggcgccgccgtcggtgtcgtcctcccacctcctcatcaccgcctcgctcccaaagcccaagccttcctccctccgcccgccgcggctccctctcgccaagcccctccccacgggtgcggcgctcctcgctctcgcggcctcgcccgcgctcgccgccgacgcgcctacccccgccccggttcccccggctccggctcccgcgcccgagctccaggccgaggcgcccacgccgaccgccaatcccttctccacctccctcctgacagcccccaagccctccgcggcggcctccgacctccccgagggcgcgcagtggcggtacagcgagttcttgtccgccgtcaagcggggaaaagtcgagcgcgtgcgcttcaccaaggacgggggcctgctccagctgacggccgtcgacggccgccgcgccaccgtggtggtccccaacgacccggacctcattgacatcctcgccaccaacggcgtcgacatctccgtctccgagggcgagtccgctggccccggcggcttcgtcgccttcgtcggcaacctcctcttcccgttcctcgccttcgcgggcctcttcttcctcttccgccgcgcgcagggcgggcctggcgctggccccggcgggctcggcgggcccatggacttcggccgctccaagagcaagttccaggaggtgcctgagacgggcgtcacgttcctcgacgtcgctggtgcggaccaggccaagctcgagctgcaggaggtcgttgatttccttaagaaccccgataagtacaccgcgctcggagccaagatccccaaggggtgcctcctcgttggtccgcctgggactgggaagaccctcctcgcgcgtgccgtcgctggggaggctggggtgcccttcttctcctgcgcggcctctgagttcgtcgagctcttcgtcggtgtcggtgcctccagggtgcgcgacctcttcgagaaggccaaggccaaggcgccctgcattgtcttcattgatgagattgatgccgtcgggaggcagcgtggtgccggacttggtgggggtaatgacgagagggagcagaccattaatcagctcttgacggagatggatggcttcgctggcaacagcggtgtcattgtgcttgccgccaccaataggcctgatgtgctggactcggcactcctccggccagggaggttcgataggcaggtcaccgttgacaggccagatgttgcagggcgcgtcaagattcttgaggttcactcccgaggaaaggctttggcaaaagatgtcgactttgagaaaattgctagaaggactcctggtttcactggtgctgacctccaaaacctcatgaatgaggctgccatccttgctgctcgccgtgatcttaaggaaattagcaaggatgagatctctgatgctcttgagagaatcattgctggccccgagaagaaaaatgctgttgtttctgaggagaagaagaggcttgtcgcttaccatgaggctggtcatgcccttgttggcgccctcatgccagagtatgatccagtagccaagatttccatcattcctcgtggacaggctggtggactcacattctttgccccaagcgaagaaaggctagaatctggattgtacagcaggagctatcttgagaaccaaatggctgtagcccttggtggcagggttgctgaagaggtgatctttggccaagaaaatgtgacaacaggagcttccaacgattttatgcaagtgtcacgtgtcgcaagacaaatggtcgaaagatttggattcagtaagaagatcggccaagttgcgattgggggacctggtggaaaccctttcttggggcaacagatgtcgagccagaaggactactcgatggcaactgctgatgttgtggatgctgaggtgagggaactcgtggagaaggcctactctagagcaacgcagatcatcaccacgcacattgacatcctccacaagctcgctcaactcctgatcgagaaggagactgtggacggggaggagttcatgagcttgttcattgacggccaggctgagttgtttgtcgcttga

SEQ ID NO: 20101 - protein, 689 aa, Sorghum bicolor
  misc_feature: Useful for making plants with modulated heat sensitivity
  misc_feature: Functional homolog of the protein sequence given in SEQ ID NO 14426
  misc_feature: Ceres ANNOT ID no. 8744806
  misc_feature: Up-regulated in shoot tissues in response to salicylic acid treatment
  misc_feature: Up-regulated in root tissues in response to salicylic acid treatment
  misc_feature (232)..(468): SWISSPROT Homolog: EC 3.6.4.3 Microtubule-severing ATPase
  misc_feature (464)..(678): Pfam ID: Peptidase_M41 Pfam Description: Peptidase family M41
  misc_feature (270)..(457): Pfam ID: AAA Pfam Description: ATPase family associated with various cellular activities (AAA)
  misc_feature (104)..(244): Pfam ID: FtsH_ext Pfam Description: FtsH Extracellular
MAPPSVSSSHLLITASLPKPKPSSLRPPRLPLAKPLPTGAALLALAASPALAADAPTPAPVPPAPAPAPELQAEAPTPTANPFSTSLLTAPKPSAAASDLPEGAQWRYSEFLSAVKRGKVERVRFTKDGGLLQLTAVDGRRATVVVPNDPDLIDILATNGVDISVSEGESAGPGGFVAFVGNLLFPFLAFAGLFFLFRRAQGGPGAGPGGLGGPMDFGRSKSKFQEVPETGVTFLDVAGADQAKLELQEVVDFLKNPDKYTALGAKIPKGCLLVGPPGTGKTLLARAVAGEAGVPFFSCAASEFVELFVGVGASRVRDLFEKAKAKAPCIVFIDEIDAVGRQRGAGLGGGNDEREQTINQLLTEMDGFAGNSGVIVLAATNRPDVLDSALLRPGRFDRQVTVDRPDVAGRVKILEVHSRGKALAKDVDFEKIARRTPGFTGADLQNLMNEAAILAARRDLKEISKDEISDALERIIAGPEKKNAVVSEEKKRLVAYHEAGHALVGALMPEYDPVAKISIIPRGQAGGLTFFAPSEERLESGLYSRSYLENQMAVALGGRVAEEVIFGQENVTTGASNDFMQVSRVARQMVERFGFSKKIGQVAIGGPGGNPFLGQQMSSQKDYSMATADVVDAEVRELVEKAYSRATQIITTHIDILHKLAQLLIEKETVDGEEFMSLFIDGQAELFVA

SEQ ID NO: 20102 - DNA, 1260 bp, Sorghum bicolor
  misc_feature: Ceres ANNOT ID no. 8744839
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20103
atggggaactgcgccagcgccatcgacgctttcgtccagcgcggcaacagggcgtcgccgtcgccgtcgtcggccgctactcctggaatgtctgcatcgaggaggactagtagctctgccaccacagggaagctgtcaacgattagcagcaccagcaccttcatgccgtccacagttagtggtgtcagcgtcgacgacgattacccagagggccagattcttgagtctccgaacctcaagatatacacctttgcggaactcaagagcgccaccaagaacttcaggcctgagactgtgcttggggagggtggattcggcaaggtttacaagggatgggttgatgagaagactctgaacccgtcaaaggctagcactggcatcatggttgccgtcaagaagctcaatcctgagagcgtgcagggaatggaacaatggcagtctgaagtcaatttcctcgggaggatttcacatcccaatcttgtcaaactcttgggctattccatggatgacaacgagctactactcgtatatgagttcatgtcaaaggggagcttggagaaccacctgttccgaagaggggcggtttctgagccgctgccttggagcctcaggctgaagattctcattggtgcagctcgtggcctcgcatttcttcattcatcagaaaggcagatcatctaccgagacttcaaggcttccaacatcttactggattcgcacttcaacgcgaagctctcagacttcggattagccaagcatggtccagatggtggggagtctcatgtgacaacaagagtcatgggaacctatggctatgcagctccagagtatgtttctaccggccacctgtatgtgaagagtgatgtgtatggctttggtgttgtactactggagatgatctctggtctgagggcgttggacccaagccgccagagcgagaaggtgaacttggtaaactgggcaaggccattgttgtctgaccggaggaagcttagccagctgatggacagtgggctggaggggcagtacaatcccaaaggagccctcctggctgctcagctgaccctcaagtgcctgaacggtgacccaaagagccggccatccatgaaggaagtggtggaggcactggagaagatcgagtccgtgaagagcagggtgatgagggagcccaggaacagctcctcgtcctcgcgtcgcagtcaggtgcagtcccctaggagtgacagcgctaggaacaactccagctccaggggcaggtag

SEQ ID NO: 20103 - protein, 419 aa, Sorghum bicolor
  misc_feature: Useful for making plants with modulated drought sensitivity
  misc_feature: Functional homolog of the protein sequence given in SEQ ID NO 14078
  misc_feature: Useful for making plants with modulated heat sensitivity
  misc_feature: Functional homolog of the protein sequence given in SEQ ID NO 14079
  misc_feature: Ceres ANNOT ID no. 8744839
  misc_feature (49)..(382): SWISSPROT Homolog: EC 2.7.11.1 Non-specific serine/threonine protein kinase
  misc_feature (94)..(376): Pfam ID: Pkinase Pfam Description: Protein kinase domain
MGNCASAIDAFVQRGNRASPSPSSAATPGMSASRRTSSSATTGKLSTISSTSTFMPSTVSGVSVDDDYPEGQILESPNLKIYTFAELKSATKNFRPETVLGEGGFGKVYKGWVDEKTLNPSKASTGIMVAVKKLNPESVQGMEQWQSEVNFLGRISHPNLVKLLGYSMDDNELLLVYEFMSKGSLENHLFRRGAVSEPLPWSLRLKILIGAARGLAFLHSSERQIIYRDFKASNILLDSHFNAKLSDFGLAKHGPDGGESHVTTRVMGTYGYAAPEYVSTGHLYVKSDVYGFGVVLLEMISGLRALDPSRQSEKVNLVNWARPLLSDRRKLSQLMDSGLEGQYNPKGALLAAQLTLKCLNGDPKSRPSMKEVVEALEKIESVKSRVMREPRNSSSSSRRSQVQSPRSDSARNNSSSRGR

SEQ ID NO: 20104 - DNA, 5847 bp, Sorghum bicolor
  misc_feature: Ceres ANNOT ID no. 8744853
  misc_feature: Encodes the peptide sequence at SEQ ID NO 20105
atggcggcgccggggcggaggacggccgacgtgtcctcgtcctcgccggccccctcgccgtccccggccgccccttcctccaccggcaggcgtctcctgcgcacccagacagtcggcaacctcggcgagtccatcttcgacagtgaggtcgtcccgtcctcgctcgtcgagatcgcacccatcctccgtgtcgccaacgaggtcgaggccaccaacccgcgcgtcgcctacctctgtcgcttctacgctttcgagaaggctcaccgcctcgacccgacttccagtggccgtggtgttcgtcagttcaagaccgcacttctgcagaggcttgagagggaaaatgatcccaccttgaagggaagggtgcatcagagcgatgctagggagatgcagcgcttctaccgtgaatactacaagaagtatattcaggcactgcaaaatgctgctgataaggctgaccgtgcactgctcactaaggcataccaaacagctgctgtcttgtttgaggtcttgagggccgttaatgtttcgcagtctgttgaagtcgatcaagcgattttggatacacacaataaggtcgaagaaaagaaaaagttgtttttaccttgtaacattcttccgcttgatcctgaaagtactggtcaagccattatgctatatccagagattcaagctgctgtttatgctctgcgcaatactagaggcctgccatggccaaaggaccaagacaagaagcctgatgagaagaatactggtaaagaccttcttgattggcttcaggctatgtttgggtttcagaaagacaacgtgtccaaccaaagggaacatttgatactgttgcttgcaaatgttcatataaggaaaatacccaaggctgacctacaaccaaagttggacgacaaagctctggatgatgtaatgaagaagctatttaagaattataagaagtggtgcaagtacctcggccgcaaaagcagtttatggttaccaaccatccagcaggaagtgcagcagcgtaagcttctttatatgggcctctacttgctgatttggggtgaggcggctaacttgagattcatgccagagtgtatttgttacatctaccatcatatggcttttgaactctacggtatgctggctggaaatgtgagcccaatgaccggtgaaaatgttaaaccagcatatggtggtgatgaagaagcctttttgatgaaagtcgtgactccaatatacaaagttatagagaaggaagctgaaaggagcaagaccatgaaatcaaagcactcacattggagaaactatgatgatctgaatgagtacttttggtcagttgattgtttccgtctaggatggcctatgagagctgatgagaacaggtctgcaggcaatgtccattggatgggaaaagttaattttgtggagatacgttcattttggcacatattccgtagtttcgacaggatgtggatcttcttaatattgtccttgcaggccatgataattattgcttggaatggtggaacaccaagtgatatctttgatgctggagtatttaagaaggttttgagcatatttattactgctgcaattttgaagttgggtcaagcaatcctagacctcgtatttggctggaaagcaagaagaagcatgtcatttgcagtcaagctacgatatgtcttgaagttaatatctgctgctgcatgggttgtgattttacctgtgacttacgcgtacacttgggagaatcctactggtctcgcaagaacaataaaaagctggcttggtgatggtcagaatcagccatctttgtatatattggccatagtgatatatatggcaccaaacatacttgcttctatgctatttcttttcccatttatgagaagattcctagagagttcaaatgttaaggtcataacgatcatgatgtggtggtctcagcctcggttatttgttggcagagggatgcatgaaggtgcattctccctcttcaagtataccatgttctggattattcttttagcaatgaagttgatagtaagcttctatattgagatcaaacctctggtacagccaaccaaagatataatgagagaacctatcaggacattccagtggcacgagtttttccctcatggaactaacaatattggtgttgttatatcactctgggctccaataatcctggtatatttcatggacacccaaatttggtatgcactgttctctactctgattggtggcatctacggggcttatcgtcgtcttggtgagatacggacattaggaatgttgagatctcgctttgaatctttgcctgaggccttcaatgaacgcttgattccttctgatgcaaataagagtaaaggtctccgtgctgcttttttgagtagacccaaggttcctggtgacgaaagagagagagagaaaagagctgcaaggtttgctcaaatgtggaacgttattattacaagcttccgtgaagaagacctcattgacaatagggagatggatctgctactggttccatactgtaaagaccgtgaacttgatatattccaatggccgcctttcctacttgctagcaagatcccaatagcactggatatggcagcagacagtggtggtaaagaccgtgatctgacgaagaggataaaatcagatccatacttttccttcgctatcagagaatgctatgcttcattcaagaacatcatcaataccttagtgtttggtcagcgggagaaggatgtcctagcaaagatttttacagttgttgatgagcatatagaagatggaactctgataaaggatctcaacatgaggaaccttcctgcactgagcaagaagtttgttgaattacttgagttactgcaaaaaaacaaggaagaagacttgggtcaggtagtcattttgttccaagatatgctcgaggtggtcacaagggatataatggaggaacaggatcagctcagcacactgttggattccatacatggtgcccatagtagaaaacatgaagggattacaccgctagatcagcaagatcagttgtttgctaaagctattaagttccctgtggaggaatcaaatgcatggactgaaaagataaagaggcttcaccttctgttaactgtgaaggagtctgctatggatgttcctactaatcttgatgctaggcggcggatatcgttctttgcaaattctctatttatggatatgcccaatgctccaaaagttcggaacatgttgcccttctctatcttgactccttattacaaggaagatgttctgttctcattacaaaatctggaagagccaaatgaggatggagtttccattcttttctacttacaaaaaatttacccagatgaatggaaaaatttcctcgaaagggtgggctgcaagaatgaagaggaactccgtgaagatgaagaactggaagagaagcttcgtctttgggcatcatatagggggcagacattaacaagaactgtaagagggatgatgtactatcgaaaagctttggagcttcaggcttttcttgatatggccaaagatgatgatcttatggaaggctacagagcaacagaagtaatgcctgaggactcacaattaatgactcaatgcaaggctatagctgacatgaagtttacatatgttgtctcatgccaacaatatggaattcagaagcgttctaatgagccttgtgcacatgatattttgagactaatgacggagtatccatcacttcgggttgcctatattgatgaagttgaagcgcccagccaagatagaaacaagaagattgaaaaggtttactactccgtgttagtcaaggcttctgttacaaaacctaatgagcctggtcagagccttgatcaggtcatctacaagataaaactaccaggtaatgccattttaggtgaaggaaagccagaaaatcagaaccatgcaataatattcacccgcggcgaatgtctccaaactatagatatgaatcaggagcactatatggaggaggctttgaaaatgagaaatctgctgcaagagtttcagaagaaacatgatggagtgagatatccatcaatacttggagtcagagaacacatatttacgggcagtgtgtcatcccttgcatggttcatgtcaaatcaggaaactagttttgtgacaattggacaacgagtgcttgccaatccgttgagggttcggtttcattatggtcatcctgatgtttttgatcgccttttccacgttacgaggggtggtgtgagtaaagcatccaaaattatcaatcttagtgaggacatatttgcaggattcaattccacattgcgtgaaggcaatgttactcaccatgaatacatgcaagttggcaagggaagggatgtgggtctcaatcaaatatctctgtttgaggcaaagatagcaaatggaaatggcgaacagacgctgagccgtgacatctaccggctaggtcatcgctttgatttcttcaggatgctgtcttgttactacacaacaattggtttctacttcagtacaatgattacagtatggactgtatatgttttcctctacgggcggctatatcttgtacttagtggacttgatgaagcactggctactggaaggaggtttgtgcgcaatgcacccctccaggttgcgcttgcatcagagtcttttgtgcaacttgggtttttgatggcgctacccatgatgatggaaatcggtttggagagaggattcagaactgcattgagtgactttatactgatgcaacttcagttggcctctgttttcttcacattctcattgggaacaaaaactcactactacggaaggacgttactccatggaggagctgaatacagagccactggacgtgggtttgtggtgttccatgccaaatttgctgacaactatcgactttattcccgtagccattttgtgaagggcatcgagctgatgattctactggttgtgtatgaaatatttggtcagtcatatagaggggctataacttacatcttcatcaccgtatccatgtggttcatggtgggcacttggctctttgcacccttcctgttcaatccttctggatttgagtggcaaaagattgtggatgactggactgattggcacaagtggatcagcaatcgtggaggtattggtgtagcaccagagaaaagctgggagtcatggtgggaaaaagagcaagagccccttcggtactctgggaagcgtggtactattgtcgaaatactgcttgcattgcgtttctttatttaccaatatggacttgtgtatcatctgaacataacgaagaagataaccaaggataaccagagtgtgctggtttattgcttctcatgggttgtaatttttgtcattttactggttatgaagaccgtatcagtgggcaggaggaggttcagtgcagagttccagctcgtgttccggttgatcaagggtctcatatttataacttttacagccatcgtggtaatcttaatagcaatccctggcatgacggttctggacatctttgtttgcatccttgctttcatgcccactggatggggtttgctcctgattgcccaagcgatcaggcctgtgattcaaaagattgggctgtgggggtcaatcaaggctcttgcccggggctacgagatcttgatgggacttctcctgttcacgcccattgccttccttgcctggttcccgttcgtgtccgaattccagaccaggatgctgttcaaccaggccttcagcagaggtctgcagatctcccgtatcctcggaggccacaagaaagaccgagggacccggaacaaggagtag

SEQ ID NO: 20105 - protein, 1948 aa, Sorghum bicolor
  misc_feature: Useful for making plants with altered cell wall content and/or composition
  misc_feature: Functional homolog of the protein sequence given in SEQ ID NO 14767
  misc_feature: Useful for making plants with altered carbohydrate content
  misc_feature: Functional homolog of the protein sequence given in SEQ ID NO 14257
  misc_feature: Ceres ANNOT ID no. 8744853
  misc_feature (1154)..(1723): SWISSPROT Homolog: EC 2.4.1.34 1,3-beta-glucan synthase
  misc_feature (1053)..(1820): Pfam ID: Glucan_synthase Pfam Description: 1,3-beta-glucan synthase component
MAAPGRRTADVSSSSPAPSPSPAAPSSTGRRLLRTQTVGNLGESIFDSEVVPSSLVEIAPILRVANEVEATNPRVAYLCRFYAFEKAHRLDPTSSGRGVRQFKTALLQRLERENDPTLKGRVHQSDAREMQRFYREYYKKYIQALQNAADKADRALLTKAYQTAAVLFEVLRAVNVSQSVEVDQAILDTHNKVEEKKKLFLPCNILPLDPESTGQAIMLYPEIQAAVYALRNTRGLPWPKDQDKKPDEKNTGKDLLDWLQAMFGFQKDNVSNQREHLILLLANVHIRKIPKADLQPKLDDKALDDVMKKLFKNYKKWCKYLGRKSSLWLPTIQQEVQQRKLLYMGLYLLIWGEAANLRFMPECICYIYHHMAFELYGMLAGNVSPMTGENVKPAYGGDEEAFLMKVVTPIYKVIEKEAERSKTMKSKHSHWRNYDDLNEYFWSVDCFRLGWPMRADENRSAGNVHWMGKVNFVEIRSFWHIFRSFDRMWIFLILSLQAMIIIAWNGGTPSDIFDAGVFKKVLSIFITAAILKLGQAILDLVFGWKARRSMSFAVKLRYVLKLISAAAWVVILPVTYAYTWENPTGLARTIKSWLGDGQNQPSLYILAIVIYMAPNILASMLFLFPFMRRFLESSNVKVITIMMWWSQPRLFVGRGMHEGAFSLFKYTMFWIILLAMKLIVSFYIEIKPLVQPTKDIMREPIRTFQWHEFFPHGTNNIGVVISLWAPIILVYFMDTQIWYALFSTLIGGIYGAYRRLGEIRTLGMLRSRFESLPEAFNERLIPSDANKSKGLRAAFLSRPKVPGDEREREKRAARFAQMWNVIITSFREEDLIDNREMDLLLVPYCKDRELDIFQWPPFLLASKIPIALDMAADSGGKDRDLTKRIKSDPYFSFAIRECYASFKNIINTLVFGQREKDVLAKIFTVVDEHIEDGTLIKDLNMRNLPALSKKFVELLELLQKNKEEDLGQVVILFQDMLEVVTRDIMEEQDQLSTLLDSIHGAHSRKHEGITPLDQQDQLFAKAIKFPVEESNAWTEKIKRLHLLLTVKESAMDVPTNLDARRRISFFANSLFMDMPNAPKVRNMLPFSILTPYYKEDVLFSLQNLEEPNEDGVSILFYLQKIYPDEWKNFLERVGCKNEEELREDEELEEKLRLWASYRGQTLTRTVRGMMYYRKALELQAFLDMAKDDDLMEGYRATEVMPEDSQLMTQCKAIADMKFTYVVSCQQYGIQKRSNEPCAHDILRLMTEYPSLRVAYIDEVEAPSQDRNKKIEKVYYSVLVKASVTKPNEPGQSLDQVIYKIKLPGNAILGEGKPENQNHAIIFTRGECLQTIDMNQEHYMEEALKMRNLLQEFQKKHDGVRYPSILGVREHIFTGSVSSLAWFMSNQETSFVTIGQRVLANPLRVRFHYGHPDVFDRLFHVTRGGVSKASKIINLSEDIFAGFNSTLREGNVTHHEYMQVGKGRDVGLNQISLFEAKIANGNGEQTLSRDIYRLGHRFDFFRMLSCYYTTIGFYFSTMITVWTVYVFLYGRLYLVLSGLDEALATGRRFVRNAPLQVALASESFVQLGFLMALPMMMEIGLERGFRTALSDFILMQLQLASVFFTFSLGTKTHYYGRTLLHGGAEYRATGRGFVVFHAKFADNYRLYSRSHFVKGIELMILLVVYEIFGQSYRGAITYIFITVSMWFMVGTWLFAPFLFNPSGFEWQKIVDDWTDWHKWISNRGGIGVAPEKSWESWWEKEQEPLRYSGKRGTIVEILLALRFFIYQYGLVYHLNITKKITKDNQSVLVYCFSWVVIFVILLVMKTVSVGRRRFSAEFQLVFRLIKGLIFITFTAIVVILIAIPGMTVLDIFVCILAFMPTGWGLLLIAQAIRPVIQKIGLWGSIKALARGYEILMGLLLFTPIAFLAWFPFVSEFQTRMLFNQAFSRGLQISRILGGHKKDRGTRNKE

SEQ ID NO: 20106 - DNA, 477 bp, Sorghum bicolor
  misc_feature: Ceres ANNOT ID no. 8744845
  misc_feature: Encodes the peptide sequence at SEQ ID NO 20107
atgaagggggccaaatccaagggcgccgccaaggccgatgccaagctggcggtgaagagcaagggtgcggagaagcccgccaagggcaggaaggggaaggccggcaaggaccccaacaagcccaagagggctcccagcgctttcttcgtcttcatggaggaattccgcaaggagttcaaggagaagaaccctaagaacaagtctgtcgctgcggtgggaaaagctgccggtgacaggtggaaatccctcagcgaatcggacaaggctccctatgtagccaaggctaataagctcaagctagagtataacaaggccattgctgcctacaacaagggcgagagcaccgctgctgctaagaaggctcctgccaaggaggaggaggaggaagacgaagaggagtctgacaagtccaagtcggaggtcaatgatgaggatgacgacgagggtagcgatgaggacgaagacgatgacgagtga

SEQ ID NO: 20107 - protein, 158 aa, Sorghum bicolor
  misc_feature: Useful for making plants with altered alkaloid content
  misc_feature: Functional homolog of the protein sequence given in SEQ ID NO 12910
  misc_feature: Ceres ANNOT ID no. 8744845
  misc_feature (41)..(110): Pfam ID: HMG_box Pfam Description: HMG (high mobility group) box
MKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKANKLKLEYNKAIAAYNKGESTAAAKKAPAKEEEEEDEEESDKSKSEVNDEDDDEGSDEDEDDDE

SEQ ID NO: 20108 - DNA, 3234 bp, Sorghum bicolor
  misc_feature: Ceres ANNOT ID no. 8744866
  misc_feature: Encodes the peptide sequence at SEQ ID NO 20109
atggcagattgcatttctgcactattggtgcctgtatattactcgatcaaaagtgatggtcaaattgtaaaactggagtttgctctcttggcagcacattggcttcgtcaacctcactgtttcactgcccacggcatgggatcttggagaccgaaactgcctgggttgggcgagggctctcaggatgctgagcccggtggtggtgggagaggtcctggaagaggtttccgtggccgcggtggctcctaccatcaacaactcccacaaggtggtcgtggaactggttactaccagcatggacagggctccatgttacaacctcgtggagtgatgatgtcgcagcggtggcagcctgctggccctgctgcaggatatctgggccaaggtcaagcttacagagaagtgcaggcaccacagtactatggtggtggtagaggtggacgtggggcaggcccgtccgccatagctcccgagctgcgccaagcaatggaaacttcacatgaacctgataacatctcaccagaaacaggctctccagatctgtcaccaagagacgaatcaagcatgtgccaagacattgtgcaagcatttccagtgtcgagcaatgcatgtaagtttcctcatcgcccaggaagtggaagtattggcaccaggtgtttggtgaaggcaaatcacttctttgctgaattgcctgacaaggatcttcatcagtatgatgtttcaatcaccccggaagtcacatcgcgaattgtgaaccgatctgtcatggaagagctggtgaagctgcacaagatgtcatacttgggagggcggcttccagcctatgatggtagaaagagcctatacacggctggtccactgccattcatttcaaaagaatttcacatcactctacttgaggaagacgatggttctggagtagagaggcgtaagaaaacatacaaggtagtgattaaatttgctgcaagggctgatctctgtcgtctggagcaatttttagctggaaggcaggcagaggctcctcaagaagccttgcaagttcttgatattgttctgcgggagctgccaacaacaagatatgcaccatttgggcgatcatttttctctcctgacctggggaggaggcgatcccttggtgagggaatagaatgctggcgtgggttttaccagagcattcggcctactcaaatgggcctgtcattgaatattgatatgtcggcaacagctttctttgagccgttacctgtgatagattttgttgcacagcttttaaacaccgacatccactcaaggcctctctcagatgctgaacgtgtcaagataaagaaggccttaagaggagtgaaggtggaagttacccaccgtggtaacatgcgacggaagtatcgaatagctggtttaacatctctggcaactcgggagttaacttttcctgttgatcaaggcggcacattgaaatctgttgtacaatattttcaagagacctatggctttgccatccagcacacctacctgccctgtctgcaagtcggcaatcagcagcacccaaattaccttccaatggaggtctgcaaaatagtagagggacagaggtactctaagagattaaaccagggtcagataagagctcttttagaggagacatgccagcgcccacatgatcgggagcgtgacattattcagatggtgaatcataactcttaccatgaggatccttatgctaaagagtttggcattaagatcagtgagcgtttggcttcaattgaggcacggattttacctgctcctcggctcaagtataatgaaactggcagagagaaggactgcttgcctagagttgggcagtggaatatgatgaacaagaaaatggtaaacggtggtagagtgaggagctggatctgtgtcaattttgctcgaaacgtgcaagagagcgttgctgttgggttctgccgtgaacttgctcgcatgtgccaagcctcgggaatggactttgccttggagcctattcttccgcctatatatgcacatcctgataaagtggagagagctctgaaagccaggttccatgatgcaatgagcatgctcggaccacagcgcaaagaactcgatttgcttattgggatacttcctgataacaacggttctctttatggtgatttgaagcgtatctgtgaaattgaccttggattagtttcacagtgctgctgtgcaaagcaagtttttaagatgaacaaacagatactggcaaatctcgctctgaagataaatgtcaaggttggaggaaggaacacagtgctggctgatgcagtatcaagacgcattcctttggtgactgacaggcctaccatcatatttggtgctgatgtgacccatcctcatcctggtgaagatagcagcccttccattgctgctgttgtggcttcccaagattggcctgaggtgacaaagtatgcaggtttagtttctgctcaatctcataggcaagagttaatagaggatctgtataaggtcgtacatgatcctcagaaaggaaccatttgtggtggcatgatcagggagctccttatatccttcaaaagatcaactggtcaaaagcctcagaggatactattctacagggatggtgtgagtgaagggcagttctaccaagttctactgcatgaattggatgcaatccgaaaggcgtgtgcatcgctggaagcaaattaccaaccacaggtgactttcatcgtggtccagaaacggcaccacacgaggttgttcgcacacaaccacaatgatcagaattcagtcgacaggagtgggaacatacttcctggtactgttgtggactcgaagatctgccaccctacagagtttgacttcttcctgtgcagccatgctggcatcaagggcacgagccgtcctgctcactaccatgtcttgtgggatgaaaacaacttcacagctgatgcattgcagacccttaccaataacctttgctacacttacgcgaggtgcacacgttctgtatccattgtcccaccagcatactacgctcatctagctgcattccgcgcccggttctacatggagccggacagctcagacagtggatcactggcgagtggctctcgcggaggagcgccgtccagctcttctacatcccgcagtacccgtgccgccaccagtggagccgttaggccccttcctgtgctcaaggacagtgtcaagaacgtcatgttctactgctga

SEQ ID NO: 20109 - protein, 1077 aa, Sorghum bicolor
  misc_feature: The sequence is a functional homolog of SEQ ID NO 2086 in the 10/374,780 US patent application
  misc_feature: The sequence is a functional homolog of SEQ ID NO 152 in the 10/225,066 US patent application
  misc_feature: The sequence is a functional homolog of SEQ ID NO 238 in the 10/374,780 US patent application
  misc_feature: Ceres ANNOT ID no. 8744866
  misc_feature (704)..(1025): Pfam ID: Piwi Pfam Description: Piwi domain
  misc_feature (414)..(551): Pfam ID: PAZ Pfam Description: PAZ domain
MADCISALLVPVYYSIKSDGQIVKLEFALLAAHWLRQPHCFTAHGMGSWRPKLPGLGEGSQDAEPGGGGRGPGRGFRGRGGSYHQQLPQGGRGTGYYQHGQGSMLQPRGVMMSQRWQPAGPAAGYLGQGQAYREVQAPQYYGGGRGGRGAGPSAIAPELRQAMETSHEPDNISPETGSPDLSPRDESSMCQDIVQAFPVSSNACKFPHRPGSGSIGTRCLVKANHFFAELPDKDLHQYDVSITPEVTSRIVNRSVMEELVKLHKMSYLGGRLPAYDGRKSLYTAGPLPFISKEFHITLLEEDDGSGVERRKKTYKVVIKFAARADLCRLEQFLAGRQAEAPQEALQVLDIVLRELPTTRYAPFGRSFFSPDLGRRRSLGEGIECWRGFYQSIRPTQMGLSLNIDMSATAFFEPLPVIDFVAQLLNTDIHSRPLSDAERVKIKKALRGVKVEVTHRGNMRRKYRIAGLTSLATRELTFPVDQGGTLKSVVQYFQETYGFAIQHTYLPCLQVGNQQHPNYLPMEVCKIVEGQRYSKRLNQGQIRALLEETCQRPHDRERDIIQMVNHNSYHEDPYAKEFGIKISERLASIEARILPAPRLKYNETGREKDCLPRVGQWNMMNKKMVNGGRVRSWICVNFARNVQESVAVGFCRELARMCQASGMDFALEPILPPIYAHPDKVERALKARFHDAMSMLGPQRKELDLLIGILPDNNGSLYGDLKRICEIDLGLVSQCCCAKQVFKMNKQILANLALKINVKVGGRNTVLADAVSRRIPLVTDRPTIIFGADVTHPHPGEDSSPSIAAVVASQDWPEVTKYAGLVSAQSHRQELIEDLYKVVHDPQKGTICGGMIRELLISFKRSTGQKPQRILFYRDGVSEGQFYQVLLHELDAIRKACASLEANYQPQVTFIVVQKRHHTRLFAHNHNDQNSVDRSGNILPGTVVDSKICHPTEFDFFLCSHAGIKGTSRPAHYHVLWDENNFTADALQTLTNNLCYTYARCTRSVSIVPPAYYAHLAAFRARFYMEPDSSDSGSLASGSRGGAPSSSSTSRSTRAATSGAVRPLPVLKDSVKNVMFYC

SEQ ID NO: 20110 - DNA, 1296 bp, Sorghum bicolor
  misc_feature: Ceres ANNOT ID no. 8744852
  misc_feature: Encodes the peptide sequence at SEQ ID NO 20111
atggcgcaggtccaggaaagaggtggtttgccaattgacaaaaggctgccgccggatgctgtccaatctcccctggtggatgatgcaatgcaacccaaggaggggacggatgggtaccctgtcaaggctcggaagccttacacgatcacgaaacagcgagagaagtggacagaagaagagcatgggaagttcctggaggcactgaagctttatggtcggtcttggcgccagatacaagaacacattggcacaaagactgctgtccagattcggagccatgctcagaagtttttctccaaggtggtgcgtgaacctggggcaagtaatgcaattgagatcccaccccctaggccaaagagaaaaccactgcacccataccctcgcaagtgtgctgactccaccattgcaaatcgtccaattggcgaaccgaagaatgctcctatttcatcatcatctggttctgatcaagagaatggttcgcctgtgtcggtgttatctgcaatgcaatcagatgcttttggatcatcagtatcaaacccgtcaacggggtgtacatcccctgcgtcatcggatgagggggataatgtcgctgaggtagtgaatggggaggaaactatacccactcagcaaatagaagatgatcaatgccgtcaggaattaaagcaggacaacagtgacggtgagttgtctgaagaagattcatcacgagtccaagaaaccagtttgaagctttttgggaagacagttatcatcccagacccaaagaaagtttgttcctcggatggggcagctggagctggagagaaagactctcattcttctacacaagaaatgctgcaagcatccttggtcggaggtgttgcagcagtcggaggtgtggcagcatacccttcccataatggatggattcttccattccaatctttccctgttcatatgtatgagtcgggggatgctaggatttcccctcttcatatatggtggccttactatggtttcccggccaaccatccaagagggtttggtacagggctgcataacgaaggtgccagtgagagtgataccagcaaaagcccatcagttgaatctagttcagattgcgtgggcaatgctcatacaaccacccctaccaactgcaaagttgtcaaggagtcacttgggccagttgagtcaggtccaagtgttgagctgaaacccagcgtgaattcggccttcgtaagagtgaagccgagcagcggcagcagagaccaaccgataaggggattcatgccatacaaaagatgtaaagtcgaataa

SEQ ID NO: 20111 - protein, 431 aa, Sorghum bicolor
  misc_feature: The sequence is a functional homolog of SEQ ID NO 1752 in the 10/412,699 US patent application
  misc_feature: The sequence is a functional homolog of SEQ ID NO 1974 in the 10/374,780 US patent application
  misc_feature: The sequence is a functional homolog of SEQ ID NO 337 in the 11/479,226 US patent application
  misc_feature: Ceres ANNOT ID no. 8744852
  misc_feature (53)..(98): Pfam ID: Myb_DNA-binding Pfam Description: Myb-like DNA-binding domain
MAQVQERGGLPIDKRLPPDAVQSPLVDDAMQPKEGTDGYPVKARKPYTITKQREKWTEEEHGKFLEALKLYGRSWRQIQEHIGTKTAVQIRSHAQKFFSKVVREPGASNAIEIPPPRPKRKPLHPYPRKCADSTIANRPIGEPKNAPISSSSGSDQENGSPVSVLSAMQSDAFGSSVSNPSTGCTSPASSDEGDNVAEVVNGEETIPTQQIEDDQCRQELKQDNSDGELSEEDSSRVQETSLKLFGKTVIIPDPKKVCSSDGAAGAGEKDSHSSTQEMLQASLVGGVAAVGGVAAYPSHNGWILPFQSFPVHMYESGDARISPLHIWWPYYGFPANHPRGFGTGLHNEGASESDTSKSPSVESSSDCVGNAHTTTPTNCKVVKESLGPVESGPSVELKPSVNSAFVRVKPSSGSRDQPIRGFMPYKRCKVE

SEQ ID NO: 20112 - DNA, 2556 bp, Sorghum bicolor
  misc_feature: Ceres ANNOT ID no. 8744867
  misc_feature: Encodes the peptide sequence at SEQ ID NO 20113
atggcctccaagctgagtttcaagaggacagacagtctcgcggaaagcatgcccgatgcgttaaggcagagccggtaccagatgaagaaatgtttccagaggtatgtttccaagggaaggaggctcttgaagaaccagcagctcatagaggagctggagaaatcactggatgacaaagtcgagaaggaaaagcttgttgaaggcttcctaggttacattatttgttccacgcaggaagcagtggtgctaccaccttatgttgcatttgctgtcaggatgaatcctggcatctgggagtatgtcaaagttcattctgaggatctgtcggtcgaaggaatcacaccatctgagtacctcaagttcaaggagacattatatgatgagaactgggccaaggatgacaactcactggaagtcgatttcggtgctcttgacctctcaacaccccatctgacactgccatcgtccataggaaacgggctccagtttgtgtccaaatttatgtcttcaaagctgggcgacaagcctgaaattagcatgaaaccgttgctggactatttgctttcactgaactatcgtggcgagaagctgatggttaacgacaccatcgatacggttaacaagcttcagacagcactgctacttgcagaggtatttgttagtggtttgccaagatacacgccattcctgaagtttgaacagagatttcaagagtggggattggagaaagggtggggtgacactgctgaaaggtgcaaggagacgctgaattgcctctctgaggtgctacaagcgccagaccctatcaacatggagaagttcttcagcagagttccatccacattcaatatagtcatcttctccatccacggttactttggccaagagaaggttcttggcttgccagacaccggtggccaggtggtctacatcctggaccaagtcagagcccttgaagaggagttgctgcaaagaatcaagctgcagggtctgaacgtgacaccaaagattcttgtgctcactaggctgataccagatgccaagggtacaaaatgcaatgtggagctcgaaccagttgaaaatacaaaacattcccacatacttcgtgtgccattcaagactgaagacggcaaggagttgcgccagtgggtgtcccggtttgacatctacccttacctagagagatatgcccaggattcgtgtgccaaaattcttgacattttggagggcaagccagacctgatcatcggcaactataccgatggcaacttagtggcgtctctcatgtcaagcaagctaggtgtcactcaggggacaatcgcgcacgctctagagaagacaaagtatgaagattcagatgtcaagtggagagatctggaccagaagtaccatttctcctgccaattcactgcagatatgattgccatgaacaccagtgacttcatcatcactagcacataccaagaaattgctggaagcaaagagaagcctggccaatatgagcaccactacgcattcacaatgccggggctctgtcgctacgccacaggcatcaatgtctttgatccaaagttcaacattgccgcacccggtgcagaccagtccatctacttccccttcacacagaaacagaagcggctgacagatttgcacccacagattgaggagttgctctacagcaagcaagacaccaatgaacacatagggtatctggcagacagaaacaagccaatcatcttctcgatggcaaggctggacaaggtgaagaacatcactggactagtggagtggtatggccagaacaagagactgagggacctggtaaaccttgtcgtcgttgcgggcctgctggaagcatcgcagtccaaggaccgggaagagattgaagaaatcaacaaaatgcatagcctgatcgacatgtatcagctgaaaggacagattcgctggatcaaggcacagactgaccgtgtccgcaacggtgagctgtaccgttgcatagcagatacaaagggtgcatttgttcagcctgcactttatgaagcattcgggctgacggtcattgaagcgatgaactgcggattgacaacctttgcgacaaatcagggagggccagcagagatcattgtggacggtgtctccggtttccacataaacccaatgaatggcagggaggcaagcaacaagattgccgatttcttccaaaagtgcaaggaagacccaagctattggaacaaggtgtccactgctgggctccagcgcatctacgaatgctacacatggaagatttatgcaactaaagtcctgaatatgggttcaacatatggcttctggaagactttgaacaaggaggagagactagccaaacagcgctacctgcagatgttctacaatcttcagttcaggaatctggcaaagactgtccctaggttatttgaacatcctccgcaagccctagcagggcctagtacaatgaccgtaacgaggcccaaagaaaggcaaatggatggtgtaaagagagtggaagtgtacatgattacaattgataataatatatga

SEQ ID NO: 20113 - protein, 851 aa, Sorghum bicolor
  misc_feature: Useful for making plants with altered cell wall content and/or composition
  misc_feature: Functional homolog of the protein sequence given in SEQ ID NO 13682
  misc_feature: Useful for making plants with altered carbohydrate content
  misc_feature: Functional homolog of the protein sequence given in SEQ ID NO 13681
  misc_feature: The sequence is a functional homolog of SEQ ID NO 12 in US patent 7091398
  misc_feature: The sequence is a functional homolog of SEQ ID NO 2 in US patent 7091398
  misc_feature: Ceres ANNOT ID no. 8744867
  misc_feature (1)..(808): SWISSPROT Homolog: EC 2.4.1.13 Sucrose synthase
  misc_feature (8)..(560): Pfam ID: Sucrose_synth Pfam Description: Sucrose synthase
  misc_feature (563)..(753): Pfam ID: Glycos_transf_1 Pfam Description: Glycosyl transferases group 1
MASKLSFKRTDSLAESMPDALRQSRYQMKKCFQRYVSKGRRLLKNQQLIEELEKSLDDKVEKEKLVEGFLGYIICSTQEAVVLPPYVAFAVRMNPGIWEYVKVHSEDLSVEGITPSEYLKFKETLYDENWAKDDNSLEVDFGALDLSTPHLTLPSSIGNGLQFVSKFMSSKLGDKPEISMKPLLDYLLSLNYRGEKLMVNDTIDTVNKLQTALLLAEVFVSGLPRYTPFLKFEQRFQEWGLEKGWGDTAERCKETLNCLSEVLQAPDPINMEKFFSRVPSTFNIVIFSIHGYFGQEKVLGLPDTGGQVVYILDQVRALEEELLQRIKLQGLNVTPKILVLTRLIPDAKGTKCNVELEPVENTKHSHILRVPFKTEDGKELRQWVSRFDIYPYLERYAQDSCAKILDILEGKPDLIIGNYTDGNLVASLMSSKLGVTQGTIAHALEKTKYEDSDVKWRDLDQKYHFSCQFTADMIAMNTSDFIITSTYQEIAGSKEKPGQYEHHYAFTMPGLCRYATGINVFDPKFNIAAPGADQSIYFPFTQKQKRLTDLHPQIEELLYSKQDTNEHIGYLADRNKPIIFSMARLDKVKNITGLVEWYGQNKRLRDLVNLVVVAGLLEASQSKDREEIEEINKMHSLIDMYQLKGQIRWIKAQTDRVRNGELYRCIADTKGAFVQPALYEAFGLTVIEAMNCGLTTFATNQGGPAEIIVDGVSGFHINPMNGREASNKIADFFQKCKEDPSYWNKVSTAGLQRIYECYTWKIYATKVLNMGSTYGFWKTLNKEERLAKQRYLQMFYNLQFRNLAKTVPRLFEHPPQALAGPSTMTVTRPKERQMDGVKRVEVYMITIDNNI

SEQ ID NO: 20114 - DNA, 1143 bp, Sorghum bicolor
  misc_feature: Ceres ANNOT ID no. 8744889
  misc_feature: Encodes the peptide sequence at SEQ ID NO 20115
atgaagcaccagccgccgccgccgccgcgccgctggggcgtcgtggcggcggtcgtcgcgctcgtcctcctcgcctgcctccagatccagtaccagcacctcaaggtggatctcggcaaggccggctttgcctctgccacgcaagagaataacgcgatccccagtcgcaatcgcattcgctgggggaccgccaggaccaggaaggcagccaccggcgctgactccttgccgcgcgggattgtccagcgccactccgacatgtccctccgcccgctctgggaggacgacgctgcttccacccacaagaataaaaatggtgaccacagtgctctcctcgccatggcagtcggcatctcccaaataaaaaacgttgacactatggctcgtaagtttctgaaggaaaactatgcagtcatgctcttccattatgatggaaatgtagatggatggcgtcatcttgagtggagtgataaggccatacacatccttgctcacaaccaaacaaaatggtggtttgctaagcgttttttgcatcctgatgtcatggctatctatgatttcatctttctatgggatgaagaccttggagtggagagcttcaacccaagaagatatcttgatataatggtttcagaaggcttggaaataacacaacctgctctggaccctgatctatcaaccgatatccaccatcggatcacaatccgcaataagatgacaaaagttcacaggagaatatatgacaatcggcctagtatgaattgttctgatgagagcaaaggacctccttgtacagggtgggtagagggcatggcaccagttttttctcgtgctgcttggaaatgtgtatggcatctgattcagaacgatctgattcatggatggggccttgacatgaagcttggctattgtgctcagggtgatcgaactgagaaagttggtgtaattgacagtgagtatgttgttcatcaagggataccatctttaggagggccatcgcttagcagcaagacacctcgaagatcattggatttgaggacccatatacgaaggcaatcatcggctgagctagagaagttcaaagagcggtggaacagggctgtaagggaagatgaaggatggaaggatcctttcgattcttga

SEQ ID NO: 20115 - protein, 380 aa, Sorghum bicolor; identical to SEQ ID NO: 2352
  misc_feature: Useful for biocontainment applications
  misc_feature: Functional homolog of the protein sequence given in SEQ ID NO 12967
  misc_feature: Ceres ANNOT ID no. 8744889

SEQ ID NO: 20116 - DNA, 537 bp, Sorghum bicolor
  misc_feature: Ceres ANNOT ID no. 8744887
  misc_feature: Encodes the peptide sequence at SEQ ID NO 20117
atgggcgccgaggaggacgccgctgcacggcgcgagcgtctccgcgccctccgcgccgccaaggagctcctctccacccccgacggcgcccccacccccgctaccgacggagaacagcaaaatggcaaccatgagatggcagaagagctagcattaccaggtcctcaggatgcatctgacgaggctgctaaagaggatggtagccccactgaggaggccgaggaggttgaagatgatggtgagcttccagccatgaagttcagaaactatcttccccatgatgagcaactccgaggtggcaagctggctccagtgtctcttcctaagtttgaagacccaattagtgctgaaactgcagaaccaaaggaagtggagaatccttttggaaacatagccccaaagaatccaaattgggatctgaaacgtcatgtgcagaagagaattgataaactggaaaggcgcacacagaaagcgttggctgagattgcattggagcagcagagggagaaggaagccttggaggaatctcaagattga

SEQ ID NO: 20117 - protein, 178 aa, Sorghum bicolor
  misc_feature: Useful for making plants with altered cell wall content and/or composition
  misc_feature: Functional homolog of the protein sequence given in SEQ ID NO 14768
  misc_feature: Ceres ANNOT ID no. 8744887
  misc_feature (4)..(177): Pfam ID: cwf18 Pfam Description: cwf18 pre-mRNA splicing factor
MGAEEDAAARRERLRALRAAKELLSTPDGAPTPATDGEQQNGNHEMAEELALPGPQDASDEAAKEDGSPTEEAEEVEDDGELPAMKFRNYLPHDEQLRGGKLAPVSLPKFEDPISAETAEPKEVENPFGNIAPKNPNWDLKRHVQKRIDKLERRTQKALAEIALEQQREKEALEESQD

SEQ ID NO: 20118 - DNA, 210 bp, Sorghum bicolor
  misc_feature: Ceres ANNOT ID no. 8745310
  misc_feature: Encodes the peptide sequence at SEQ ID NO 20119
atggggaaatattgtgaactttctagcaattttattattctgaagttacatagagcattgaaggtgaagaactttgttaaagcacttgagatctttcagcttgttgctgctatcgctgaggaagaaggtttaacaagtaatgatttcatcattgttgtgaagatcaatgatctcactttggaaggcattataaggaagaaagctacatag

SEQ ID NO: 20119 - protein, 69 aa, Sorghum bicolor
  misc_feature: Useful for making plants with altered alkaloid content
  misc_feature: Functional homolog of the protein sequence given in SEQ ID NO 14769
  misc_feature: Ceres ANNOT ID no. 8745310
MGKYCELSSNFIILKLHRALKVKNFVKALEIFQLVAAIAEEEGLTSNDFIIVVKINDLTLEGIIRKKAT

SEQ ID NO: 20120 - DNA, 1248 bp, Sorghum bicolor
  misc_feature: Ceres ANNOT ID no. 8746067
  misc_feature: Encodes the peptide sequence at SEQ ID NO 20121
atggcgcacgacggcttcttcgggggattccacgacctatcttggccgctcgatcatgctgcagccgcccgcgccgcgcctttcgaccccctgcgggaagtggtacatgtgccgcacgcgcttatgggcgcgggtgcgaggtgggaacacgacgctgcggtgggcgcgctcgtgccgtcgcagtcgccatcgccatcaccgtcatcgctcgcgacggccgccgccgtaggaggaggagatgttgttgaggctgccctgatggagcagcttgcgggcaggctcggcgtcagcgtgccgtcgcctcggtcatcgcggtacacatcctgccacagctcgacggtggacaagccggcggcgctcagccagtcgcttctccgcgagcaggctccggcgcccgagcccgcgcccttgccaggcgctgttaaacagcacgcgagcgacgggtcatgtagcgatggcccctgccggaagcggaaggcgtcgggcggcaagtccaaggctaaggtcgtggtcacgccggctgcacccaagtcccgggcgccagagacgagagccaagaaatgcaagctctccacggacgtcggccatgacgacgaggagcagaagccggctgccggagaggcatggcatgacaatagcaatgggaaggaggttgcggcagagccatccaaggactatatccacgtgcgcgcgcgccggggccaggccactgacagtcacagcctcgccgagcgggtgaggagggaaaagatcagcgagcgcatgaaactgctgcaagacctcgtgccaggctgcagcaaggttaccgggaaggccgtgatgctcgatgagatcataaactacgtgcagtcgctgcaacgccaggtggagttcttgtcgatgaagctgtcgaccgtcaacccgcgcctcaaacttgacgtggatagctgcatccccaaagacttatgtacaatgcaggccaacaagctgtttgcgcaaacgacgtccaccattgcacaacctctgccacctgtctacgcacttgagggctcgagctcggcgttctgctacacctcgtctccaggcaccgctgcgcagagtgttgtgacaaatgccaaaggctttggaatgcattcgtccttaatgaaccatggcgatgtggatcggtcactcgaaggacatcaaaatacaaatccccagatggggagcttgtgggaagaggatgatctccaaagtctagtcctgatgggattccggggcaatacgtga

SEQ ID NO: 20121 - protein, 415 aa, Sorghum bicolor
  misc_feature: Useful for making plants with modulated biomass
  misc_feature: Functional homolog of the protein sequence given in SEQ ID NO 13025
  misc_feature: The sequence is a functional homolog of SEQ ID NO 186 in the 10/714,887 US patent application
  misc_feature: The sequence is a functional homolog of SEQ ID NO 186 in the 11/435,388 US patent application
  misc_feature: Ceres ANNOT ID no. 8746067
  misc_feature (236)..(286): Pfam ID: HLH Pfam Description: Helix-loop-helix DNA-binding domain
MAHDGFFGGFHDLSWPLDHAAAARAAPFDPLREVVHVPHALMGAGARWEHDAAVGALVPSQSPSPSPSSLATAAAVGGGDVVEAALMEQLAGRLGVSVPSPRSSRYTSCHSSTVDKPAALSQSLLREQAPAPEPAPLPGAVKQHASDGSCSDGPCRKRKASGGKSKAKVVVTPAAPKSRAPETRAKKCKLSTDVGHDDEEQKPAAGEAWHDNSNGKEVAAEPSKDYIHVRARRGQATDSHSLAERVRREKISERMKLLQDLVPGCSKVTGKAVMLDEIINYVQSLQRQVEFLSMKLSTVNPRLKLDVDSCIPKDLCTMQANKLFAQTTSTIAQPLPPVYALEGSSSAFCYTSSPGTAAQSVVTNAKGFGMHSSLMNHGDVDRSLEGHQNTNPQMGSLWEEDDLQSLVLMGFRGNT

SEQ ID NO: 20122 - DNA, 690 bp, Sorghum bicolor
  misc_feature: Ceres ANNOT ID no. 8746065
  misc_feature: Encodes the peptide sequence at SEQ ID NO 20123
atggcccgcttggcctgccgccgtcatgacgatcgtgccagcgcgccgttgctagcttgcaggagattgggaggcttccttgtatacaatttcatgatgtcatgggatggcgtaagagtaccaccgatcaacactatgaccgtagcgttagcacggcattatactagtggtctgaagggcaaaagagtttatagtagtggttcggatctagagtcgctgcggtggttcacgcaggcggagatgatgcatgggtggtgggcaatgctggcggcggcgggcatcctgatcccggacctgctggtgcggtgtggcttcatcaacaccggctacttgtggttcgacgccgggtcccgcgagtacttcgtggacccatggacgctcttcgtcttgcagatggcgctagtggggtgggcagagagccggcggtgtgcagacttcctcaggcgcagctgcgttgacattgagccatgcttcgcaaaccgcaagaaccccgtccttgacatcgggtaccccggtggcgtctggttcgattggcccaactggggctggcatggtgttgcgctgtcgcacccggttttccaaagaataccaggcgctaactatatgtgtgcccaggatgtccacacaacacatatagtgacaaatatggagaatatcaagaacaatgctttattacatattgaaacatag

SEQ ID NO: 20123 - protein, 229 aa, Sorghum bicolor
  misc_feature: Useful for making plants with modulated oxidative stress sensitivity
  misc_feature: Functional homolog of the protein sequence given in SEQ ID NO 13028
  misc_feature: Ceres ANNOT ID no. 8746065
  misc_feature (49)..(187): Pfam ID: Chloroa_b-bind Pfam Description: Chlorophyll A-B binding protein
MARLACRRHDDRASAPLLACRRLGGFLVYNFMMSWDGVRVPPINTMTVALARHYTSGLKGKRVYSSGSDLESLRWFTQAEMMHGWWAMLAAAGILIPDLLVRCGFINTGYLWFDAGSREYFVDPWTLFVLQMALVGWAESRRCADFLRRSCVDIEPCFANRKNPVLDIGYPGGVWFDWPNWGWHGVALSHPVFQRIPGANYMCAQDVHTTHIVTNMENIKNNALLHIET

SEQ ID NO: 20124 - DNA, 447 bp, Sorghum bicolor
  misc_feature: Ceres ANNOT ID no. 8747470
  misc_feature: Encodes the peptide sequence at SEQ ID NO 20125
atgactgaatctgctgctgtaggaactcgtggcttcaaaacaaagcagaagaagtatgcttcagtaggactcctggctccaaacatgtatgcaagaattgttcatgtggaaactggttgctgcctgcctccaggctcttgtggggagctctggctccatggtccatcaataatgaaaggcctaaatgatggctggctgcgaaccggtgacattgcttactggggccgcttgaaagaggtgatcaagtacaaaggatttcagatagctccagctgacttggaagcaattttgatccaacaccctggaattgttgatgtggctgtgacatctactgaggatgaagaagctggagagataccagttgccttcgtggtgaggaaatctggaagtggcctttcatgcacgcaagtgatggattatgtggccaagcagtatacactatcctga

SEQ ID NO: 20125 - protein, 148 aa, Sorghum bicolor
  misc_feature: Useful for making plants with altered cell wall content and/or composition
  misc_feature: Functional homolog of the protein sequence given in SEQ ID NO 14478
  misc_feature: Useful for making plants with altered carbohydrate content
  misc_feature: Functional homolog of the protein sequence given in SEQ ID NO 14252
  misc_feature: Useful for making plants with altered lignin content
  misc_feature: Functional homolog of the protein sequence given in SEQ ID NO 14211
  misc_feature: Ceres ANNOT ID no. 8747470
  misc_feature (63)..(144): SWISSPROT Homolog: EC 6.2.1.12 4-coumarate--CoA ligase
  misc_feature (2)..(63): SWISSPROT Homolog: EC 6.1.1.13 D-alanine--poly(phosphoribitol) ligase
MTESAAVGTRGFKTKQKKYASVGLLAPNMYARIVHVETGCCLPPGSCGELWLHGPSIMKGLNDGWLRTGDIAYWGRLKEVIKYKGFQIAPADLEAILIQHPGIVDVAVTSTEDEEAGEIPVAFVVRKSGSGLSCTQVMDYVAKQYTLS

SEQ ID NO: 20126 - DNA, 390 bp, Sorghum bicolor
  misc_feature: Ceres ANNOT ID no. 8748390
  misc_feature: Encodes the peptide sequence at SEQ ID NO 20127
atggcgcaggttatgtgcactgaaaatgtaaaagagaagaaagagttgttgtatgcgttgatcaatggtaggaagctttcagaccttcctaaaattaaccagcaaaccttgataatttggggagagcaagaccgagtctttccattggaacttggattaaggctgaaaaggcatctgggagatacttccgaactagtgatcgtcaagaatgccggtcatgccataaaccgtgaaaagccagcagaactttgcagactaataaagaactacatcgttgatgatccctcggtcaaatatcgagatgaccgtaagggatcttggaagaatgtgataaagaggtttgttgggtcgagcctgagaaaggtggactcttctcgacctctgctataa

SEQ ID NO: 20127 - protein, 129 aa, Sorghum bicolor
  misc_feature: Useful for making plants with altered lignin content
  misc_feature: Functional homolog of the protein sequence given in SEQ ID NO 13198
  misc_feature: Ceres ANNOT ID no. 8748390
MAQVMCTENVKEKKELLYALINGRKLSDLPKINQQTLIIWGEQDRVFPLELGLRLKRHLGDTSELVIVKNAGHAINREKPAELCRLIKNYIVDDPSVKYRDDRKGSWKNVIKRFVGSSLRKVDSSRPLL

SEQ ID NO: 20128 - DNA, 300 bp, Sorghum bicolor
  misc_feature: Ceres ANNOT ID no. 8749322
  misc_feature: Encodes the peptide sequence at SEQ ID NO 20129
atgaaggggggcggggataaggttgactacgtcttcaaggtggtgctcatcggcgactccgccgtcggcaagtcgcagatcctggcgcgcttcgcccgcaacgagttcagcctcgactccaaggccaccatcggggtcgagttccagacccggacgcttgtcatcgaccacaagtccgtcaaggcgcagatctgggacaccgccgggcaggagaggcaattccatattttcctcttcttgtttgtttgcagactatctaaactagagtctacggataccaattgccatactattgtttag

SEQ ID NO: 20129 - protein, 99 aa, Sorghum bicolor
  misc_feature: Useful for making plants with altered lignin content
  misc_feature: Functional homolog of the protein sequence given in SEQ ID NO 13076
  misc_feature: Useful for making plants with altered terpenoid content
  misc_feature: Functional homolog of the protein sequence given in SEQ ID NO 13157
  misc_feature: Useful for making plants with altered alkaloid content
  misc_feature: Functional homolog of the protein sequence given in SEQ ID NO 13220
  misc_feature: Useful for making plants with modulated oxidative stress sensitivity
  misc_feature: Functional homolog of the protein sequence given in SEQ ID NO 13074
  misc_feature: Ceres ANNOT ID no. 8749322
  misc_feature (13)..(97): Pfam ID: Ras Pfam Description: Ras family
MKGGGDKVDYVFKVVLIGDSAVGKSQILARFARNEFSLDSKATIGVEFQTRTLVIDHKSVKAQIWDTAGQERQFHIFLFLFVCRLSKLESTDTNCHTIV

SEQ ID NO: 20130 - DNA, 1776 bp, Sorghum bicolor
  misc_feature: Ceres ANNOT ID no. 8752603
  misc_feature: Encodes the peptide sequence at SEQ ID NO 20131
atgagggtggttggaatggttgcttgggcatgcatatggctgctgctcctgcagctcgccggggcttctcatgtcgtctacgatgagaacctcgaggtggaggcggcggcagccgccgtgccgccctccattgtcgaccccctgctgaggacagggtaccatttccagcctcgcaagaactggatcaatgctccattgtactacaaggggtggtaccacatcttctaccaatacaaccccaaaggcgccgtgtggggcaacatcgtgtggggccactcggtgtcgcgagacctcatcaactgggtggccctgaagccggcgatcgagcccagcatcccgtccgacaagtacggctgctggtcagggtcggcgaccacgctccccgacggcacgccggcgatcatgtacacgggcgtgaaccgtcccgacgtgaactaccaggtgcagaacatcgcgtaccctcggaacaagtcggacccgctgctccgggagtgggtgaagccctcgcacaacccgatcatcgtccccaaggccggcgtcaacgcgacgcagttccgggaccccaccacggcgtggcgccacgccgacggcggcggccactggcggctgctcatcggcagcctggagggcgccgcccgcggcgtggcgtacgtgtaccggagccgcgacttcaagcggtggacgcgggtccggcggccgctgcactcggcggccacggggatgtgggagtgcccggacttctacccgctcagcacggccggccggcgcatgggtgtcgagacgtcgtcgtcgtcggcggcggcggcgggctctcgccgtcgtcaggcgaacaagtacgtgctgaagaacagcctggacctgcggcggtacgactactacaccatcggcacgtacgacccggcggcggagcggtacgtgccggacgaccccgccggcgacgagcgccacctgcggtacgactacggcaacttctacgcgtccaagacgttctacgacccggcgaagcggcggcggatcctgtggggctgggccaacgagtccgacaccgccgccgacgacgtcgccaaagggtgggctgggattcaggcgattccgaggacggtgtggctggatcccagcgggaagcagctgctgcagtggcctatcgaggaagtggaggcgctcagaggcaagtcggtcactctcaagaacagggtgatcaagccaggacagcacgtcgaggtgaccgggatacaaacggcacaggctgacgtggaggtgagcttcgaggtgccgagcctggcgggagcggaggcgctggacgacccggcgctcgccggcgacgcgcagcggctgtgcggcgccaggggcgccgccgtggagggcggcgtcggaccgttcgggctctgggtgctggcctccgccaaccgggaggagaggaccgccgtgttcttcagggtgttcaggcccgcgcgcggcggcggcaagccggtggtgctcatgtgcaccgacccctgcaagtcatctctggacccgaacctgtaccagccgacgtttgcaggttttgtggacacagacatttctaacggcaagatctctctgagaagcctgatcgaccggtcggttgttgagagctttggagccgggggcaagacgtgcatcctctccagggtctacccgtcgctcgccatcggcaagaacgcccgcctctacgtgttcaacaacgggaaggcggacgtcaaggtgtccagtctcaccgcatgggagatgaagaagccactcatgaatggagcttga

SEQ ID NO: 20131 - protein, 591 aa, Sorghum bicolor
  misc_feature: Useful for making plants with altered carbohydrate content
  misc_feature: Functional homolog of the protein sequence given in SEQ ID NO 13829
  misc_feature: Useful for making plants with modulated biomass
  misc_feature: Functional homolog of the protein sequence given in SEQ ID NO 13761
  misc_feature: Ceres ANNOT ID no. 8752603
  misc_feature (1)..(591): SWISSPROT Homolog: EC 3.2.1.26 Beta-fructofuranosidase
  misc_feature (54)..(381): Pfam ID: Glyco_hydro_32N Pfam Description: Glycosyl hydrolases family 32 N terminal
  misc_feature (422)..(543): Pfam ID: Glyco_hydro_32C Pfam Description: Glycosyl hydrolases family 32 C terminal
MRVVGMVAWACIWLLLLQLAGASHVVYDENLEVEAAAAAVPPSIVDPLLRTGYHFQPRKNWINAPLYYKGWYHIFYQYNPKGAVWGNIVWGHSVSRDLINWVALKPAIEPSIPSDKYGCWSGSATTLPDGTPAIMYTGVNRPDVNYQVQNIAYPRNKSDPLLREWVKPSHNPIIVPKAGVNATQFRDPTTAWRHADGGGHWRLLIGSLEGAARGVAYVYRSRDFKRWTRVRRPLHSAATGMWECPDFYPLSTAGRRMGVETSSSSAAAAGSRRRQANKYVLKNSLDLRRYDYYTIGTYDPAAERYVPDDPAGDERHLRYDYGNFYASKTFYDPAKRRRILWGWANESDTAADDVAKGWAGIQAIPRTVWLDPSGKQLLQWPIEEVEALRGKSVTLKNRVIKPGQHVEVTGIQTAQADVEVSFEVPSLAGAEALDDPALAGDAQRLCGARGAAVEGGVGPFGLWVLASANREERTAVFFRVFRPARGGGKPVVLMCTDPCKSSLDPNLYQPTFAGFVDTDISNGKISLRSLIDRSVVESFGAGGKTCILSRVYPSLAIGKNARLYVFNNGKADVKVSSLTAWEMKKPLMNGA

SEQ ID NO: 20132 - DNA, 237 bp, Sorghum bicolor
  misc_feature: Ceres ANNOT ID no. 8752605
  misc_feature: Encodes the peptide sequence at SEQ ID NO 20133
atgagatcggcacttgtagtgagctttgcttgtgcgtggctgctgctgttgcagctcgcaggagcttcgcatgtcgtctacgacgagtttttcgaggccgaggctgcgacagcgaaggtgccaccgtccatcgtcaacccccagctgaggacggggtaccacttccatccccccaagaactggatcaatggtaatgtaaagctactaagtaatcatcaaccagagccaaatttttga

SEQ ID NO: 20133 - protein, 78 aa, Sorghum bicolor
  misc_feature: Useful for making plants with altered carbohydrate content
  misc_feature: Functional homolog of the protein sequence given in SEQ ID NO 13829
  misc_feature: Ceres ANNOT ID no. 8752605
  misc_feature (10)..(63): SWISSPROT Homolog: EC 3.2.1.26 Beta-fructofuranosidase
MRSALVVSFACAWLLLLQLAGASHVVYDEFFEAEAATAKVPPSIVNPQLRTGYHFHPPKNWINGNVKLLSNHQPEPNF

SEQ ID NO: 20134 - DNA, 1758 bp, Sorghum bicolor
  misc_feature: Ceres ANNOT ID no. 8752594
  misc_feature: Encodes the peptide sequence at SEQ ID NO 20135
atggggactacgggtatggcggcggcgctgttgcttgtggcggttctgctgcactgcacgggcacggccatggtgcgggcgtcgcacactgtgtatccagagctccagtcgttggaggtggagaaggttgatgagatgtcgcgcaccgggtaccacttccagcctccaaagcactggatcaacggaccaatgtactacaaggggctgtaccatctcttctaccagtacaaccccaagggcgcggtgtggggcaacatcgagtgggcgcactcggtgtcaaccgacctgatcgactggacggcactagaccccgggatctacccgtccaagaacttcgacatcaagggctgctggtcaggctccgccaccgtgctccccagcggcatgccgatcgtcatgtacacgggcatcgaccccaacgatcaccaggtgcagaacctggcctaccccaagaacctctccgacccgttcctccgcgagtgggtcaagcccgactacaaccccatcatctcccccgacagcggcatcaacgccagcgccttccgcgacccgaccaccgcctggctcggccccgacaagcactggcgcctgctggtcggcagcagggtcgacgacaagggcctcgccgtgctgtaccggagccgggacttcaagcgctgggtcaaggcgcaccacccgctccactcgggcctcacggggatgtgggagtgcccggacttcttccccgtcgccgtccacggcggcagccgccaccaccgccgcggcgtcgacaccgccgagctgcacgacagggcgctcgccgaggaggtcaagtacgtgctcaaggtcagcctggacatgacgcgctacgagtactacaccgtggggtcctacgaccacgccacggaccgctacacccccgacgccggcttccgcgacaacgactacggcctccgctacgactacggcgacttctacgcgtccaagtcgttctacgatccggccaagcgccgccgcatcctctggggctgggctaacgagtcggacaccgtccccgatgaccgcagaaagggctgggccggcattcaggcgataccgaggaagctgtggctgtcgccgggcgggaagcagctgatccagtggccggtggaggaggtcaaggcgctgcgcgggaagcacgtgaacgtcagtgaccaggtcgtcaagggagggcagtacttcgaggtcgacggcttcaagtccgtgcagtcggacgtggaggtgacgttcgcggtcgacgacctgagcaaggcggagcagttcaacccaaagtggttcactgacccacaaaggctgtgcaagaagcggggcgcccgggagaagggcgaggtgggcccgttcgggctgtgggtgctggccgccggcgacctcacggagaggacggccgtcttcttcagggtgttcaggaccaacaccagcaggctcgtcgtactcatgtgcaacgaccctaccaactccacgttcgaggcgcaggtctaccgccccaccttcgccagcttcgtcaaccacgacatcgccaaaaccaaaaccatcgcactcaggacactgatcgaccactccgtggtggagagcttcggggccggcggaaggacgtgcatcttgtcgagggtgtacccgaagaaggccctgggcgacaacgcgcacctctttgtgttcaaccacggcgaggtggacgtcaaggtcgcgaagctggacgcctgggagatgaggacgccgaagatgaacgcgccggcgcagtag

SEQ ID NO: 20135 - protein, 585 aa, Sorghum bicolor
  misc_feature: Useful for making plants with altered carbohydrate content
  misc_feature: Functional homolog of the protein sequence given in SEQ ID NO 13829
  misc_feature: Useful for making plants with modulated biomass
  misc_feature: Functional homolog of the protein sequence given in SEQ ID NO 13761
  misc_feature: Ceres ANNOT ID no. 8752594
  misc_feature (24)..(582): SWISSPROT Homolog: EC 3.2.1.26 Beta-fructofuranosidase
  misc_feature (52)..(375): Pfam ID: Glyco_hydro_32N Pfam Description: Glycosyl hydrolases family 32 N terminal
  misc_feature (416)..(535): Pfam ID: Glyco_hydro_32C Pfam Description: Glycosyl hydrolases family 32 C terminal
MGTTGMAAALLLVAVLLHCTGTAMVRASHTVYPELQSLEVEKVDEMSRTGYHFQPPKHWINGPMYYKGLYHLFYQYNPKGAVWGNIEWAHSVSTDLIDWTALDPGIYPSKNFDIKGCWSGSATVLPSGMPIVMYTGIDPNDHQVQNLAYPKNLSDPFLREWVKPDYNPIISPDSGINASAFRDPTTAWLGPDKHWRLLVGSRVDDKGLAVLYRSRDFKRWVKAHHPLHSGLTGMWECPDFFPVAVHGGSRHHRRGVDTAELHDRALAEEVKYVLKVSLDMTRYEYYTVGSYDHATDRYTPDAGFRDNDYGLRYDYGDFYASKSFYDPAKRRRILWGWANESDTVPDDRRKGWAGIQAIPRKLWLSPGGKQLIQWPVEEVKALRGKHVNVSDQVVKGGQYFEVDGFKSVQSDVEVTFAVDDLSKAEQFNPKWFTDPQRLCKKRGAREKGEVGPFGLWVLAAGDLTERTAVFFRVFRTNTSRLVVLMCNDPTNSTFEAQVYRPTFASFVNHDIAKTKTIALRTLIDHSVVESFGAGGRTCILSRVYPKKALGDNAHLFVFNHGEVDVKVAKLDAWEMRTPKMNAPAQ

SEQ ID NO: 20136 - DNA, 1596 bp, Sorghum bicolor
  misc_feature: Ceres ANNOT ID no. 8752608
  misc_feature: Encodes the peptide sequence at SEQ ID NO 20137
atgtactacaaagggtggtaccatttcttctaccagtacaatcctaagggcgccgtgtggaacaacatcgtatgggcgcactcggtgtcacgagatctcatcaactgggtggcactaccgacggccctcagacctagcatcccgtccgacaggtacggctgctggtcgggctcggcgaccgtgcttcccgacggcacgccggtgatcatgtacaccggcatcaaccaccccgacatcaactaccaggtccagaacgtggcctaccctcggaacaagtccgatccactgctccgcgagtgggtgaagccctcgcacatgaaccccatcatcgtgccggagcgcgacatcaacgtgacacagttccgcgacccgaccacggcgtggcgcgccgccgccgacggccagtggcggctgctcatcggcagcgcgacggacggcggctcacgcggcgcagcgtacgtgtaccggagccgcgacttccggcggtggacgcgagtccggcggccgctgcactcggcgccggccacggggatgtgggagtgcccggacttctacccggtgagcagcgacgacgacggccgccgccggcgcgtcgggctcgagacgtccgttccgtcgggcccaagggtgaagcacgtgctcaagaacagcctcgacctccggcggtacgactactacaccgtcggcacgtaccaccggagagccgagcggtacgtgccggacgaccccgccggcgacggcgacggcgagcgccgcgtgcggtacgactacggcaacttctacgcgtccaagacgttctacgacccggcgaagcggcggcggatcctgtggggttgggccaacgagtccgacaccgccgccgacgatgtcgccaaagggtgggccgggattcaggcgattccgaggacggtgtggctggaccccagcgggaagcagctgctgcagtggcctatcgaggaggtggaggcgctcagaggcaaggcggtcactctcgggaagacgataatcaaggcagggcaccatgtcaaggtgaccgggatacagacggcacaggctgacgtggaggtgagcttcgaggtgtcgccgtcggccctggcgggagcggagcggctggacccggcgctcgccgacgacgccgagaggctgtgcggcgtcaagcgcgccgacgtgaagggcggcgtgggtccgttcgggctgtgggtgctggcctccgccaacctcaaggagaggaccgcggtgttcttcagggtgttcaaggccgccgccggcagcagcaacaagcacgtcgtgctcatgtgcaccgaccctaccaagtcgtctctgaacccaaacctgtaccgcccgacgtttgcaggttttgttgacacggacatttcaaatgggaagatatcgctgagaaccttgatcgacaggtcggttgttgagagctttggagctggaggcaaaacgtgcatcctctccagggtgtacccgtcgcttgccatcggcaacaaggctcacctctacgtgttcaacaacgggagggcggacgtcaaggtgtcccgtctcatcgcatgggagatgaagaagccggtcatgaacggggccaagatctag

SEQ ID NO: 20137 - protein, 531 aa, Sorghum bicolor
  misc_feature: Useful for making plants with altered carbohydrate content
  misc_feature: Functional homolog of the protein sequence given in SEQ ID NO 13829
  misc_feature: Useful for making plants with modulated biomass
  misc_feature: Functional homolog of the protein sequence given in SEQ ID NO 13761
  misc_feature: Ceres ANNOT ID no. 8752608
  misc_feature (1)..(529): SWISSPROT Homolog: EC 3.2.1.26 Beta-fructofuranosidase
  misc_feature (1)..(317): Pfam ID: Glyco_hydro_32N Pfam Description: Glycosyl hydrolases family 32 N terminal
  misc_feature (358)..(481): Pfam ID: Glyco_hydro_32C Pfam Description: Glycosyl hydrolases family 32 C terminal
MYYKGWYHFFYQYNPKGAVWNNIVWAHSVSRDLINWVALPTALRPSIPSDRYGCWSGSATVLPDGTPVIMYTGINHPDINYQVQNVAYPRNKSDPLLREWVKPSHMNPIIVPERDINVTQFRDPTTAWRAAADGQWRLLIGSATDGGSRGAAYVYRSRDFRRWTRVRRPLHSAPATGMWECPDFYPVSSDDDGRRRRVGLETSVPSGPRVKHVLKNSLDLRRYDYYTVGTYHRRAERYVPDDPAGDGDGERRVRYDYGNFYASKTFYDPAKRRRILWGWANESDTAADDVAKGWAGIQAIPRTVWLDPSGKQLLQWPIEEVEALRGKAVTLGKTIIKAGHHVKVTGIQTAQADVEVSFEVSPSALAGAERLDPALADDAERLCGVKRADVKGGVGPFGLWVLASANLKERTAVFFRVFKAAAGSSNKHVVLMCTDPTKSSLNPNLYRPTFAGFVDTDISNGKISLRTLIDRSVVESFGAGGKTCILSRVYPSLAIGNKAHLYVFNNGRADVKVSRLIAWEMKKPVMNGAKI

SEQ ID NO: 20138 - DNA, 582 bp, Sorghum bicolor
  misc_feature: Ceres ANNOT ID no. 8752870
  misc_feature: Encodes the peptide sequence at SEQ ID NO 20139
atgtttctggtggactggttctacggggtgctggcgtcgctggggctgtggcagaaggaggccaagatcctcttcctcggcctcgacaacgccggcaagaccacgctcctccacatgctcaaggatgagagattggtccagcatcagcctacacagtatccaacttctgaagagctgagcatcgggaagatcaagttcaaggcatttgatttaggaggacatcagattgctcgccgtgtttggaaggattactatgctaaggtggatgcagtggtctaccttgtggatgcctatgacaaggagcggtttgctgagtcaaagaaggagctagatgcgctcctatcagatgactccctggccactgtcccattcctgatcctggggaacaagatcgacatcccttatgccgcttcagaggaggaactccgttatcacatggggctgagcaacttcaccactggcaagggcaaggttaacctgggcgagtctaacgtccgccccctggaggtgttcatgtgcagcgttgttcgcaagatggggtacggcgatgggtttaagtgggtgtcacagtacatcaactag

SEQ ID NO: 20139 - protein, 193 aa, Sorghum bicolor
  misc_feature: The sequence is a functional homolog of SEQ ID NO 11 in US patent 7259294
  misc_feature: Ceres ANNOT ID no. 8752870
  misc_feature (6)..(192): Pfam ID: Arf Pfam Description: ADP-ribosylation factor family
MFLVDWFYGVLASLGLWQKEAKILFLGLDNAGKTTLLHMLKDERLVQHQPTQYPTSEELSIGKIKFKAFDLGGHQIARRVWKDYYAKVDAVVYLVDAYDKERFAESKKELDALLSDDSLATVPFLILGNKIDIPYAASEEELRYHMGLSNFTTGKGKVNLGESNVRPLEVFMCSVVRKMGYGDGFKWVSQYIN

SEQ ID NO: 20140 - DNA, 354 bp, Sorghum bicolor
  misc_feature: Ceres ANNOT ID no. 8752909
  misc_feature: Encodes the peptide sequence at SEQ ID NO 20141
atgccgcttcaacacccgtgctgcggcagcaccttacctccgccgcgcagccttctctctttcaaggaactcttttctgatgttggtcatatcaagcgttactccatcaactgtgacaggagtagaagatcaaagggaactgcagaggtcatcttctcaagaaggtctgatgctctagctgccgttaagaggtacaacaaatgtgctatcatcgggacaaacattcaggcaccaccaccactaccaaccgcttttttctctttcaatccaccagctggaaacttcaatttgactttcaaaaggtcagttagtaccatcgttctttgccacatgcagtgtatttttctcccctaa

SEQ ID NO: 20141 - protein, 117 aa, Sorghum bicolor
  misc_feature: Useful for making plants with modulated biomass
  misc_feature: Functional homolog of the protein sequence given in SEQ ID NO 13041
  misc_feature: Ceres ANNOT ID no. 8752909
MPLQHPCCGSTLPPPRSLLSFKELFSDVGHIKRYSINCDRSRRSKGTAEVIFSRRSDALAAVKRYNKCAIIGTNIQAPPPLPTAFFSFNPPAGNFNLTFKRSVSTIVLCHMQCIFLP

SEQ ID NO: 20142 - DNA, 297 bp, Sorghum bicolor
  misc_feature: Ceres ANNOT ID no. 8753267
  misc_feature: Encodes the peptide sequence at SEQ ID NO 20143
atggctacgacaagggagtctgccgatgatatgggagaagagctattcaccccccctctagccatattaggacctttcaccttctcctcggtctccaccgttggcgcgaagctggccgcatccacgggcatgtcggccggcggcgacggcgtcgccctcggtcagggacgcgtctggttcgagttcctcgacgacgaggacccgagccctgacctagacgacctcatgcggcacctcgcaaggaaggacttccggtgttcgcgaagttgctggggccgcaggcggcgttcagggtag

SEQ ID NO: 20143 - protein, 98 aa, Sorghum bicolor
  misc_feature: Useful for making plants with altered carbohydrate content
  misc_feature: Functional homolog of the protein sequence given in SEQ ID NO 14401
  misc_feature: Ceres ANNOT ID no. 8753267
MATTRESADDMGEELFTPPLAILGPFTFSSVSTVGAKLAASTGMSAGGDGVALGQGRVWFEFLDDEDPSPDLDDLMRHLARKDFRCSRSCWGRRRRSG

SEQ ID NO: 20144 - DNA, 249 bp, Sorghum bicolor
  misc_feature: Ceres ANNOT ID no. 8754565
  misc_feature: Encodes the peptide sequence at SEQ ID NO 20145
atggcgagcacagcatgctttgtgattgttagtaagaatgacatcccaatctatgaggctgaagttggatctgctctcaaaaaagaagatttagctcatcagcatcagttcattttgcatgctgcattggatgttgctcaggaccttgcatggtctactaatgcaatgtttctgagatcagttgatagattcagtgacttcgtcgtgtctgtatatgtaactgctggtcatatccttcgtgtactatga

SEQ ID NO: 20145 - protein, 82 aa, Sorghum bicolor
  misc_feature: Useful for biocontainment applications
  misc_feature: Functional homolog of the protein sequence given in SEQ ID NO 12968
  misc_feature: Ceres ANNOT ID no. 8754565
  misc_feature (9)..(81): Pfam ID: Sedlin_N Pfam Description: Sedlin, N-terminal conserved region
MASTACFVIVSKNDIPIYEAEVGSALKKEDLAHQHQFILHAALDVAQDLAWSTNAMFLRSVDRFSDFVVSVYVTAGHILRVL

SEQ ID NO: 20146 - DNA, 990 bp, Sorghum bicolor
  misc_feature: Ceres ANNOT ID no. 8754895
  misc_feature: Encodes the peptide sequence at SEQ ID NO 20147
atggcgattaagcattttgtagttatgctgctgcctatggccctcctgctcctcgcaacaggtagctcaccggtggtggctcagctggagctcggctactacagcaagacatgcccgaacgccgaggcgatcgtccgcgccgagatggagaagatcatctcagctgcacccagccttgctggcccgctcctcaggcttcatttccacgactgctttgtcaggggatgtgacgcttctgtcctgctcgactccaccgagggcaacctggcagagagggacgccaagccgaacaagagcctccggggatttggttccgtggagagggtgaaggccaagctcgaggccgcctgccctaacaccgtttcctgtgccgacgtcctcaccctcatggcccgtgatgccgttgtgctggccaagggcccctcctggccggtggcgctcgggaggcgagacggccgtgtgtccagcgcaacggaggcggccgagcagctacccccagcgcacggtgacatccccctgctcaccaagattttcgcttccaaaggcctcgacgtcaaggacctcgccgtcctctccggcgcgcatacccttggcacggcgcactgcccgtcctacgccggccggctctacaactacagcagcgcctacaacgcggacccctccctcgacagcgagtacgccgacaggctcaggacgcgctgcaagagcgtcgacgacagggccatgctttccgagatggatcccggcagctacaagaccttcgacacgagctactatcgccacgttgccaagcgcaggggactgttccagtccgacgccgcgctcctcaccgatgcaaccaccagggagtacgtccagcgcattgccactggcaagttcgacgacgtgttctttaaggacttcagcgagtccatgatcaagatgggcaacgttggcgtgatcaccggtgctgacggggaaattaggaagaaatgctacatcgtcaactaa

SEQ ID NO: 20147 - protein, 329 aa, Sorghum bicolor
  misc_feature: Useful for making plants with altered carbohydrate content
  misc_feature: Functional homolog of the protein sequence given in SEQ ID NO 13757
  misc_feature: Useful for making plants with altered cell wall content and/or composition
  misc_feature: Functional homolog of the protein sequence given in SEQ ID NO 14262
  misc_feature: Useful for making plants with modulated phosphate use efficiency
  misc_feature: Functional homolog of the protein sequence given in SEQ ID NO 13134
  misc_feature: Useful for making plants with modulated nitrogen use efficiency
  misc_feature: Functional homolog of the protein sequence given in SEQ ID NO 13758
  misc_feature: Ceres ANNOT ID no. 8754895
  misc_feature (27)..(329): SWISSPROT Homolog: EC 1.11.1.7 Peroxidase
  misc_feature (45)..(291): Pfam ID: peroxidase Pfam Description: Peroxidase
MAIKHFVVMLLPMALLLLATGSSPVVAQLELGYYSKTCPNAEAIVRAEMEKIISAAPSLAGPLLRLHFHDCFVRGCDASVLLDSTEGNLAERDAKPNKSLRGFGSVERVKAKLEAACPNTVSCADVLTLMARDAVVLAKGPSWPVALGRRDGRVSSATEAAEQLPPAHGDIPLLTKIFASKGLDVKDLAVLSGAHTLGTAHCPSYAGRLYNYSSAYNADPSLDSEYADRLRTRCKSVDDRAMLSEMDPGSYKTFDTSYYRHVAKRRGLFQSDAALLTDATTREYVQRIATGKFDDVFFKDFSESMIKMGNVGVITGADGEIRKKCYIVN

SEQ ID NO: 20148 - DNA, 645 bp, Sorghum bicolor
  misc_feature: Ceres ANNOT ID no. 5254890
  misc_feature: Encodes the peptide sequence at SEQ ID NO 20149
atggcgcccgctgtggaagccgtgaaggagactggctcgttccaaaaggttcctgccttgaacgaaaggatactgtcaaccatgtccaggagatctgttgctgcccacccttggcatgatctggagataggtcctggcgctccaaccatattcaactgtgtcattgagattcccaggggcagcaaggttaagtatgaacttgacaagaaaactggattgatcaaggtggaccgtgtgctgtattcatcagttgtttaccctcacaactatggattcattccacgcacactttgtgaagacagtgatcctttggatgtactggttataatgcaggagccagttatcccaggctgtttcctacgtgcaaaggccatcggcgttatgcccatgattgatcaaggagaggcagacgacaagatcattgcagtgtgtgctgatgatcctgagtacaagcactacaatgatatcaaggacctcccacctcaccgcttggctgaaatcaggcgcttctttgaagactacaagaagaatgagaacaaggaggttgctgtgaacgactttctgcctgcaactgaagcttatgaagtcatacagcactctatggatctgtatgctacctacattgttgagggcctgaggagatag

SEQ ID NO: 20149 - protein, 214 aa, Sorghum bicolor
  misc_feature: Useful for making plants with modulated nitrogen use efficiency
  misc_feature: Functional homolog of the protein sequence given in SEQ ID NO 13344
  misc_feature: Ceres ANNOT ID no. 5254890
  misc_feature (1)..(214): SWISSPROT Homolog: EC 3.6.1.1 Inorganic diphosphatase
  misc_feature (52)..(206): Pfam ID: Pyrophosphatase Pfam Description: Inorganic pyrophosphatase
MAPAVEAVKETGSFQKVPALNERILSTMSRRSVAAHPWHDLEIGPGAPTIFNCVIEIPRGSKVKYELDKKTGLIKVDRVLYSSVVYPHNYGFIPRTLCEDSDPLDVLVIMQEPVIPGCFLRAKAIGVMPMIDQGEADDKIIAVCADDPEYKHYNDIKDLPPHRLAEIRRFFEDYKKNENKEVAVNDFLPATEAYEVIQHSMDLYATYIVEGLRR

SEQ ID NO: 20150 - DNA, 1089 bp, Sorghum bicolor; identical to SEQ ID NO: 15178
  misc_feature: Ceres ANNOT ID no. 5254892
  misc_feature: Encodes the peptide sequence at SEQ ID NO 20151

SEQ ID NO: 20151 - protein, 362 aa, Sorghum bicolor; identical to SEQ ID NO: 15179
  misc_feature: The sequence is a functional homolog of SEQ ID NO 1685 in the 10/412,699 US patent application
  misc_feature: The sequence is a functional homolog of SEQ ID NO 1687 in the 10/412,699 US patent application
  misc_feature: The sequence is a functional homolog of SEQ ID NO 2660 in the 10/374,780 US patent application
  misc_feature: The sequence is a functional homolog of SEQ ID NO 74 in the 10/225,066 US patent application
  misc_feature: The sequence is a functional homolog of SEQ ID NO 926 in the 10/412,699 US patent application
  misc_feature: The sequence is a functional homolog of SEQ ID NO 1688 in the 10/412,699 US patent application
  misc_feature: The sequence is a functional homolog of SEQ ID NO 1686 in the 10/412,699 US patent application
  misc_feature: The sequence is a functional homolog of SEQ ID NO 1418 in the 10/666,642 US patent application
  misc_feature: The sequence is a functional homolog of SEQ ID NO 200 in the 10/225,068 US patent application
  misc_feature: The sequence is a functional homolog of SEQ ID NO 2428 in the 10/374,780 US patent application
  misc_feature: The sequence is a functional homolog of SEQ ID NO 942 in the 11/435,388 US patent application
  misc_feature: The sequence is a functional homolog of SEQ ID NO 2201 in the 10/666,642 US patent application
  misc_feature: The sequence is a functional homolog of SEQ ID NO 865 in the 10/666,642 US patent application
  misc_feature: Useful for making plants with modulated biomass
  misc_feature: Useful for making plants with modulated heat sensitivity
  misc_feature: Functional homolog of the protein sequence given in SEQ ID NO 13700
  misc_feature: The sequence is a functional homolog of SEQ ID NO 2203 in the 10/666,642 US patent application
  misc_feature: The sequence is a functional homolog of SEQ ID NO 2205 in the 10/666,642 US patent application
  misc_feature: The sequence is a functional homolog of SEQ ID NO 2207 in the 10/666,642 US patent application
  misc_feature: The sequence is a functional homolog of SEQ ID NO 142 in the 10/666,642 US patent application
  misc_feature: The sequence is a functional homolog of SEQ ID NO 422 in the 10/666,642 US patent application
  misc_feature: The sequence is a functional homolog of SEQ ID NO 816 in the 11/435,388 US patent application
  misc_feature: Ceres ANNOT ID no. 5254892
  misc_feature (44)..(214): Pfam ID: HSF_DNA-bind Pfam Description: HSF-type DNA-binding

SEQ ID NO: 20152 - DNA, 1194 bp, Sorghum bicolor
  misc_feature: Ceres ANNOT ID no. 8464990
  misc_feature: Encodes the peptide sequence at SEQ ID NO 20153
atgagcgccaagatcaatggggcagcagcagctgctgcattcctgctcttctacactcacctctacttcccaaccactgttcatctctactcctcagccactccattgcttggagccctcgttaatcttacaacgccttcccttccattatacccgttttcggttgattccacctctacccatcatcagtatgactgtaaatacaacccgctatgcgacgacttcccaccggattttcccccgcccgacataccagcagtgtccatcttctgtgtcgatcccaatggctgttgtgaattcacaaccgtgcaggcggcggtcgatgcagttccaaaccacagcagcaaaaggaatgttgtgtggatcaacaagggcatctactttgagaaggtgacagtcccagcatccaagcccaacatcacattccaagggcaggggttcgacctgacagcgatcgcgtggaacgatactgccaagtcggcgaacggcacattctatagcgcctcagtctctgttttcgcatcaggattcattgcgaagaacataagcttcattaatgtagcaccaattccaaggcctggcgctgtcgatgcacaggcagtggcaatcaggatcaatggtgaccaagcagcattctggggttgtggcttctttggagcgcaagacacactccatgacgacagaggccggcattacttcaaggaatgtttcatccagggctccattgactttatctttggagatgctaggtcactctatgaaaattgcagattgatatctattgcagacccagtgccttcagggcaaagatcaattactggttcagtcactgcacatgcccgggtatcagaagatgacaacactggctactcatttgtcaattgtagcataggtggcaccggttggatatggcttggacgagcatggagaccatattctcgggtcatctttgcctacacatcaatgtcagacatcatagcttctgaaggatggaatgactggaatgaccacacaagagatcagactgtattttatggagagtacaagtgtacaggtgatggtgcaaacctggcagatagagtgccttatgctcagaagcttagtgatgtgcaagtgttaccttacctgaacacatctttcatcgatggagatcaatggctgaaaccatactgtgactcactaatatctgcttga

SEQ ID NO: 20153 - protein, 397 aa, Sorghum bicolor
  misc_feature: Useful for making plants with altered carbohydrate content
  misc_feature: Functional homolog of the protein sequence given in SEQ ID NO 14564
  misc_feature: Useful for making plants with altered cell wall content and/or composition
  misc_feature: Functional homolog of the protein sequence given in SEQ ID NO 14565
  misc_feature: Ceres ANNOT ID no. 8464990
  misc_feature (92)..(387): SWISSPROT Homolog: EC 3.1.1.11 Pectinesterase
  misc_feature (92)..(384): Pfam ID: Pectinesterase Pfam Description: Pectinesterase
MSAKINGAAAAAAFLLFYTHLYFPTTVHLYSSATPLLGALVNLTTPSLPLYPFSVDSTSTHHQYDCKYNPLCDDFPPDFPPPDIPAVSIFCVDPNGCCEFTTVQAAVDAVPNHSSKRNVVWINKGIYFEKVTVPASKPNITFQGQGFDLTAIAWNDTAKSANGTFYSASVSVFASGFIAKNISFINVAPIPRPGAVDAQAVAIRINGDQAAFWGCGFFGAQDTLHDDRGRHYFKECFIQGSIDFIFGDARSLYENCRLISIADPVPSGQRSITGSVTAHARVSEDDNTGYSFVNCSIGGTGWIWLGRAWRPYSRVIFAYTSMSDIIASEGWNDWNDHTRDQTVFYGEYKCTGDGANLADRVPYAQKLSDVQVLPYLNTSFIDGDQWLKPYCDSLISA

SEQ ID NO: 20154 - DNA, 1743 bp, Sorghum bicolor
  misc_feature: Ceres ANNOT ID no. 8631367
  misc_feature: Encodes the peptide sequence at SEQ ID NO 20155
atggatcctaccactattgattcgaaatggacgtctcccatcactgaagatgggtccatggacagacgaggaaacccagctgtcaagacaaccaccggaggatggagatctgccatcctgctgttagctaactatggactcgcgacgtgcgccttcttcggcgtcggcgtgaacctcgtggtgttcctgcgccgggtgctccaccagggcaacgccgaggcggccaacaacatcagcaagtggacagggaccgtctacatcttctccctcatcggcgccttcctcagcgactcctactggggccgttacgtcacctgcgccatctttcagatcatctatgtgacgggcctggtgatcctgtcgcttgcgtcatggttcttgttggtgaagccctccggctgcggcggcgtcaaggtgcactgcgacgagccgtcggcgcccggcgtcgcgctgttctacctgtccacctacatgatcgcgttcggcaacggagggtaccagccttccatcgcgaccttcggatcggaccagttcgacgagacggaccccaaggaggggcgctccaaggtcgccttcttcagctacttctacctggcgctcaacgtggggtccctgttttccaacacggtgctggtgtactacgaggactcagggcggtgggtcatggggttctgggtctcggcggccgccgccgcgctggcgctcgtgctcttcttgctcggcacgcccaactaccggcacttcaagccgagcggcaacccgctgacccgcgtcgcgcaggtgttcgtcgccgcgttccgcaagtggcacgctgaggttccccgcggcgagctcctccacgaggtggaaggagaggaccctaagatctcgggcatccgcaagatccttcacagcgacgagctcaggttcctcgacaaagcggcgacgatcaccgagggggagaagatggagaacccgtggaggctctgcacggtgacgcaggtggaggaggtgaagtgcatcctgaagatgctgcccatctggctgtgcacgatcgtgtactcggtggtgttcacccagatggcgtcgctgttcgtggagcagggcgccaccatggacaccaacatcgggtcgttccacttccccgcagcgagcatgtcgctgttcgacgtcctcagcgtgctggcgttcatcgccatctaccggcgggtcctggtgcccgtcatggcgcggctgtcgggcaacccgcagggcctgacggagctgcagcgcatgggcgtcgggctcgtgatcggcatggcggcgatggtggtggcgggcgtggtggaggtggagcggctgaagcgcgtggcagccccggaccagccgagctccctgagcgtgctgtggcaggtgccgcagtacgcgctgatcggggcgtcggaggtgttcatgtacgtggggcagctggagttcttcaacgggcaggcgcccgacggcgtcaagagcttcggcagcgcgctgtgcatggcgtccatctcgctggggaactacgtgagcatcatgctggtgagcgtggtcacaagcctcaccgccggggagaagcgtccggggtggatccctgggaacctcaactccggccacctggacaggttctacttcctcctcgcagcgctctcgctcgtcgacctcgccgtctacatcgcctgtgccatgtggtacaagggcatcaagcttgacggcggcgacggcgatgacagtagaaaggtctctgcgcatgtctag

SEQ ID NO: 20155 - protein, 580 aa, Sorghum bicolor
  misc_feature: Useful for making plants with altered carbon content
  misc_feature: Useful for making plants with altered nitrogen content
  misc_feature: Functional homolog of the protein sequence given in SEQ ID NO 14559
  misc_feature: Ceres ANNOT ID no. 8631367
  misc_feature: Up-regulated in shoot tissues in response to salicylic acid treatment
  misc_feature (103)..(499): Pfam ID: PTR2 Pfam Description: POT family
MDPTTIDSKWTSPITEDGSMDRRGNPAVKTTTGGWRSAILLLANYGLATCAFFGVGVNLVVFLRRVLHQGNAEAANNISKWTGTVYIFSLIGAFLSDSYWGRYVTCAIFQIIYVTGLVILSLASWFLLVKPSGCGGVKVHCDEPSAPGVALFYLSTYMIAFGNGGYQPSIATFGSDQFDETDPKEGRSKVAFFSYFYLALNVGSLFSNTVLVYYEDSGRWVMGFWVSAAAAALALVLFLLGTPNYRHFKPSGNPLTRVAQVFVAAFRKWHAEVPRGELLHEVEGEDPKISGIRKILHSDELRFLDKAATITEGEKMENPWRLCTVTQVEEVKCILKMLPIWLCTIVYSVVFTQMASLFVEQGATMDTNIGSFHFPAASMSLFDVLSVLAFIAIYRRVLVPVMARLSGNPQGLTELQRMGVGLVIGMAAMVVAGVVEVERLKRVAAPDQPSSLSVLWQVPQYALIGASEVFMYVGQLEFFNGQAPDGVKSFGSALCMASISLGNYVSIMLVSVVTSLTAGEKRPGWIPGNLNSGHLDRFYFLLAALSLVDLAVYIACAMWYKGIKLDGGDGDDSRKVSAHV

SEQ ID NO: 20156 - DNA, 987 bp, Sorghum bicolor
  misc_feature: Ceres ANNOT ID no. 8755008
  misc_feature: Up-regulated in shoot tissues in response to salicylic acid treatment
  misc_feature: Encodes the peptide sequence at SEQ ID NO 20157
atgccgggaatggacccgggcgggggcggcagctcgcgctacttccaccagctgctgcggccgcagcagcagcagcagccgtcgccgctgtcgcccaattcccacgtcaagatggagcaccaccacaagatgtctccggacaagagccccgtcggtggcgaggccgaggcgggcgggagcggcggcggcggcgaccagccgtcctcgtcggctttggtcccagtcgagggtggcagcggcgggggaggaggcagcgggtcgggcacgcccacgcggcggccgcggggccgcccgccggggtccaagaacaagcctaagccgcccatcatcgtgacgcgcgacagccccaacgcgctgcactcgcacgtcctcgaggtcgccgcgggagccgacgtcgtggactgcgtcgcggagtacgcgcgccgccggggtcgaggcgtgtgcgtgctcagcggcgggggcgccgtcgtcaacgtggcgctcaggcagcccggcgcgtcgccccccgggagcatggtggccacgctgaggggacggttcgagatcctctccctcaccggcaccgtgctgccgccgcccgctccccccggcgcgagtggcctcacggtgttcctctccggcgggcagggccaggtcatcggcgggagcgtggtgggcccactggtcgccgcggggcccgttgtcctgatggctgcgtcgttcgccaacgccgtgtacgagcggctcccgctggagggggaggaagaggagacagccgcggctgccgccggagccgaaccacaagatcaagtggcgcagtcggctggacccccaggtcagcagccgacggcgtctcagtcctctggtgtgaccggaggaggcgacgccggcggcggcggcatgtcgctctacaacctcgctgggaatgtaggggcctaccagctaccgggagacaacttcggaggctggagtggaggcggtggcggcggagtccggccaccgttttga

SEQ ID NO: 20157 - protein, 328 aa, Sorghum bicolor
  misc_feature: The sequence is a functional homolog of SEQ ID NO 10 in the 10/669,824 US patent application
  misc_feature: The sequence is a functional homolog of SEQ ID NO 10 in the 10/870,198 US patent application
  misc_feature: The sequence is a functional homolog of SEQ ID NO 1399 in the 10/374,780 US patent application
  misc_feature: The sequence is a functional homolog of SEQ ID NO 1509 in the 10/412,699 US patent application
  misc_feature: The sequence is a functional homolog of SEQ ID NO 340 in the 11/435,388 US patent application
  misc_feature: The sequence is a functional homolog of SEQ ID NO 342 in the 10/714,887 US patent application
  misc_feature: Ceres ANNOT ID no. 8755008
MPGMDPGGGGSSRYFHQLLRPQQQQQPSPLSPNSHVKMEHHHKMSPDKSPVGGEAEAGGSGGGGDQPSSSALVPVEGGSGGGGGSGSGTPTRRPRGRPPGSKNKPKPPIIVTRDSPNALHSHVLEVAAGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEETAAAAAGAEPQDQVAQSAGPPGQQPTASQSSGVTGGGDAGGGGMSLYNLAGNVGAYQLPGDNFGGWSGGGGGGVRPPF

SEQ ID NO: 20158 - DNA, 3051 bp, Sorghum bicolor
  misc_feature: Ceres ANNOT ID no. 8631380
  misc_feature: Up-regulated in root tissues in response to salicylic acid treatment
  misc_feature: Encodes the peptide sequence at SEQ ID NO 20159
atggagaagctgccgacctacgaccgcatgcgccagggcatcctccggcaggcgctcgccgccggcgaccaacaacagagcggcggcgtcgaggtggtggacatccagaagctggccggcggcgacgggggccgtgaactcttggagcgcctcttccaggacgacagcgagcgattcctgcgccggctcagggaccgaatcgacatggttggcatcgagctcccgaccatcgaggttcggtatgagcagctgaatgtggaggctgacgtcatcgccgccggtcgcgccctccccacgctctggaacgctgccaccaatcttttcgagggtctcattggacggtttggttcttcaaacaagaggaacatcaccatacttaagaatgtcaatggtatcctcaagccttccaggatgacgcttcttcttgggcctccatcctcaggaaagagcacgctcatgcgagcactcgctggcaagcttgacaaaaatctcaaggtctctggcagcatcacgtattgtggccatccaatctcagagttctatcctgagaggactagcgcatatgttggtcaatatgatctccacaatgccgagatgactgtaagagagacgctggatttctccaggcgatgcctaggcattggtgccagatatgagatgatagcagaacttgctagaagggagcgggatgcaggcattaagccagatcctgagattgatgctttcatgaaagctactgcagtacaaggacaggagactaatattataacagatctcactctcaaggtgcttgggctggacatttgtgctgatgttattattggcgatgagatgatcagaggaatttctggtgggcaaaagaaacgtgtgacaactggggagatgttaacgggaccagcaagggctttatttatggacgaaatatcaactggtctggatagctcaagcacatttcagattgtaaagtttatgaggcaattggtccatgtaatgaatgaaaccgtcatgatctctctgctccagccaccgccagagacctacaatctttttgatgacataatcctgctatcagaaggatacatagtctaccatgggccacgggagaatatattggaattctttgagtctgccggtttccggtgccctgacaggaaaggtgttgcagactttcttcaagaggttacttccaagaaagaccaacagcaatactggtaccttgatcaggagcagtatcattatgtatctgtaccagactttgcacaacgtttcaagtcattccatgcatgccagcagatgcagaaggagttgcaaattccttttgaaaagtccaaaacccatcctgctgcgttgaccaccagaaaatatggtctttccagctgggaatcactcaaggcagtgatgtcgagagagcaactattgatgaagcgcaactccttcatctatattttcaaggtcacccagctgatcatccttgcactcatgtccatgactgtgtttctcagaacaaagatgccccatgggcagattgctgatggcaccaaattctttggggctctgacttttggtttaataacgatcatgttcaatgggtttgctgagctacaattgaccataaagaagcttccagttttctacaaacatagggatttcttattcttccctgcatggaccttaggagtggcaaacataatcttaaaagttcctgtctcgctcgtggaatcagcagtatgggttgctctcacgtactatgtgatgggctttgcacctgctgcaggaaggttctttcgtcagtttatagctttctttgccacacaccaaatggcaatggctttattccggtttcttggtgctatattgaaaacaatggttgtggccaatacttttgggatgtttgtgctgctcattattttcatctttggaggatttgtcatccgtagaaatgacatcaaaccatggtggatctggggttattgggcatcacctatgatgtatagtcaaaatgcaatatctatcaacgaattccttgctagtaggtgggctattccaaacaatgacacgactattgatgcaccaacagtaggcaaagcaattctaaaatccaaaggcttgtttactggagaatggggattttggctatccatcggagcccttataggattcattattttgttcaacatgctctacatttgggcccttacatatttaagtcgcactaatggagcaacaaacacactagctgagtcacgagtcactttgcctttccagcctctttcactttgctttaaccatgtaaactattatgttgacatgcctgcagaaatgaaggaacaaggattcacagaaagccgtttacaactgctctctgatatcagtggtgcttttaggccaggggttctgacagcattagttggtgtgagtggagctggaaagaccactttaatggatgtcctggcaggaaggaaaactagtggagctattgaaggagatattaccctgtccggtttccccaagaaacaagaaacttttgcccggattagtggttattgtgaacaaactgatatccattctccgaatgttactgtatttgaatccatcacctactctgcctggctgcgtctttcctcagacattgatgatggtacgaaaaagatgtttgtggaagaagtgatggcccttgtagagcttgatgtgttgcgcgacgctcttgtgggtctccctggagttagtggattatcaactgagcaaagaaaaaggctgacaattgctgtggagctggtagcaaacccttcaatcatcttcatggatgagccaacctctggtctcgatgctcgagctgcagcaattgtcatgcgtacagtaagaaatacagttaacactgggcgtactgtggtctgcacaatccatcagcccagcatcgacatatttgagtcttttgatgagcttctgcttttgaaacgtggaggtcaggttatttatgctggtgaacttggtcgccactctcacaaattagttgaatattttgaggtcagacctcttttcttatgtgtttga
